(12) United States Patent
Akilesh et al.

(10) Patent No.: US 12,234,506 B2
(45) Date of Patent: Feb. 25, 2025

(54) METHODS AND COMPOSITIONS FOR VIRAL NANO-FISH

(71) Applicant: ALTIUS INSTITUTE FOR BIOMEDICAL SCIENCES, Seattle, WA (US)

(72) Inventors: Shreeram Akilesh, Seattle, WA (US); John A. Stamatoyannopoulos, Seattle, WA (US); Alessandra Sullivan, Seattle, WA (US); William Kerwin, Seattle, WA (US); Tobias Ragoczy, Seattle, WA (US); Pavel Zrazhevskiy, Seattle, WA (US); Vivek Nandakumar, Seattle, WA (US)

(73) Assignee: Altius Institute for Biomedical Sciences, Seattle, WA (US)

( * ) Notice: Subject to any disclaimer, the term of this patent is extended or adjusted under 35 U.S.C. 154(b) by 118 days.

(21) Appl. No.: 16/631,632

(22) PCT Filed: Jul. 19, 2018

(86) PCT No.: PCT/US2018/042973
§ 371 (c)(1),
(2) Date: Jan. 16, 2020

(87) PCT Pub. No.: WO2019/018700
PCT Pub. Date: Jan. 24, 2019

(65) Prior Publication Data
US 2021/0310058 A1    Oct. 7, 2021

Related U.S. Application Data

(60) Provisional application No. 62/659,687, filed on Apr. 18, 2018, provisional application No. 62/636,088, (Continued)

(51) Int. Cl.
| C12Q 1/6841 | (2018.01) |
| A61K 39/00  | (2006.01) |
| C12Q 1/6876 | (2018.01) |

(52) U.S. Cl.
CPC .......... C12Q 1/6841 (2013.01); A61K 39/461 (2023.05); A61K 39/4611 (2023.05);
(Continued)

(58) Field of Classification Search
CPC ....... C12Q 1/6841; C12Q 1/6876; C12Q 1/70
See application file for complete search history.

(56) References Cited

U.S. PATENT DOCUMENTS 5,474,796 A * 12/1995 Brennan .................. A01N 1/02
427/2.13
6,107,088 A    8/2000 Korneluk et al.
(Continued)

FOREIGN PATENT DOCUMENTS

DE    4038293       6/1992
WO    2013101893    7/2013
(Continued)

OTHER PUBLICATIONS

Alonas, E et al. Methods 98:91-98 (Feb. 12, 2016). (Year: 2016).*
(Continued)

*Primary Examiner* — Diana B Johannsen
(74) *Attorney, Agent, or Firm* — Bozicevic, Field & Francis LLP; Shweta Chandra

(57) ABSTRACT

Disclosed herein are methods of detecting a target viral nucleic acid sequence, determining the localization of the target viral nucleic acid sequence, and/or quantifying the number of target viral nucleic acid sequences in a cell. This method may be used on small target nucleic acid sequences, and may be referred to as Nano-FISH or viral Nano-FISH.

13 Claims, 71 Drawing Sheets

Specification includes a Sequence Listing.

Nano-FISH localizes chromosome territories

Chromosome 19
1.6 kb target region

Chromosome 18
1.4 kb target region

Related U.S. Application Data filed on Feb. 27, 2018, provisional application No. 62/583,427, filed on Nov. 8, 2017, provisional application No. 62/534,669, filed on Jul. 19, 2017.

(52) U.S. Cl.
CPC .. *A61K 39/4631* (2023.05); *A61K 39/464412* (2023.05); *A61K 39/464413* (2023.05); *A61K 39/464417* (2023.05); *A61K 39/464453* (2023.05); *A61K 39/464462* (2023.05); *A61K 39/464466* (2023.05); *A61K 39/46447* (2023.05); *C12Q 1/6876* (2013.01); *A61K 2239/48* (2023.05); *A61K 2239/49* (2023.05); *A61K 2239/55* (2023.05); *A61K 2239/59* (2023.05)

(56) References Cited

U.S. PATENT DOCUMENTS

| | | | |
|---|---|---|---|
| 11,353,400 | B2 | 6/2022 | Stamatoyannopoulos et al. |
| 2003/0027159 | A1 | 2/2003 | Ward et al. |
| 2003/0087279 | A1 | 5/2003 | Shao et al. |
| 2003/0170689 | A1 | 9/2003 | Stamatoyannopoulos et al. |
| 2007/0204354 | A1 | 8/2007 | Nomura |
| 2012/0322692 | A1 | 12/2012 | Pham et al. |
| 2014/0073520 | A1 | 3/2014 | Cai et al. |
| 2016/0046984 | A1 | 2/2016 | Nguyen et al. |
| 2022/0397526 | A1* | 12/2022 | Stamatoyannopoulos ........... G01N 33/574 |

FOREIGN PATENT DOCUMENTS

| | | |
|---|---|---|
| WO | 2014036525 | 3/2014 |
| WO | 2014204727 | 12/2014 |
| WO | 2015002978 | 1/2015 |
| WO | 2018017774 | 1/2018 |
| WO | 2018035387 | 2/2018 |

OTHER PUBLICATIONS

Baranyi, L. et al. Human Gene Therapy Methods 24:214-227. Aug. 2013. (Year: 2013).*
Beliveau, B.J. et al. Nature Communications 6:7147. May 2015. (Year: 2015).*
Zufferey, R. et al. Journal of Virology 72(12):9873-9880. Dec. 1998 (Year: 1998).*
Ni, Y. et al. ELIFE 6:e21660 (23 pages). May 9, 2017 (Year: 2017).*
Goel, G. et al. Journal of Applied Microbiology 99:435-442. (Year: 2005).*
Beliveau et al., (2012) "Versatile designand synthesis platform for visualizing genomes with Oligopaint FISH probes", Proceedings of the National Academy of Sciences of the United States of America, (109)52:21301-21306.
Ma et al., (2015) "Multicolor CRISPR labeling of chromosomal loci in human cells", Proceedings of the National Academy of Sciences of the United States of America, (112)10:3002-3007.
Reisinger et al., (2006) "Visualization of episomal and integrated Epstein-Barr virus DNA by fiber fluorescencein situ hybridization", International Journal of Cancer, (118)7:1603-1608.
European Patent Office Examination Report, 18750070.7, Sep. 2, 2021, 1-5.
Fu et al., Promises and Pitfalls of Intracellular Delivery of Proteins. Bioconjugate Chemistry, 25, 1602-1608, 2014.
Namdev et al., Challenges and approaches for Oral protein and peptide drug delivery. Research J. Pharm. and Tech., 9(3), 305-312, 2016.
Rehman et al., Delivery of Therapeutic Proteins: Challenges and Strategies. Current Drug Targets, 17, 1172-1188, 2016.
Kotterman, et al., Engineering adeno-associated viruses for clinical gene therapy. Nature Reviews, 15,445-451,2014.
Shim, et al., Nonviral Delivery Systems for Cancer Gene Therapy: Strategies and Challenges. Current Gene Therapy, 18,3-20, 2018.
Lenziet al., NCBI Bookshelf, A Service of the Nationa l Library of Medicine, National Institute of Health, Oversight and Review of Clinical Gene Transfer Protocols :Assessing the Role of the Recombinant DNA Advisory Committee. Washington(DC): National Academies Press (US), pp. 1-16, 2014.
Chimeric nuclease and "Apoptosis" from Wikipedia. Printed on Jun. 10, 2022, (two pages).
Corrigan et al., "A continuum model of transcriptional bursting", eLife, 2016, 5:e13051 (38 pages).
Gen Bank data sheet, "H1N1 Influenza segment 4", printed on Aug. 20, 2020, 2020, pp. 1-2.
Gen Bank data sheet, "H1N1 Influenza segment 5", printed on Aug. 21, 20, 2020, pp. 1-2.
Gen Bank data sheet, "H1N1 Influenza segment 6", printed on Aug. 20, 20, 2020, pp. 1-2.
Raj et al., "Imaging individual mRNA molecules using multiple singly labeled probes", Nature Methods, Sep. 21, 2008, 5(10):877-879.

* cited by examiner

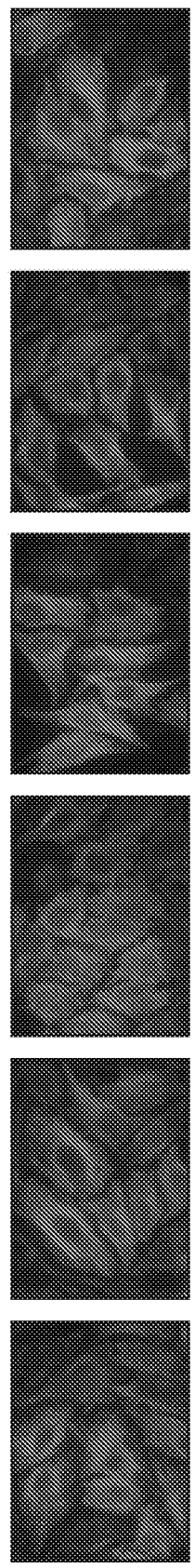
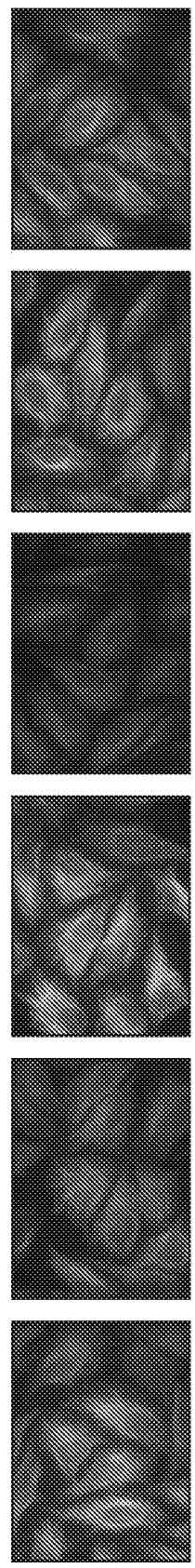
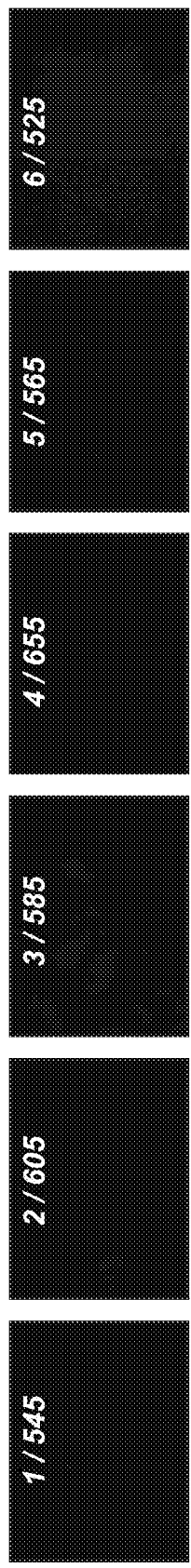
FIG. 9A β-Tubulin (M) -> RaM-ssDNA -> QDot655-Rb
FIG. 9B β-Tubulin (M) -> RaM-ssDNA -> QDot-ssDNA'
FIG. 9C Control -> QDot-ssDNA'
1/545  2/605  3/585  4/655  5/565  6/525

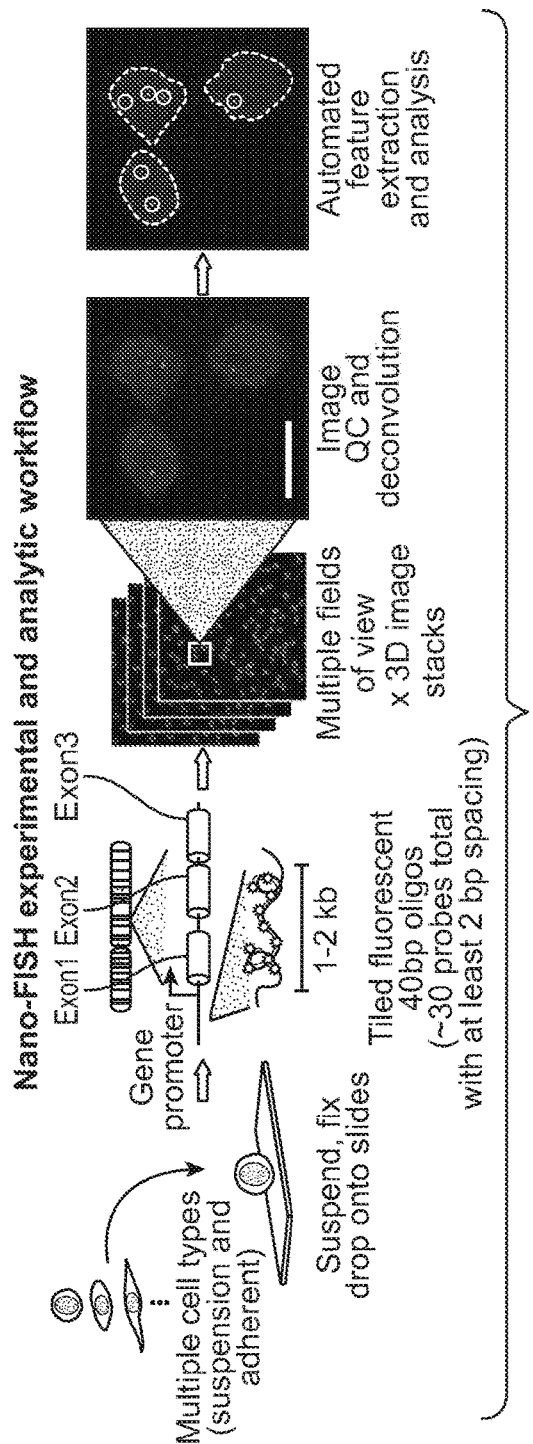
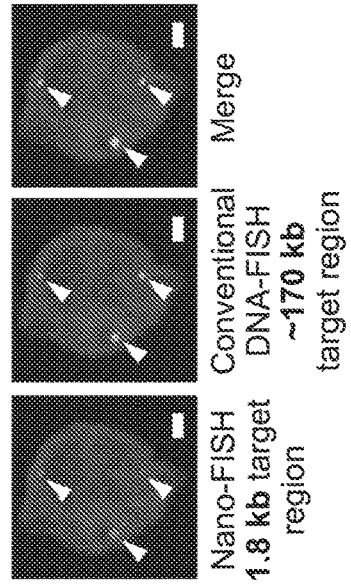
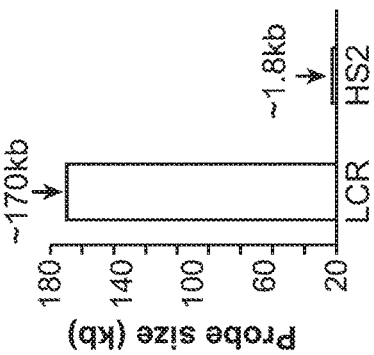
FIG. 33A
FIG. 33B    FIG. 33    FIG. 33C

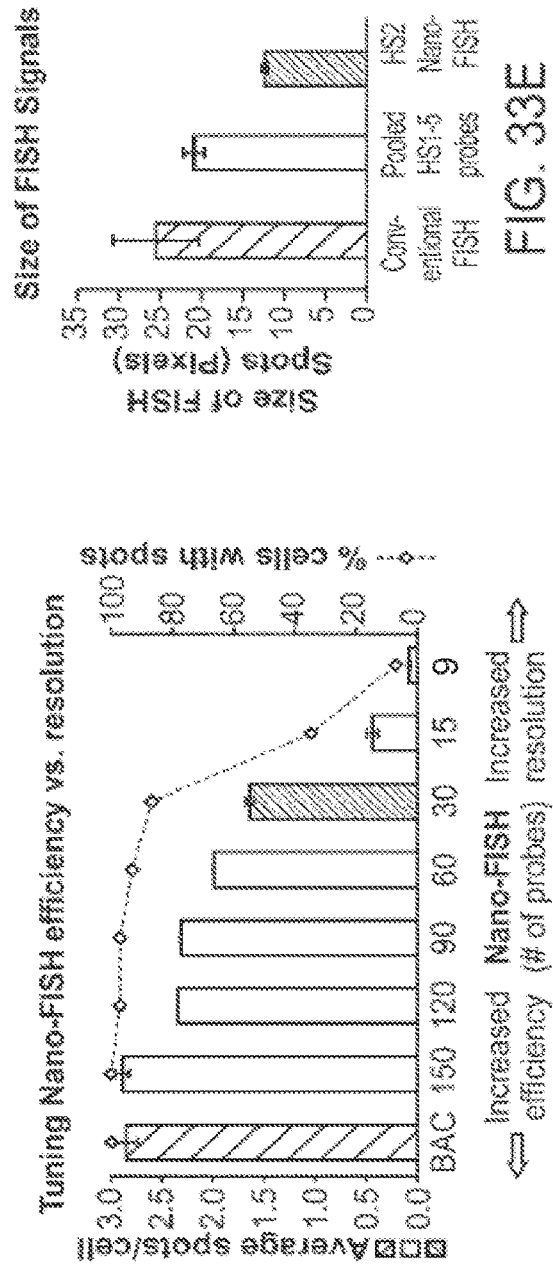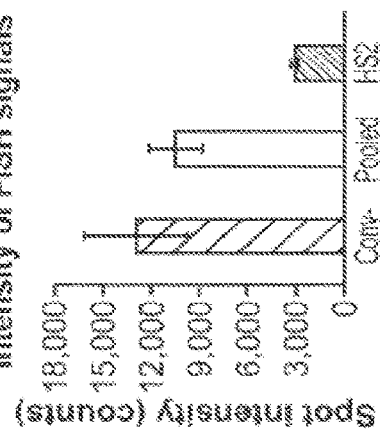
FIG. 33D
FIG. 33E
FIG. 33F
FIG. 33G

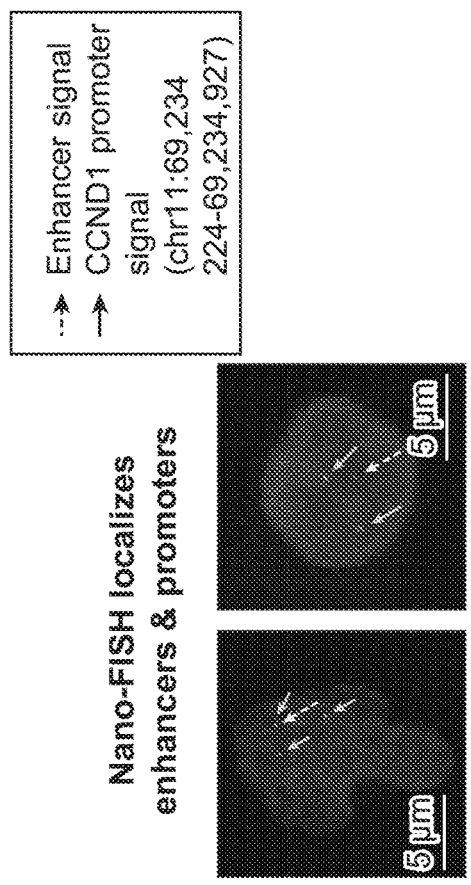
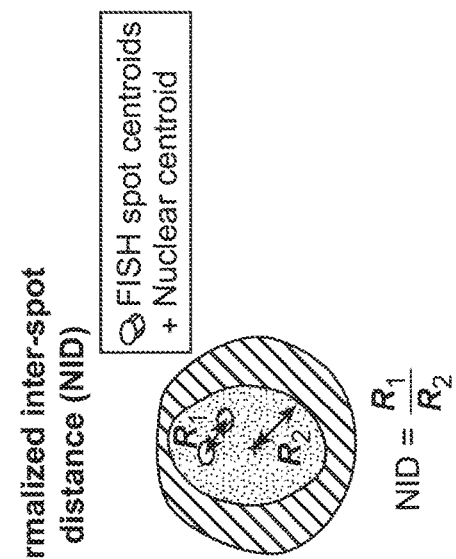
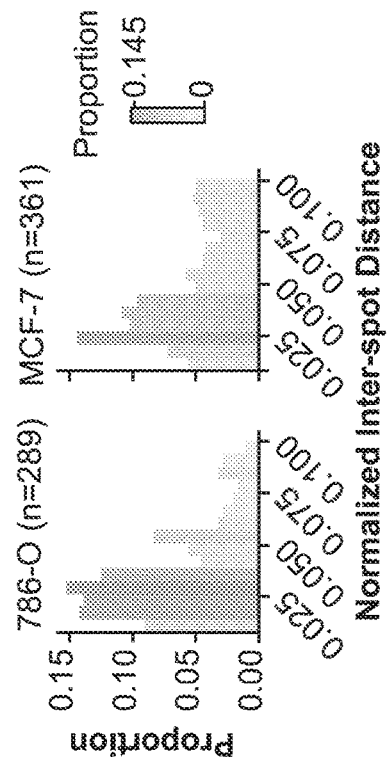
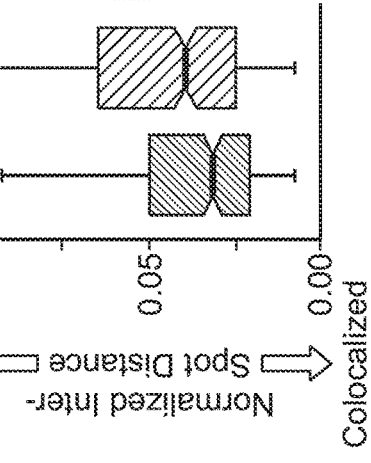
FIG. 35A
FIG. 35B
FIG. 35C
FIG. 35D

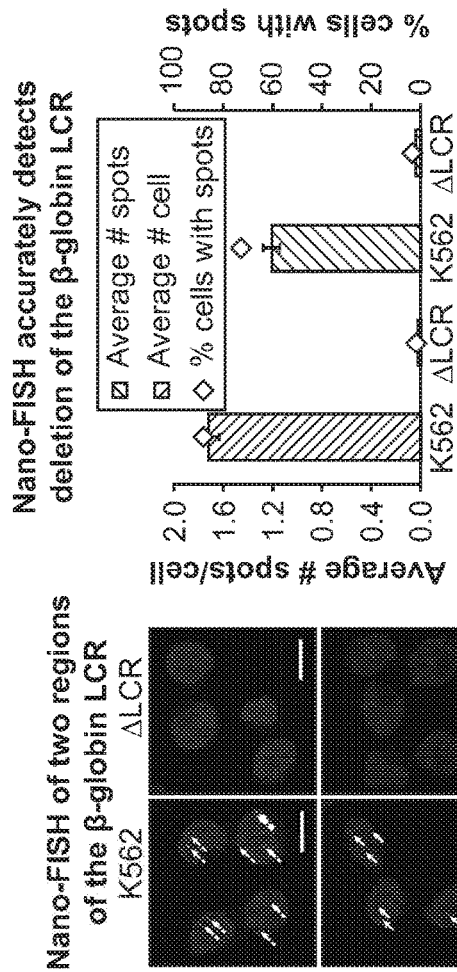
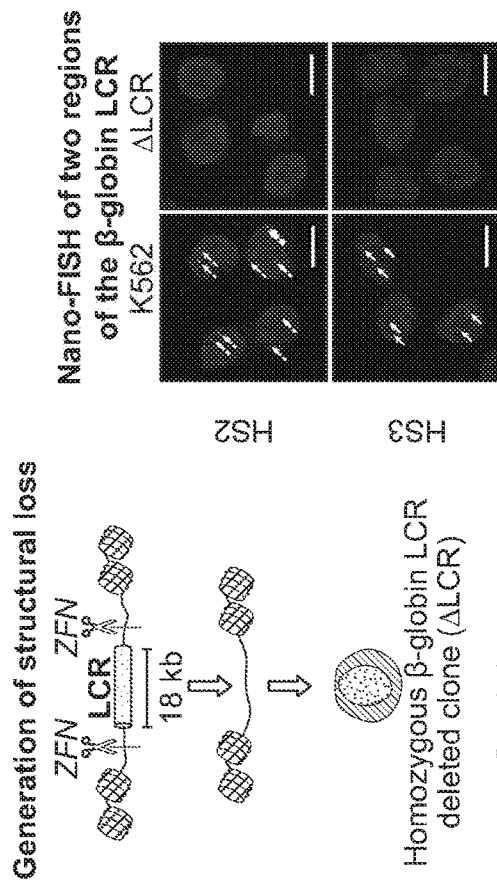
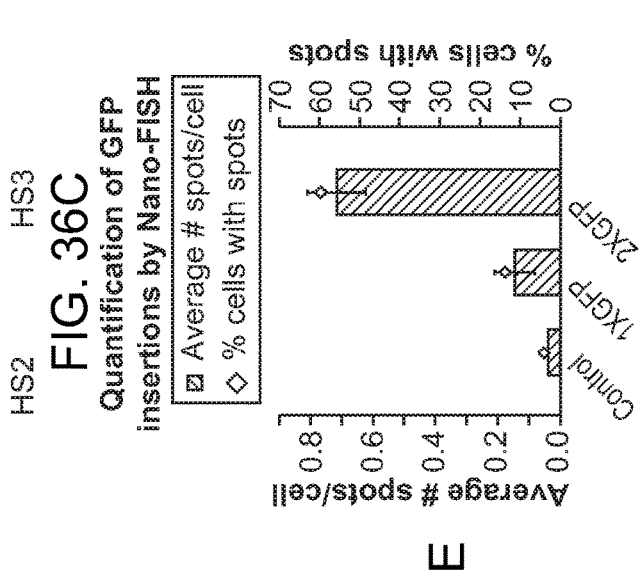
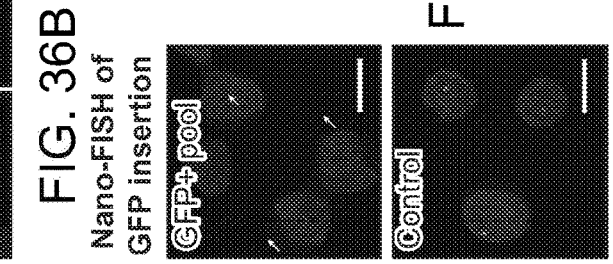
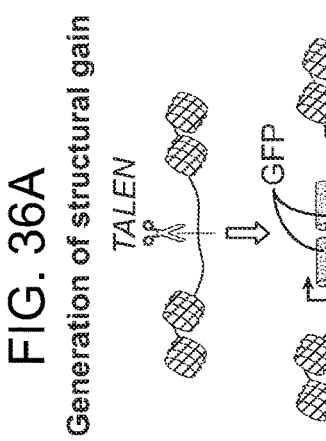
FIG. 36A FIG. 36B FIG. 36C FIG. 36D FIG. 36E FIG. 36F

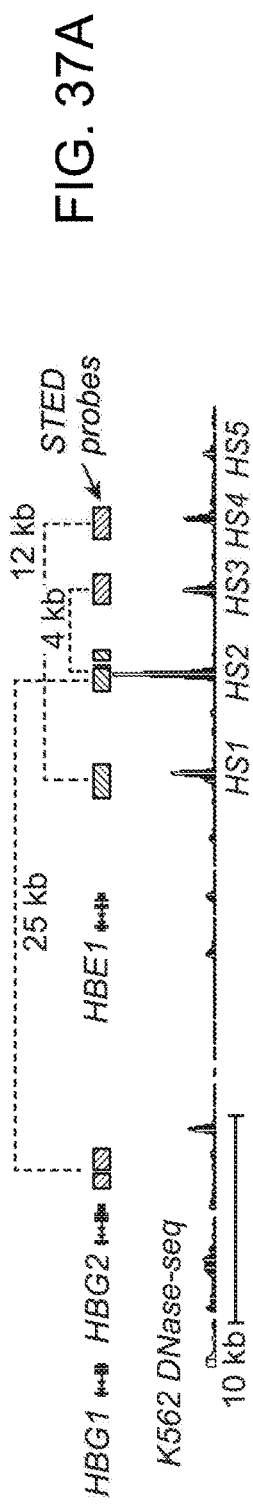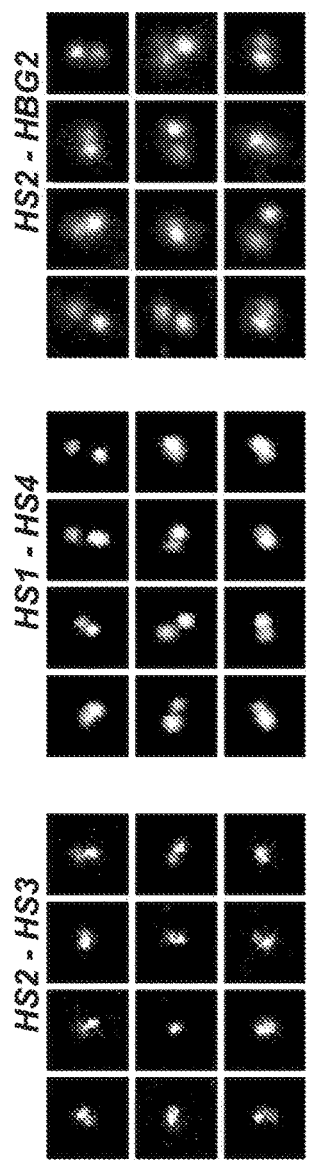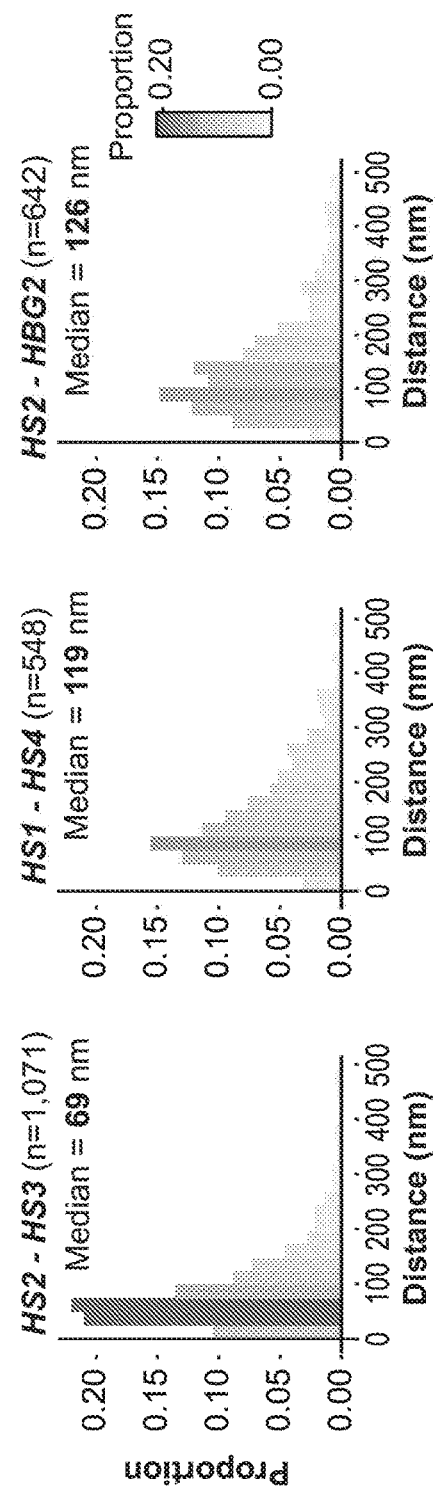
FIG. 37A
FIG. 37B
FIG. 37C

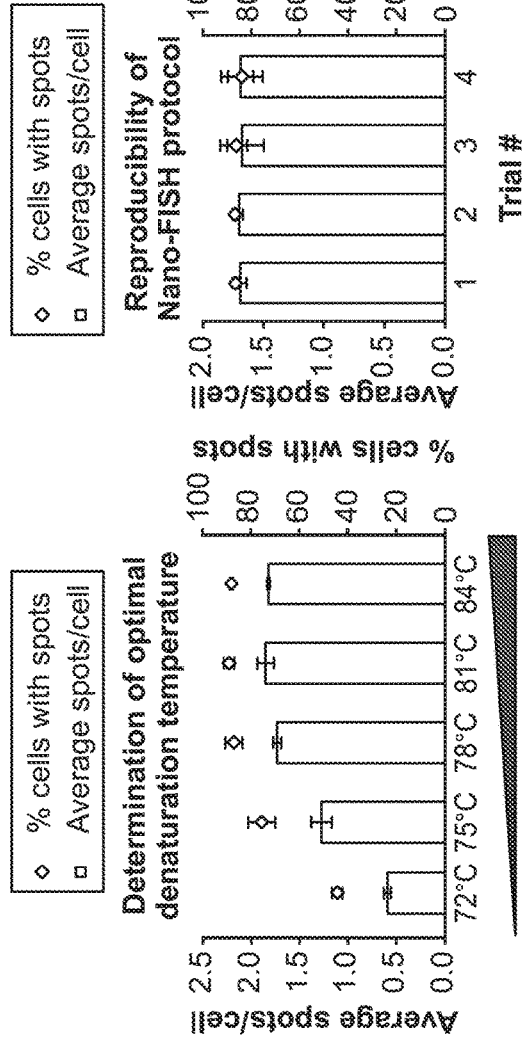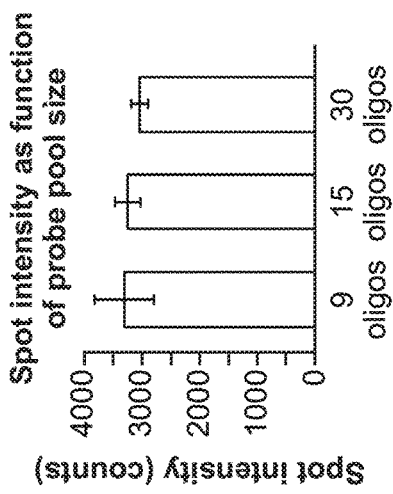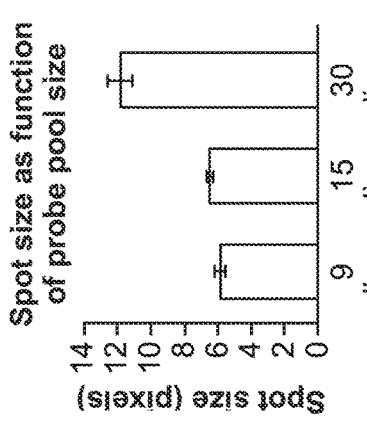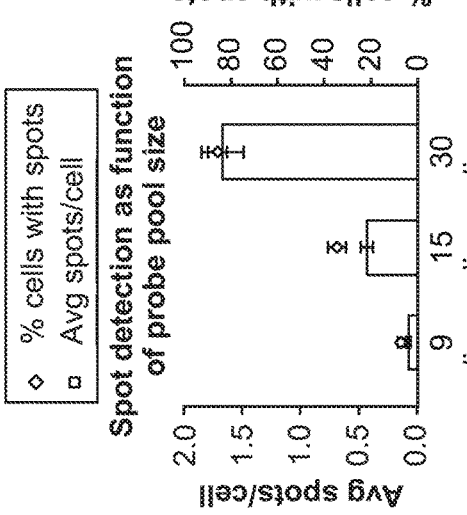
FIG. 38A
FIG. 38B
FIG. 38C
FIG. 38D
FIG. 38E
FIG. 38F

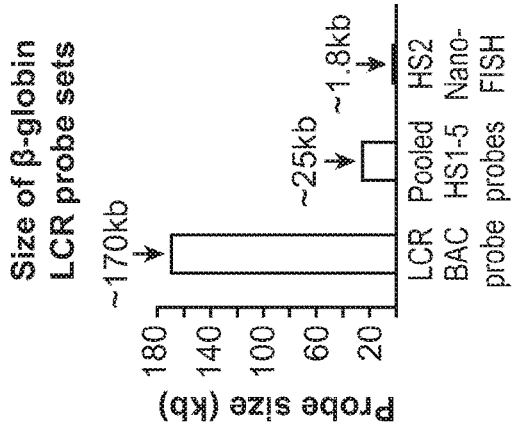
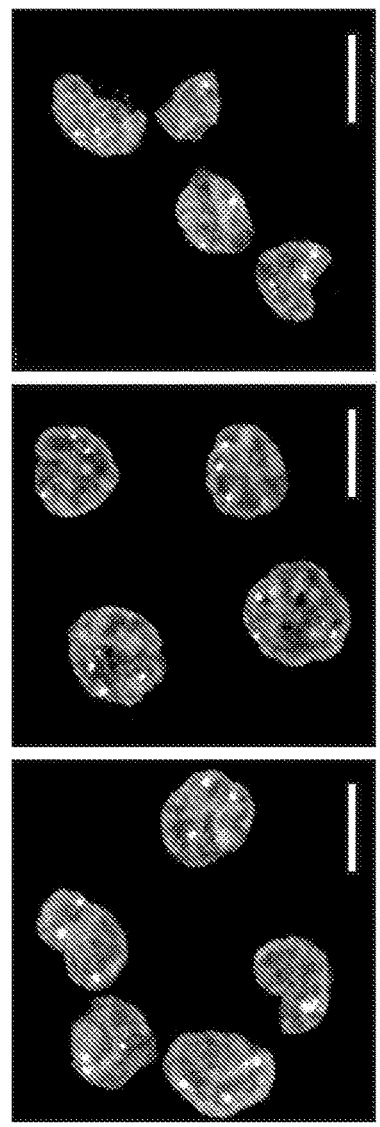
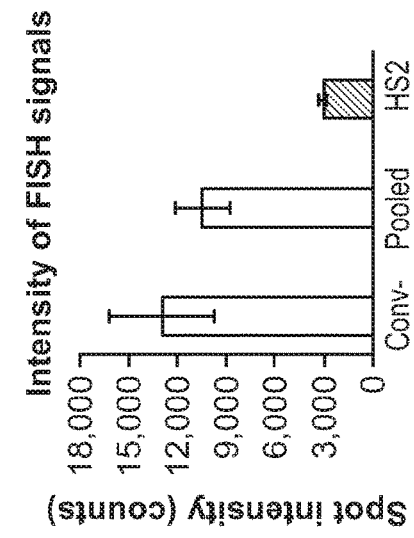
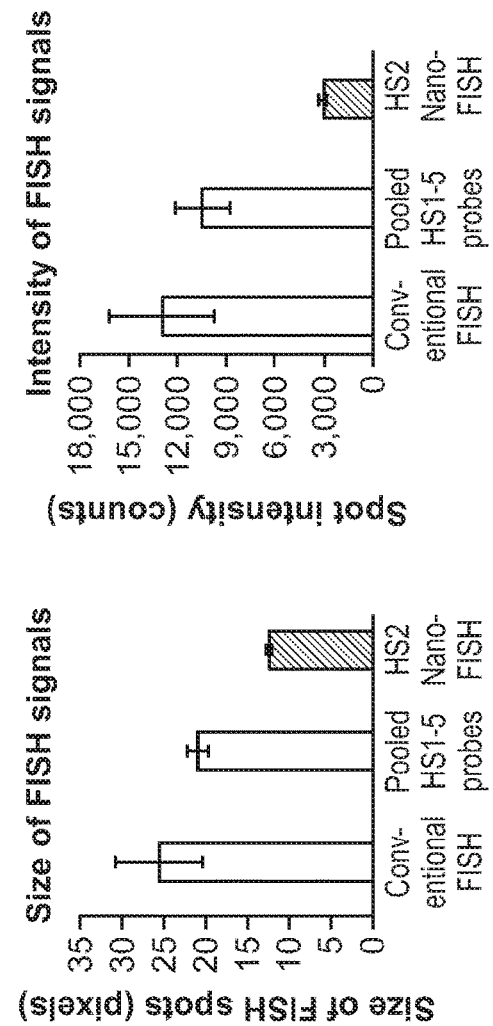
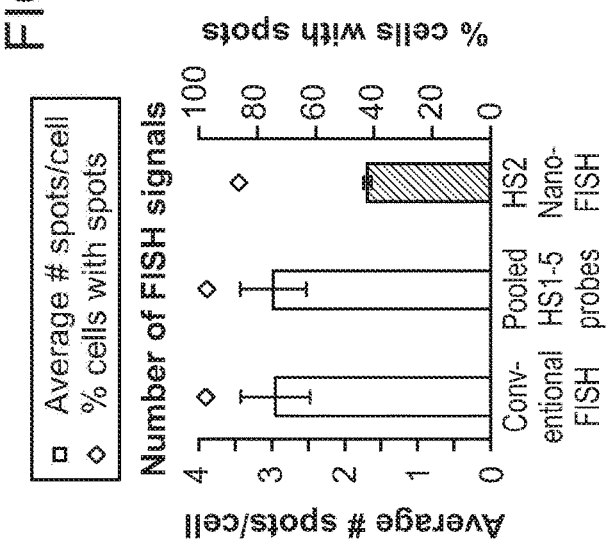
FIG. 39A Nano-FISH for β-globin LCR (K562 cells): LCR BAC-FISH, Pooled HS1-5 probes, HS2 Nano-FISH
FIG. 39B Size of β-globin LCR probe sets
FIG. 39C Number of FISH signals
FIG. 39D Size of FISH signals
FIG. 39E Intensity of FISH signals

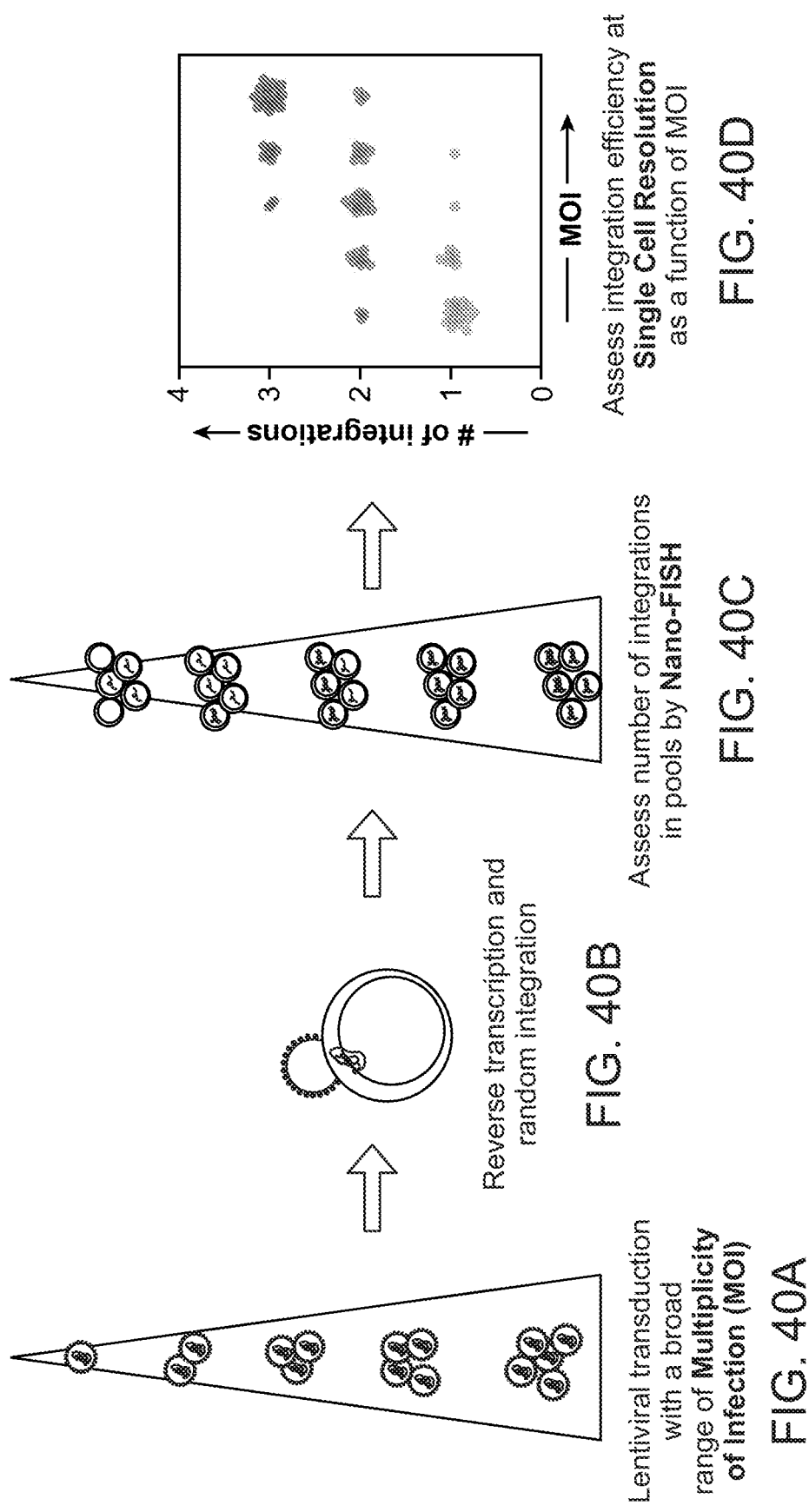

| # | Feature | # | Feature | # | Feature |
|---|---|---|---|---|---|
| 1 | NdeI (487) | 51 | BamHI (2958) | 101 | ApaI (4745) |
| 2 | SnaBI (593) | 52 | lentiCas9_0 (2934 .. 2973) | 102 | PmeI (4750) |
| 3 | CMV promoter | 53 | P2A | 103 | StuI (5797) |
| 4 | 5' LTR (truncated) | 54 | lentiCas9_1 (2976 .. 3015) | 104 | AvrII (5798) |
| 5 | KasI (1016) | 55 | lentiCas9_2-BSD (3018 .. 3057) | 105 | EM7 promoter |
| 6 | NarI (1019) | 56 | lentiCas9_3-BSD (3060 .. 3099) | 106 | MauBI (5963) |
| 7 | SfoI (1020) | 57 | lentiCas9_4-BSD (3102 .. 3141) | 107 | SgrAI (6041) |
| 8 | PluTI (1022) | 58 | lentiCas9_5-BSD (3144 .. 3183) | 108 | BmgBI (6061) |
| 9 | lentiCas9pack_0 (1058 .. 1097) | 59 | lentiCas9_6-BSD (3186 .. 3225) | 109 | FseI (6203) |
| 10 | HIV-1 ψ | 60 | lentiCas9_7-BSD (3228 .. 3267) | 110 | SV40 poly(A) signal |
| 11 | lentiCas9pack_1 (1100 .. 1139) | 61 | lentiCas9_8-BSD (3270 .. 3309) | 111 | BstZ17I (6563) |
| 12 | lentiCas9pack_2 (1142 .. 1181) | 62 | BsaBI* (3322) | 112 | lac operator |
| 13 | lentiCas9tween_3 (1184 .. 1223) | 63 | lentiCas9_9-BSD (3312 .. 3351) | 113 | lac promoter |
| 14 | lentiCas9tween_5 (1268 .. 1307) | 64 | lentiCas9_10-BSD (3354 .. 3393) | 114 | CAP binding site |
| 15 | lentiCas9tween_6 (1310 .. 1349) | 65 | EcoRI (3423) | 115 | lentiCas9_7-BSD (6761 .. 6770) |
| 16 | lentiCas9tween_7 (1352 .. 1391) | 66 | lentiCas9_11-BSD+ (3396 .. 3435) | 116 | PciI (6942) |
| 17 | lentiCas9tween_9 (1436 .. 1475) | 67 | lentiCas9_13-WPRE (3480 .. 3519) | 117 | AhdI (7835) |
| 18 | NotI (1525) | 68 | lentiCas9_14-WPRE (3522 .. 3561) | 118 | FspI (8057) |
| 19 | lentiCas9tween_11 (1520 .. 1559) | 69 | lentiCas9_15-WPRE (3564 .. 3603) | 119 | ScaI (8315) |
| 20 | lentiCas9tween_13 (1604 .. 1643) | 70 | lentiCas9_16-WPRE (3606 .. 3645) | 120 | SspI (8639) |
| 21 | lentiCas9RRE_15 (1688 .. 1727) | 71 | lentiCas9_17-WPRE (3648 .. 3687) | 121 | AmpR promoter |
| 22 | lentiCas9RRE_16 (1730 .. 1746) | 72 | PflMI (3688) | 122 | SgrDI (1) |
| 23 | lentiCas9RRE_16 (1730 .. 1769) | 73 | lentiCas9_18-WPRE (3690 .. 3729) | 123 | MluI (231) |
| 24 | BbvCI (1801) | 74 | lentiCas9_19-WPRE (3732 .. 3771) | 124 | SpeI (252) |
| 25 | lentiCas9RRE_17 (1772 .. 1811) | 75 | lentiCas9_20-WPRE (3774 .. 3813) | | |
| 26 | lentiCas9RRE_18 (1814 .. 1853) | 76 | lentiCas9_21-WPRE (3816 .. 3855) | | |
| 27 | lentiCas9RRE_19 (1856 .. 1895) | 77 | lentiCas9_22-WPRE (3858 .. 3897) | | |
| 28 | lentiCas9RRE_20 (1898 .. 1937) | 78 | lentiCas9_23-WPRE (3900 .. 3939) | | |
| 29 | AleI (1954) | 79 | SacII (3950) | | |
| 30 | lentiCas9tween_21 (1940 .. 1979) | 80 | lentiCas9_24-WPRE (3942 .. 3981) | | |
| 31 | lentiCas9tween_22 (1982 .. 2021) | 81 | lentiCas9_25-WPRE (3984 .. 4023) | | |
| 32 | lentiCas9tween_23 (2024 .. 2063) | 82 | BspDI - ClaI (4037) | | |
| 33 | lentiCas9tween_24 (2066 .. 2105) | 83 | PaeR7I - XhoI (4051) | | |
| 34 | lentiCas9tween_28 (2234 .. 2273) | 84 | lentiCas9_post-WPRE-to-LTR_0 (4038 .. 4077) | | |
| 35 | KflI (2311) | 85 | lentiCas9_post-WPRE-to-LTR_1 (4080 .. 4119) | | |
| 36 | lentiCas9tween_29 (2276 .. 2315) | 86 | Bsu36I (4165) | | |
| 37 | lentiCas9tween_31 (2360 .. 2399) | 87 | Acc65I (4169) | | |
| 38 | PstI (2414) | 88 | KpnI (4173) | | |
| 39 | lentiCas9tween_32 (2402 .. 2441) | 89 | lentiCas9_post-WPRE-to-LTR_3 (4164 .. 4203) | | |
| 40 | lentiCas9cPPT_33 (2444 .. 2483) | 90 | lentiCas9cPPT_33 (4223 .. 4242) | | |
| 41 | NheI (2601) | 91 | lentiCas9_post-WPRE-to-LTR_5 (4248 .. 4287) | | |
| 42 | BmtI (2605) | 92 | lentiCas9_post-WPRE-to-LTR_6 (4290 .. 4329) | | |
| 43 | EF-1α core promoter | 93 | lentiCas9_post-WPRE-to-LTR_7 (4332 .. 4371) | | |
| 44 | Cas9_26 (2762 .. 2772) | 94 | lentiCas9_post-WPRE-to-LTR_8 (4374 .. 4413) | | |
| 45 | AgeI (2863) | 95 | lentiCas9_post-WPRE-to-LTR_9 (4416 .. 4455) | | |
| 46 | XbaI (2869) | 96 | lentiCas9_post-WPRE-to-LTR_10 (4458 .. 4497) | | |
| 47 | AfeI (2876) | 97 | lentiCas9_post-WPRE-to-LTR_11 (4500 .. 4539) | | |
| 48 | BfuAI - BspMI (2900) | 98 | BspEI (4547) | | |
| 49 | nucleoplasmin NLS | 99 | 3' LTR (truncated) | | |
| 50 | FLAG | 100 | PspOMI (4741) | | |

FIG. 46 (Cont.)

| # | Label |
|---|---|
| 1 | Lenti-5'm35.dna_0 (668 .. 707) |
| 2 | Lenti-5'm35.dna_1 (738 .. 777) |
| 3 | Lenti-5'p.dna_1 (703 .. 742) |
| 4 | Lenti-5'm35.dna_2 (808 .. 847) |
| 5 | Lenti-5'p.dna_2 (773 .. 812) |
| 6 | Lenti-5'm35.dna_3 (878 .. 917) |
| 7 | Lenti-5'm35.dna_4 (948 .. 987) |
| 8 | Lenti-5'p.dna_4 (913 .. 952) |
| 9 | Lenti-5'm35.dna_5 (1018 .. 1057) |
| 10 | Lenti-5'p.dna_5 (983 .. 1022) |
| 11 | Lent1-5'p.dna_6 (1053 .. 1092) |
| 12 | Lenti-5'm35.dna_7 (1158 .. 1197) |
| 13 | Lenti-5'p.dna_7 (1123 .. 1162) |
| 14 | Lenti-5'm35.dna_8 (1228 .. 1267) |
| 15 | Lenti-5'm35.dna_9 (1298 .. 1337) |
| 16 | Lenti-5'm35.dna_10 (1368 .. 1407) |
| 17 | Lenti-5'p.dna_10 (1333 .. 1372) |
| 18 | Lenti-5'm35.dna_11 (1438 .. 1477) |
| 19 | Lenti-5'p.dna_11 (1403 .. 1442) |
| 20 | Lenti-5'm35.dna_12 (1508 .. 1547) |
| 21 | Lenti-5'p.dna_12 (1473 .. 1512) |
| 22 | Lenti-5'm35.dna_13 (1578 .. 1617) |
| 23 | Lenti-5'p.dna_13 (1543 .. 1582) |
| 24 | Lenti-5'm35.dna_14 (1648 .. 1687) |
| 25 | Lenti-5'p.dna_14 (1613 .. 1652) |
| 26 | Lenti-5'p.dna_15 (1683 .. 1722) |
| 27 | Lenti-5'p.dna_16 (1753 .. 1792) |
| 28 | Lenti-5'm35.dna_17 (1858 .. 1897) |
| 29 | Lenti-5'p.dna_17 (1823 .. 1862) |
| 30 | Lenti-5'm35.dna_18 (1928 .. 1967) |
| 31 | Lenti-5'p.dna_18 (1893 .. 1932) |
| 32 | Lenti-5'm35.dna_19 (1998 .. 2037) |
| 33 | Lenti-5'm35.dna_20 (2068 .. 2107) |
| 34 | Lenti-5'p.dna_20 (2033 .. 2072) |
| 35 | Lenti-5'm35.dna_21 (2138 .. 2177) |
| 36 | Lenti-hu-frag-payload.dna_6 (2410 .. 2449) |
| 37 | Lenti-hu-frag-payload.dna_28 (3334 .. 3373) |
| 38 | Lenti-hu-frag-payload.dna_32 (3502 .. 3541) |
| 39 | Lenti-hu-frag-payload.dna_33 (3544 .. 3583) |
| 40 | Lenti-hu-frag-payload.dna_54B (4441 .. 4480) |
| 41 | Lenti-hu-frag-payload.dna_57 (4552 .. 4591) |
| 42 | Lenti-hu-frag-payload.dna_59 (4636 .. 4675) |
| 43 | 4-1BB |
| 44 | Lenti-hu-frag-payload.dna_61 (4720 .. 4759) |
| 45 | Lenti-hu-frag-payload.dna_61B (4774 .. 4813) |
| 46 | Lenti-hu-frag-payload.dna_65 (4888 .. 4927) |
| 47 | CD3 Zeta |
| 48 | Lenti-hu-frag-payload.dna_70 (5098 .. 5137) |
| 49 | T2A |
| 50 | Lenti-hu-frag-payload.dna_71 (5140 .. 5179) |
| 51 | Lenti-hu-frag-payload.dna_87 (5812 .. 5851) |
| 52 | Lenti-hu-frag-payload.dna_91 (5980 .. 6019) |
| 53 | Lenti-3'm35.dna_0 (6276 .. 6315) |
| 54 | Lenti-3'p.dna_0 (6241 .. 6280) |
| 55 | Lenti-3'm35.dna_1 (6346 .. 6385) |
| 56 | Lenti-3'p.dna_1 (6311 .. 6350) |
| 57 | Lenti-3'm35.dna_2 (6416 .. 6455) |
| 58 | Lenti-3'p.dna_2 (6381 .. 6420) |
| 59 | Lenti-3'm35.dna_3 (6486 .. 6525) |
| 60 | Lenti-3'p.dna_3 (6451 .. 6490) |
| 61 | Lenti-3'm35.dna_4 (6556 .. 6595) |
| 62 | Lenti-3'p.dna_4 (6521 .. 6560) |
| 63 | Lenti-3'm35.dna_5 (6626 .. 6665) |
| 64 | Lenti-3'p.dna_5 (6591 .. 6630) |
| 65 | Lenti-3'm35.dna_6 (6696 .. 6735) |
| 66 | Lenti-3'p.dna_6 (6661 .. 6700) |
| 67 | Lenti-3'm35.dna_7 (6766 .. 6805) |
| 68 | Lenti-3'p.dna_7 (6731 .. 6770) |
| 69 | Lenti-3'm35.dna_8 (6836 .. 6875) |
| 70 | Lenti-3'p.dna_8 (6801 .. 6840) |
| 71 | Lenti-3'm35.dna_9 (6906 .. 6945) |
| 72 | Lenti-3'p.dna_9 (6871 .. 6910) |
| 73 | Lenti-3'm35.dna_10 (6976 .. 7015) |

FIG. 51 (Cont.)

insertion rate = 0.49 [$R^2$ = 0.93]

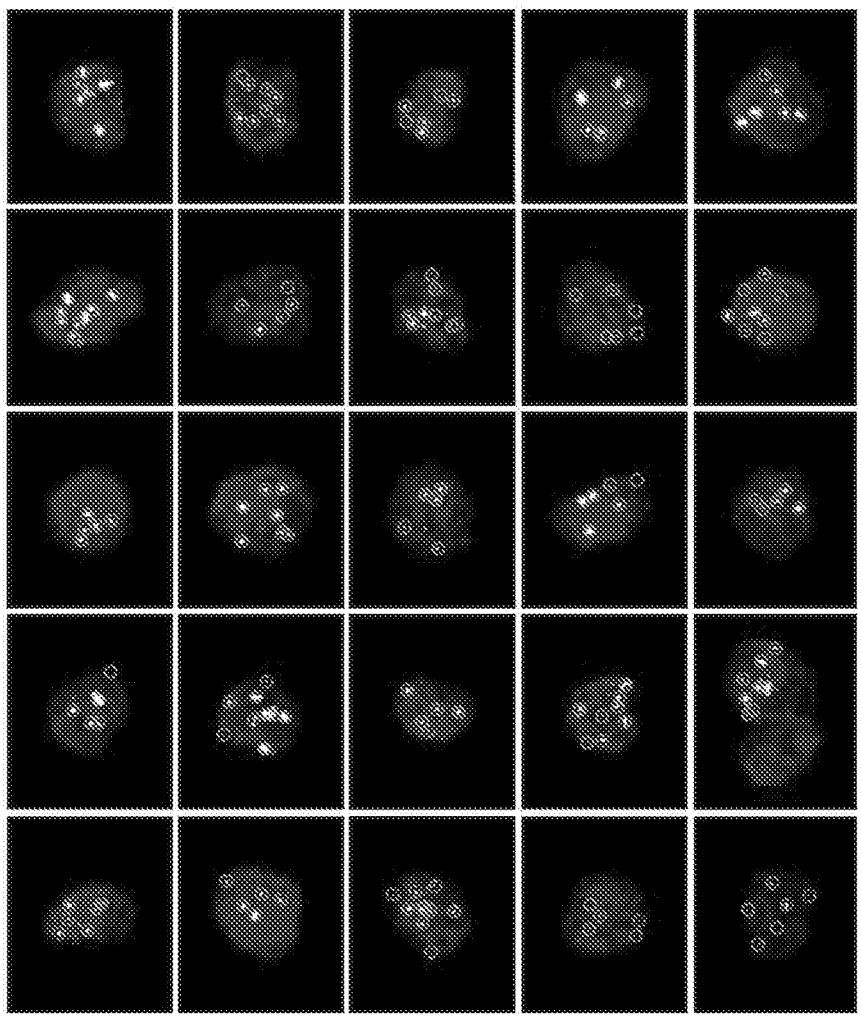
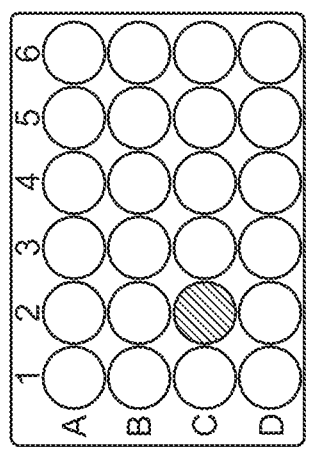
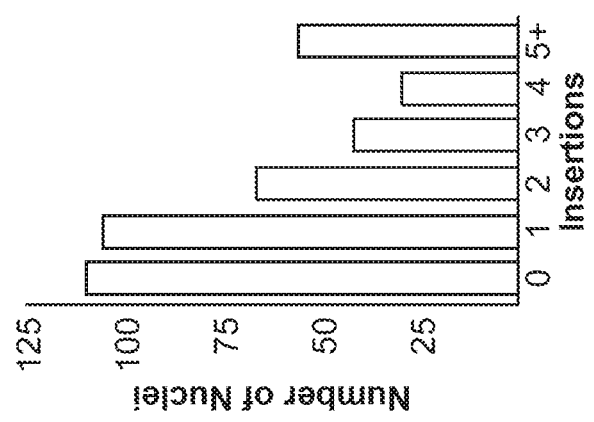
FIG. 59C
FIG. 59A
FIG. 59B

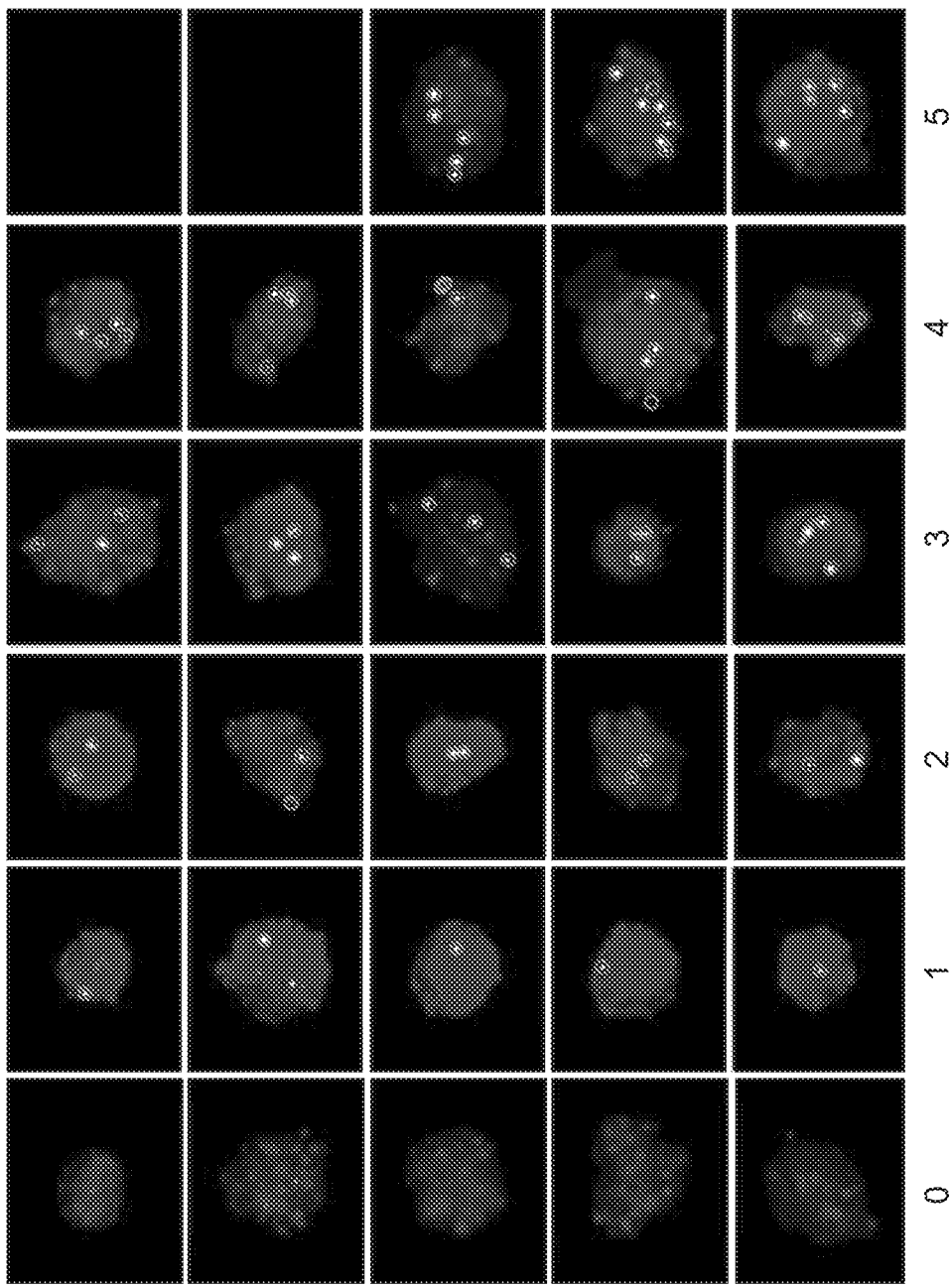
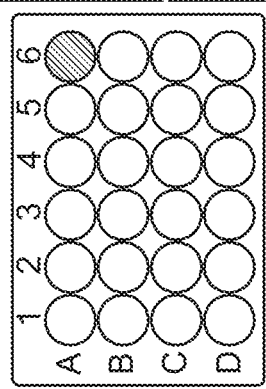
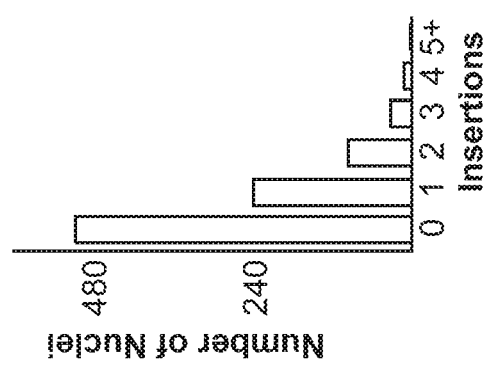
FIG. 60A
FIG. 60B
FIG. 60C

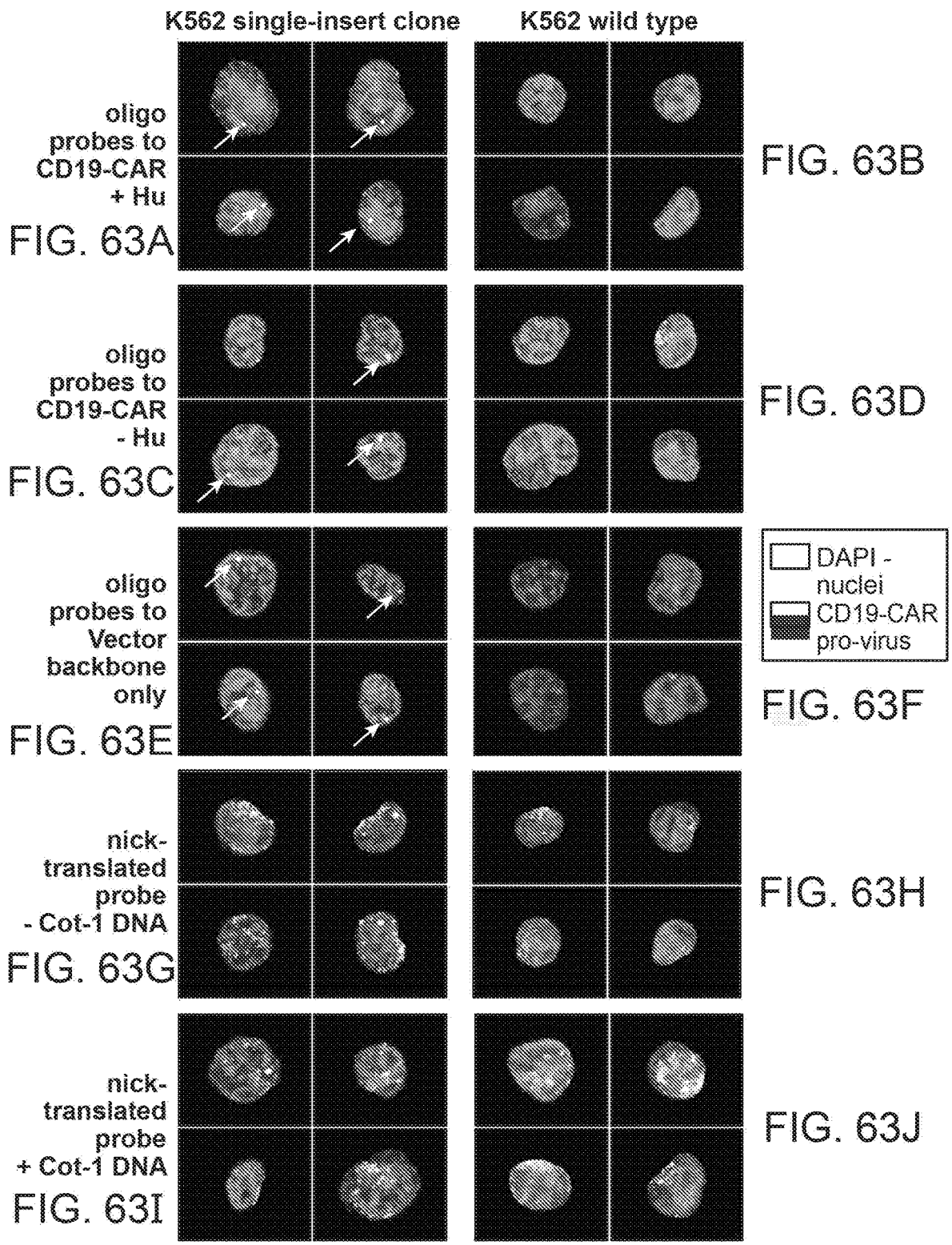

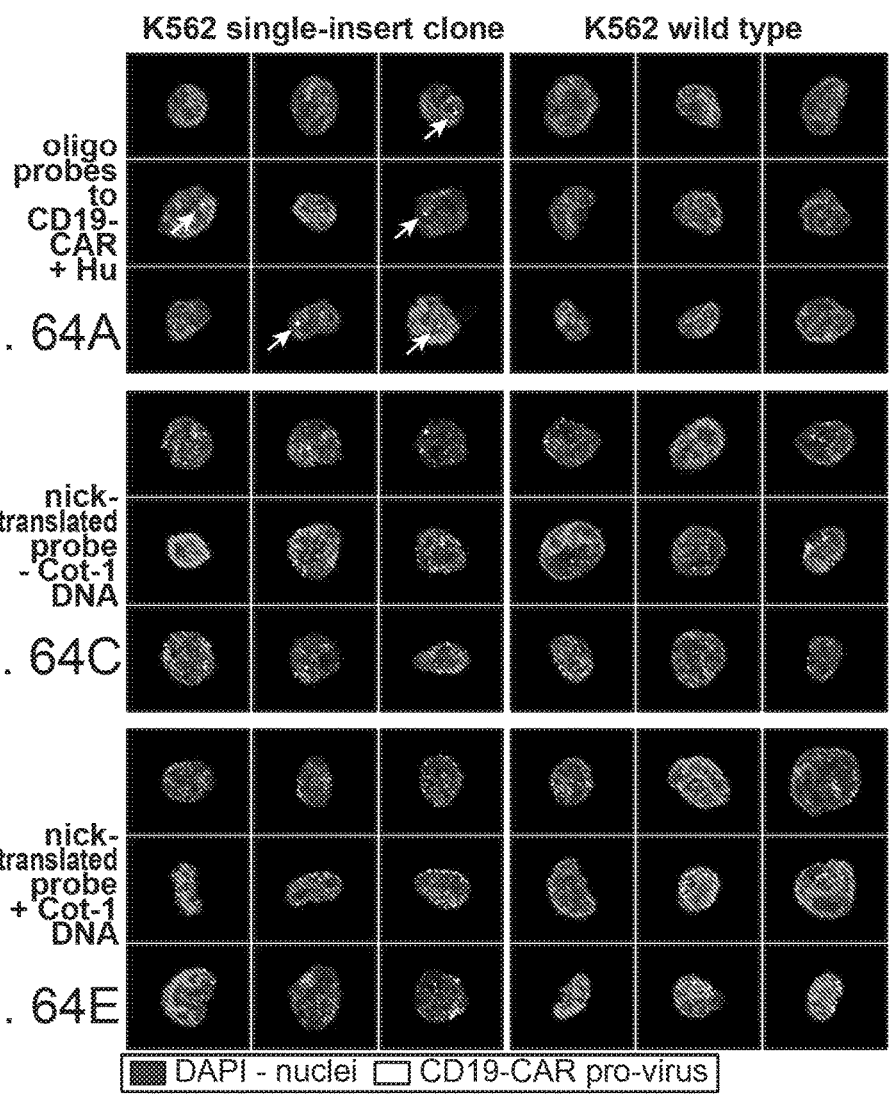

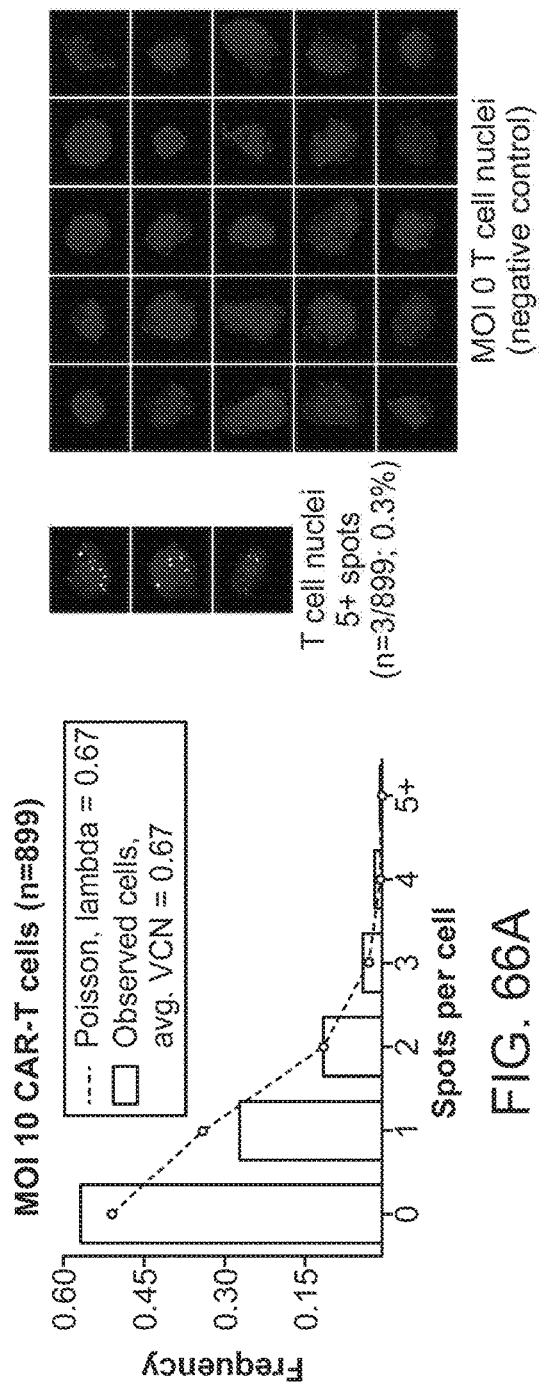
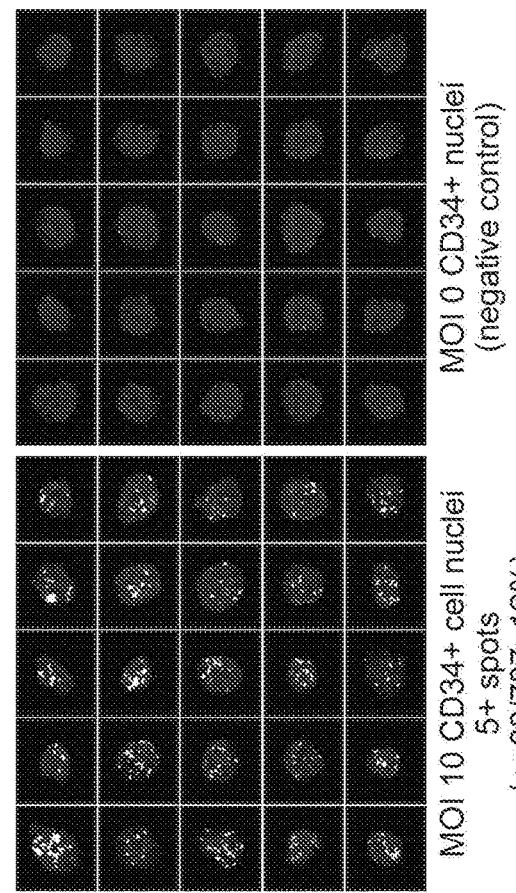
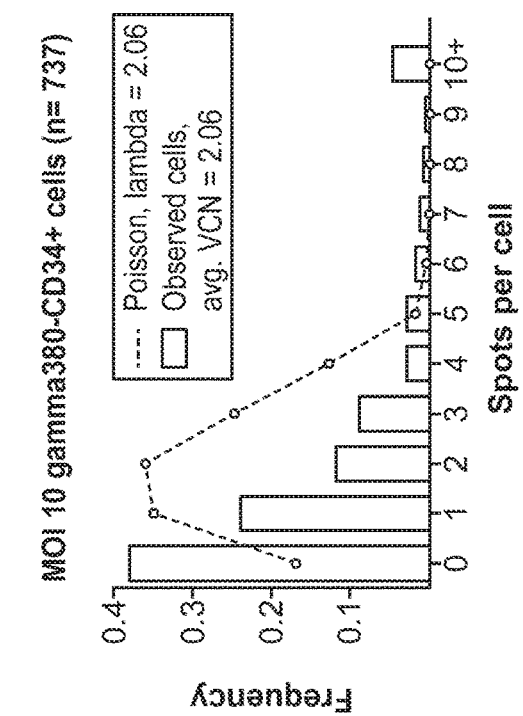
FIG. 66A
FIG. 66B
FIG. 66C
FIG. 66D

METHODS AND COMPOSITIONS FOR VIRAL NANO-FISH

CROSS-REFERENCE

This application claims the benefit of U.S. Provisional Application Nos. 62/659,687, filed Apr. 18, 2018; 62/636,088, filed Feb. 27, 2018; 62/583,427, filed Nov. 8, 2017; and 62/534,669, filed Jul. 19, 2017, which applications are incorporated herein by reference in their entirety for all purposes.

STATEMENT AS TO FEDERALLY SPONSORED RESEARCH

This invention was made with the support of the United States government under NIH CEGS Contract number 5RM1HG007743-04 by NIH Centers of Excellence in Genomic Science.

BACKGROUND

Imaging techniques such as fluorescence in situ hybridization (FISH) allows for visualization of DNA or RNA regions, and/or assessment of gene expression, chromosome position, and/or protein localization. As such, data acquisition from large number of cells requires multiple fields of view and thereby presents challenges in obtaining high throughput and high resolution imaging data. This precludes the use of existing FISH techniques for accurate detection or spatial localization of smaller genomic sequences. As such, new FISH techniques are required to detect the localization of probes to small genomic sequences.

SUMMARY

In various aspects, the present disclosure provides a method comprising detecting a target nucleic acid sequence in a cell, wherein the target nucleic acid sequence comprises an exogenous viral nucleic acid sequence less than 10 kilobases in length, wherein the cell is an intact cell.

In some aspects, the method further comprises: a) contacting a plurality of probes with the cell, wherein a first probe of the plurality of probes comprises an oligonucleotide sequence comprising at least 10 and not more than 10,000 nucleotides and a detectable label associated with a nucleotide of the oligonucleotide sequence; b) hybridizing the first probe to a portion of the target nucleic acid sequence; and c) detecting a presence of the detectable label in the cell, wherein the presence of the detectable label indicates the presence of the target nucleic acid sequence.

In some aspects, the oligonucleotide sequence comprises at least 20 and not more than 80 nucleotides. In some aspects, the detectable label is indirectly attached to the nucleotide. In some aspects, the detectable label is directly attached to the nucleotide. In some aspects, the nucleotide is a first nucleotide at the 3' end of the oligonucleotide sequence.

In various aspects, the present disclosure provides a method of detecting a target nucleic acid sequence, the method comprising: a) contacting a plurality of probes with a cell, wherein a first probe of the plurality of probes comprises an oligonucleotide sequence comprising at least 10 and not more than 10,000 nucleotides and a detectable label associated with a nucleotide of the oligonucleotide sequence; b) hybridizing the first probe to a portion of the target nucleic acid sequence; and c) detecting a presence of the detectable label in the cell, wherein the presence of the detectable label indicates the presence of the target nucleic acid sequence. In some aspects, the oligonucleotide sequence comprises at least 20 and not more than 80 nucleotides. In some aspects, the detectable label is indirectly attached to the nucleotide. In some aspects, the detectable label is directly attached to the nucleotide. In some aspects, the nucleotide is a first nucleotide at the 3' end of the oligonucleotide sequence.

In some aspects, the target nucleic acid sequence comprises an exogenous nucleic acid sequence. In some aspects, the exogenous nucleic acid sequence comprises a viral nucleic acid sequence. In some further aspects, the viral nucleic acid sequence comprises a portion of a viral nucleic acid sequence from a vector.

In some aspects, the vector comprises an integrating virus or a non-integrating virus. In some aspects, the integrating virus is selected from a retrovirus. In some aspects, the retrovirus is selected from a lentivirus, a gamma retrovirus, or a foamy virus. In some aspects, the gamma retrovirus is selected from a Friend murine leukemia virus, a Moloney murine leukemia virus, or a Murine type C retrovirus. In further aspects a foamy virus is selected from an Eastern chimpanzee simian foamy virus, a Macaque simian foamy virus, or a Feline foamy virus. In some aspects, the non-integrating virus is selected from an adenovirus, an adeno-associated virus, or a human papillomavirus. In further aspects, the adenovirus is selected from Human mastadenovirus D; Human adenovirus 81; Human mastadenovirus B; Human adenovirus 71; Human adenovirus 69; Human adenovirus 68; Human adenovirus 67; Human adenovirus 66; Human adenovirus 65; Human adenovirus 64; Human adenovirus 63; Human adenovirus 62; Human adenovirus 61; Human adenovirus 58; Human mastadenovirus C; Human adenovirus 56; Human adenovirus 55; or Human adenovirus 54. In some aspects, an adeno-associated virus is selected from adeno-associated virus serotype 1; adeno-associated virus serotype 2; adeno-associated virus serotype 3; adeno-associated virus serotype 4; adeno-associated virus serotype 5; adeno-associated virus serotype 6; adeno-associated virus serotype 7; adeno-associated virus serotype 8; adeno-associated virus serotype 9; adeno-associated virus serotype 10; adeno-associated virus serotype 11; adeno-associated virus serotype 12; adeno-associated virus serotype 13; pAAV-DJ (VPK-420-DJ (PN-340001)), synthetically evolved adeno-associated viruses of any one of adeno-associated virus 1, adeno-associated virus 2, adeno-associated virus 3, adeno-associated virus 4, adeno-associated virus 5, adeno-associated virus 6, adeno-associated virus 7, adeno-associated virus 8, adeno-associated virus 9; adeno-associated virus 10, adeno-associated virus 11, adeno-associated virus 12, adeno-associated virus 13, a naturally occurring adeno-associated virus, or a synthetic adeno-associated virus comprising chimeras of any combination of adeno-associated virus 1, adeno-associated virus 2, adeno-associated virus 3, adeno-associated virus 4, adeno-associated virus 5, adeno-associated virus 6, adeno-associated virus 7, adeno-associated virus 8, adeno-associated virus 9; adeno-associated virus 10; adeno-associated virus 11; adeno-associated virus 12; adeno-associated virus 13. In some aspects, the human papillomavirus is selected from human papillomavirus 116.

In further aspects, the vector comprises NC_002077.1, NC_001401.2, NC_001729.1, NC_001829.1, AF085716.1, AF028704.1, NC_006260.1, NC_006261.1, AY530579.1, AY631965.1, AY631966.1, DQ813647.1, EU285562.1, VPK-420-DJ (PN-340001), LC314153.1, MF416150.1, KX827426.1, LC066535.1, AB765926.1, LC177352.1, KT970440.1, KF268328.1, KF633445.1, KY618678.1, KY618677.1, KY618676.1, KF268335.1, KF268207.1, KP641339.1, JN226748.1, JN860678.1, AP012302.1, JN860676.1, AP012285.1, EF121005.1, JN935766.1, JN162671.1, JF964962.1, HQ007053.1, JF799911.1, HQ883276.1, HQ003817.1, HM770721.2, FJ643676.1, AB333801.2, FJ169625.1, NC_001362.1, NC_001501.1, NC_001702.1, KX087159.1, MF280817.1, Y08851.1, or NC_013035.1.

In further aspects, the target nucleic acid sequence comprises at least 60%, at least 65%, at least 70%, at least 75%, at least 80%, at least 85%, at least 90%, at least 95%, at least 98%, at least 99%, or 100% sequence identity to any one of: SEQ ID NO: 1282, SEQ ID NO: 1283, SEQ ID NO: 1284, SEQ ID NO: 1285, SEQ ID NO: 1405-SEQ ID NO: 1458, or a portion thereof.

In some aspects, the exogenous nucleic acid sequence comprises a transgene nucleic acid sequence of an insert from the vector or portion thereof. In some aspects, the transgene nucleic acid sequence of the insert from the vector or portion thereof comprises a therapeutic gene. In some aspects, the transgene nucleic acid sequence of the insert from the vector or portion thereof comprises Cas9, a chimeric antigen receptor (CAR), BCMA, CD19, CD22, WT1, L1CAM, MUC16, ROR1, or LeY. In some aspects, the method further comprises determining a number of insertions from the target nucleic acid sequence on a per cell basis.

In some aspects, the method further comprises determining a distribution of insertions from the target nucleic acid sequence in a population of cells. In some aspects, the method further comprises correlating the number of insertions from the target nucleic acid sequence on a per cell basis to a property of the cell. In some aspects, the property of the cell comprises protein expression, mRNA transcript level, or cellular state.

In some aspects, the plurality of probes comprises at least one SEQ ID NO: 930-SEQ ID NO: 1281 or SEQ ID NO: 1388-SEQ ID NO: 1403. In some aspects, the first probe hybridizes to a plus strand of the target nucleic acid sequence and a second probe hybridizes to a minus strand of the target nucleic acid sequence. In some aspects, at least 1, at least 3, at least 4, at least 5, at least 6, at least 7, at least 8, at least 9, or at least 10 nucleotides at a 3' end of the first probe are complementary to 5 nucleotides at a 5' end of the second probe of the plurality of probes.

In some aspects, at least 1, at least 3, at least 4, at least 5, at least 6, at least 7, at least 8, at least 9, or at least 10 nucleotides at a 5' end of the first probe are complementary to 5 nucleotides at a 3' end of the second probe of the plurality of probes. In some aspects, the first probe comprises 100% identity to fewer than 300 sequences from a 16-mer database of genomic sequences from a species of the cell.

In further aspects, the first probe comprises more than 50% contiguous homology to fewer than 3 genomic sequences from a species of the cell. In some aspects, the species is a human, a *Caenorhabditis elegans*, a mouse, a rat, a dog, a pig, or a horse. In some aspects, the first probe of the plurality of probes comprises at least 30 and not more than 60 nucleotides. In some aspects, the plurality of probes is not blocked with a blocking agent prior to the contacting the plurality of probes with the cell. In further aspects, the blocking agent is Cot-1 DNA, salmon sperm DNA, yeast tRNA, or any combination thereof.

In some aspects, the cell comprises a mammalian cell or a eukaryotic cell. In further aspects, the cell comprises a hematopoietic progenitor cell, a monocyte, a macrophage, a microglia, a neuron, or a T cell. In still further aspects, the cell comprises an engineered cell or a progenitor cell thereof. In further aspects, the engineered cell comprises a CD34+ cell or a T cell. In some aspects, the CD34+ cell is transduced with the exogenous nucleic acid sequence to introduce a gene. In some aspects, the T cell is transduced with the exogenous nucleic acid sequence to introduce a chimeric antigen receptor (CAR).

In some aspects, the cell is an intact cell. In some aspects, the target nucleic acid sequence is a non-amplified nucleic acid sequence. In some aspects, the detecting the target nucleic acid sequence comprises less than 48 hours. In some aspects, the target nucleic acid sequence or portion thereof is at least 10 bases in length and no more than 12 kilobases in length, at least 10 bases in length and no more than 10 kilobases in length, at least 10 bases in length and no more than 8 kilobases in length, at least 10 bases in length and no more than 6 kilobases in length, at least 10 bases in length and no more than 4 kilobases in length, at least 10 bases in length and no more than 3 kilobases, at least 10 bases in length and no more than 2 kilobases, at least 10 bases in length and no more than 1.5 kilobases in length, at least 10 bases in length and no more than 1 kilobases in length, or at least 200 bases and no more than 4 kilobases in length.

In some aspects, the method comprises optically detecting the detectable label. In some aspects, the target nucleic acid sequence comprises DNA. In other aspects, the target nucleic acid sequence comprises RNA.

In some aspects, the oligonucleotide sequence comprises at least 40 nucleotides. In some aspects, the detectable label is a fluorescent dye molecule. In some aspects, the plurality of probes is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes.

In some aspects, the method further comprises denaturing a DNA of the cell prior to contacting the plurality of probes with the cell. In further aspects, the denaturing the DNA of the cell comprises incubating the cell for 4.5 minutes in 70% formamide at a temperature of 78° C. In some aspects, the method further comprises hybridizing at least a portion of the plurality of probes to the target nucleic acid sequence. In some aspects, the method further comprises washing the cell after the contacting the plurality of probes with the cell. In some aspects, the target nucleic acid sequence is introduced into the cell. In some aspects, the target nucleic acid sequence is introduced into the cell.

In further aspects, the introducing comprises electroporation, lipofection, transfection, microinjection, viral transduction, or use of a gene gun. In some aspects, the method further comprises: a) contacting the cell with a second detectable label that binds to a portion of a cellular structure; and b) detecting a position of the detectable label in the cell relative to the second detectable label, wherein the position is used to determine a spatial position of the exogenous nucleic acid sequence.

In some aspects, the method further comprises determining a number of the target nucleic acid sequences present in the cell. In some aspects, the method further comprises correlating an expression level of a cell surface protein with the number of target nucleic acid sequences present in the cell, wherein the exogenous nucleic acid sequence encodes for the cell surface protein. In some aspects, the method further comprises optically detecting the second detectable label.

In some aspects, the nucleic acid sequence is integrated into the genome of the cell. In further aspects, the cell is obtained from a tissue. In still further aspects, the cell is a live cell. In some aspects, the first probe comprises less than 1 repetitive element, wherein the repetitive element comprises a short interspersed nuclear elements (SINE), an ALUs, a long interspersed nuclear elements (LINE), a long terminal repeat elements (LTR) including retroposons, a DNA repeat elements, a simple repeats (micro-satellites), a low complexity repeats, a satellite repeats, a RNA repeat, or a class RC.

In some aspects, the first probe comprises a GC content of from 25-70%. In further aspects, the GC content of each probe within the plurality of probes varies by less than 5 to 10%. In some aspects, the single detectable agent is located at the 5' end of the first probe or at any nucleotide of the first probe. In some aspects, a signal to noise ratio of about 1.2-1.5 to 1, 1.5:1, 4-8 to 1, or 5-10:1 is observed. In some aspects, the plurality of probes binds endogenous and exogenous genes. In some aspects, the target nucleic acid sequence is double stranded.

In some aspects, the cell is fixed with a fixation buffer prior to the contacting the plurality of probes with the cell. In further aspects, the fixation buffer comprises a 3 to 1 ratio of methanol to acetic acid. In some aspects, the first probe comprises more than 75% contiguous homology to fewer than 1 genomic sequences from a species of the cell.

In some aspects, the contacting the plurality of probes with the cell comprises simultaneously contacting a plurality of cell populations with the plurality of probes. In some aspects, each of the plurality of cell populations is deposited in an individual well in a well plate. In some aspects, the well plate comprises at least 24 wells. In some aspects, each of the plurality of cell populations is from a unique sample.

In other aspects, each of the plurality of cell populations is from an identical sample. In some aspects, each of the plurality of cell populations is deposited in an individual well in up to 1 to 2 well plates, 2 to 3 well plates, 3 to 4 well plates, 4 to 5 plates, or 5 to 10 plates. In some aspects, a probe set comprises the plurality of probes. In some aspects, the method comprises providing a plurality of probe sets.

In some aspects, each probe set of the plurality of probe sets comprises a unique fluorophore and detects a unique exogenous nucleic acid sequence. In some aspects, the method further comprises determining a transduction efficacy of a vector by calculating the number of exogenous nucleic acid sequences in the cell. In some aspects, the method further comprises enriching for a cell population with a certain number of target nucleic acid sequences in each cell of a plurality of cells.

In some aspects, the method further comprises correlating an expression level of a cell surface reporter gene with the number of target nucleic acid sequences present in the cell, wherein the target nucleic acid sequence comprises the cell surface reporter gene. In some aspects, the detecting the target nucleic acid sequence comprises less than 48 hours. In some aspects, the first probe comprises an amino acid sequence.

In some aspects, the second detectable label comprises a fluorescent dye molecule. In some aspects, the method further comprises correlating a phenotype of the cell with the presence of the target nucleic acid sequence. In some aspects, the phenotype is a product expressed due to a genetic modification in the intact genetically modified cell, a quality of the product expressed due to the genetic modification in the intact genetically modified cell, or a combination thereof.

In some aspects, the phenotype is an increased or decreased expression of the product, an increase or a decrease in the quality of the product, or a combination thereof. In some aspects, the method further comprises determining a number or location of genetic modifications in the cell. In some aspects, the product expressed is a transgene protein, RNA, or a secondary product of the genetic modification.

In some aspects, the method further comprises: selecting a first genetically modified cell comprising a phenotype of interest; determining a set of conditions used for a genetic modification of the first genetically modified cell; and preparing a second genetically modified cell using the set of conditions for genetic modification.

In some aspects, the target nucleic acid comprises a portion of a naturally occurring virus and the method of detecting the target nucleic acid sequence comprises detecting infection of the cell by the naturally occurring virus.

In further aspects, the naturally occurring virus comprises HIV, RSV, malaria, or influenza. In still further aspects, the target nucleic acid comprises latent HIV insertions. In some aspects, the portion comprises a contiguous nucleic acid segment.

In various aspects, the present disclosure provides a composition comprising a plurality of probes, wherein a first probe of the plurality of probes is capable of hybridizing to a target nucleic acid sequence in a cell, and wherein the target nucleic acid sequence comprises at least 60%, at least 65%, at least 70%, at least 75%, at least 80%, at least 85%, at least 90%, at least 95%, at least 98%, at least 99%, or 100% sequence identity to any one of SEQ ID NO: 1282, SEQ ID NO: 1283, SEQ ID NO: 1284, SEQ ID NO: 1285, SEQ ID NO: 1405-SEQ ID NO: 1458, or a portion thereof.

In some aspects, the plurality of probes comprises an oligonucleotide sequence comprising at least 10 and not more than 10,000 nucleotides; and a detectable label associated with a nucleotide of the oligonucleotide sequence. In some aspects, the oligonucleotide sequence comprises at least 20 and not more than 80 nucleotides. In some aspects, the detectable label is indirectly attached to the nucleotide. In some aspects, the detectable label is directly attached to the nucleotide. In some aspects, the nucleotide is a first nucleotide at the 3' end of the oligonucleotide sequence.

In various aspects, the present disclosure provides a composition comprising a plurality of probes, wherein a first probe of the plurality of probes comprises: an oligonucleotide sequence comprising at least 10 and not more than 10,000 nucleotides; and a detectable label associated with a nucleotide of the oligonucleotide sequence.

In some aspects, the oligonucleotide sequence comprises at least 20 and not more than 80 nucleotides. In some aspects, the detectable label is indirectly attached to the nucleotide. In some aspects, the detectable label is directly attached to the nucleotide. In some aspects, the nucleotide is a first nucleotide at the 3' end of the oligonucleotide sequence.

In some aspects, the first probe is capable of hybridizing to a target nucleic acid sequence in a cell. In some aspects, the target nucleic acid sequence comprises an exogenous nucleic acid sequence. In further aspects, the exogenous nucleic acid sequence comprises a viral nucleic acid sequence. In still further aspects, the viral nucleic acid sequence comprises a portion of a viral nucleic acid sequence from a vector.

In some aspects, the vector comprises an integrating virus or a non-integrating virus. In some aspects, the integrating virus is selected from a retrovirus. In some aspects, the retrovirus is selected from a lentivirus, a gamma retrovirus, or a foamy virus. In some aspects, the gamma retrovirus is selected from a Friend murine leukemia virus, a Moloney murine leukemia virus, or a Murine type C retrovirus. In further aspects a foamy virus is selected from an Eastern chimpanzee simian foamy virus, a Macaque simian foamy virus, or a Feline foamy virus. In some aspects, the non-integrating virus is selected from an adenovirus, an adeno-associated virus, or a human papillomavirus. In further aspects, the adenovirus is selected from Human mastadenovirus D; Human adenovirus 81; Human mastadenovirus B; Human adenovirus 71; Human adenovirus 69; Human adenovirus 68; Human adenovirus 67; Human adenovirus 66; Human adenovirus 65; Human adenovirus 64; Human adenovirus 63; Human adenovirus 62; Human adenovirus 61; Human adenovirus 58; Human mastadenovirus C; Human adenovirus 56; Human adenovirus 55; or Human adenovirus 54. In some aspects, an adeno-associated virus is selected from adeno-associated virus serotype 1; adeno-associated virus serotype 2; adeno-associated virus serotype 3; adeno-associated virus serotype 4; adeno-associated virus serotype 5; adeno-associated virus serotype 6; adeno-associated virus serotype 7; adeno-associated virus serotype 8; adeno-associated virus serotype 9; adeno-associated virus serotype 10; adeno-associated virus serotype 11; adeno-associated virus serotype 12; adeno-associated virus serotype 13; pAAV-DJ (VPK-420-DJ (PN-340001)), synthetically evolved adeno-associated viruses of any one of adeno-associated virus 1, adeno-associated virus 2, adeno-associated virus 3, adeno-associated virus 4, adeno-associated virus 5, adeno-associated virus 6, adeno-associated virus 7, adeno-associated virus 8, adeno-associated virus 9; adeno-associated virus 10, adeno-associated virus 11, adeno-associated virus 12, adeno-associated virus 13, a naturally occurring adeno-associated virus, or a synthetic adeno-associated virus comprising chimeras of any combination of adeno-associated virus 1, adeno-associated virus 2, adeno-associated virus 3, adeno-associated virus 4, adeno-associated virus 5, adeno-associated virus 6, adeno-associated virus 7, adeno-associated virus 8, adeno-associated virus 9; adeno-associated virus 10; adeno-associated virus 11; adeno-associated virus 12; adeno-associated virus 13. In some aspects, the human papillomavirus is selected from human papillomavirus 116.

In some aspects, the vector comprises NC_002077.1, NC_001401.2, NC_001729.1, NC_001829.1, AF085716.1, AF028704.1, NC_006260.1, NC_006261.1, AY530579.1, AY631965.1, AY631966.1, DQ813647.1, EU285562.1, VPK-420-DJ (PN-340001), LC314153.1, MF416150.1, KX827426.1, LC066535.1, AB765926.1, LC177352.1, KT970440.1, KF268328.1, KF633445.1, KY618678.1, KY618677.1, KY618676.1, KF268335.1, KF268207.1, KP641339.1, JN226748.1, JN860678.1, AP012302.1, JN860676.1, AP012285.1, EF121005.1, JN935766.1, JN162671.1, JF964962.1, HQ007053.1, JF799911.1, HQ883276.1, HQ003817.1, HM770721.2, FJ643676.1, AB333801.2, FJ169625.1, NC_001362.1, NC_001501.1, NC_001702.1, KX087159.1, MF280817.1, Y08851.1, or NC_013035.1.

In further aspects, wherein the target nucleic acid sequence comprises at least 60%, at least 65%, at least 70%, at least 75%, at least 80%, at least 85%, at least 90%, at least 95%, at least 98%, at least 99%, or 100% sequence identity to any one of SEQ ID NO: 1282, SEQ ID NO: 1283, SEQ ID NO: 1284, SEQ ID NO: 1285, SEQ ID NO: 1405-SEQ ID NO: 1458, or a portion thereof. In some aspects, the exogenous nucleic acid sequence comprises a transgene nucleic acid sequence of an insert from the vector or portion thereof.

In some aspects, the transgene nucleic acid sequence of the insert from the vector or portion thereof comprises a therapeutic gene. In further aspects, the transgene nucleic acid sequence of the insert from the vector or portion thereof comprises Cas9, a chimeric antigen receptor (CAR), BCMA, CD19, CD22, WT1, L1CAM, MUC16, ROR1, or LeY. In some aspects, the plurality of probes comprises at least one SEQ ID NO: 930-SEQ ID NO: 1281 or SEQ ID NO: 1388-SEQ ID NO: 1403. In some aspects, the first probe is capable of hybridizing to a plus strand of the target nucleic acid sequence and a second probe is capable of hybridizing to a minus strand of the target nucleic acid sequence.

In some aspects, at least 1, at least 2, at least 3, at least 4, at least 5, at least 6, at least 7, at least 8, at least 9, or at least 10 nucleotides at a 3' end of the first probe are complementary to 5 nucleotides at a 5' end of the second probe of the plurality of probes. In some aspects, at least 1, at least 2, at least 3, at least 4, at least 5, at least 6, at least 7, at least 8, at least 9, or at least 10 nucleotides at a 5' end of the first probe are complementary to 5 nucleotides at a 3' end of the second probe of the plurality of probes. In some aspects, the first probe comprises 100% identity to fewer than 300 sequences from a 16-mer database of genomic sequences from a species of the cell. In further aspects, the first probe comprises more than 50% contiguous homology to fewer than 3 genomic sequences from a species of the cell.

In further aspects, the species is a human, a *Caenorhabditis elegans*, a mouse, a rat, a dog, a pig, or a horse. In some aspects, the first probe of the plurality of probes comprises at least 30 and not more than 60 nucleotides. In some aspects, the plurality of probes is not blocked with a blocking agent prior to contacting the plurality of probes with the cell. In further aspects, the blocking agent is Cot-1 DNA, salmon sperm DNA, yeast tRNA, or any combination thereof.

In some aspects, the cell comprises a mammalian cell or a eukaryotic cell. In further aspects, the cell comprises a hematopoietic progenitor cell, a monocyte, a macrophage, a microglia, a neuron, or a T cell. In still further aspects, the cell comprises an engineered cell or a progenitor cell thereof. In some aspects, the engineered cell comprises a CD34+ cell or a T cell. In further aspects, the CD34+ cell is transduced with the exogenous nucleic acid sequence to introduce a gene. In further aspects, the T cell is transduced with the exogenous nucleic acid sequence to introduce a chimeric antigen receptor (CAR).

In some aspects, the cell is an intact cell. In some aspects, the target nucleic acid sequence is a non-amplified nucleic acid sequence. In some aspects, the detecting the target nucleic acid sequence comprises less than 48 hours. In some aspects, the target nucleic acid sequence or portion thereof is at least 10 bases in length and no more than 12 kilobases in length, at least 10 bases in length and no more than 10 kilobases in length, at least 10 bases in length and no more than 8 kilobases in length, at least 10 bases in length and no more than 6 kilobases in length, at least 10 bases in length and no more than 4 kilobases in length, at least 10 bases in length and no more than 3 kilobases, at least 10 bases in length and no more than 2 kilobases in length, at least 10 bases in length and no more than 1.5 kilobases in length, at least 10 bases in length and no more than 1 kilobases in length, or at least 200 bases and no more than 4 kilobases in length.

In some aspects, the target nucleic acid sequence comprises DNA. In other aspects, the target nucleic acid sequence comprises RNA.

In some aspects, the detectable label is a fluorescent dye molecule. In some aspects, the plurality of probes is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes.

In some aspects, the target nucleic acid sequence is integrated into the genome of the cell. In some aspects, the cell is obtained from a tissue. In further aspects, the cell is a live cell. In some aspects, the first probe comprises less than 1 repetitive element, wherein the repetitive element comprises a short interspersed nuclear elements (SINE), an ALUs, a long interspersed nuclear elements (LINE), a long terminal repeat elements (LTR) including retroposons, a DNA repeat elements, a simple repeats (micro-satellites), a low complexity repeats, a satellite repeats, a RNA repeat, or a class RC.

In some aspects, the first probe comprises a GC content of from 25-70%. In further aspects, the GC content of each probe within the plurality of probes varies by less than 5 to 10%. In some aspects, the single detectable label is located at the 5' end of the first probe or at any nucleotide of the first probe. In some aspects, the plurality of probes is capable of hybridizing to endogenous and exogenous genes.

In some aspects, the target nucleic acid sequence is double stranded. In some aspects, the first probe comprises more than 75% contiguous homology to fewer than 1 genomic sequence from a species of the cell. In some aspects, the target nucleic acid sequence is at least 200 nucleotides in length, 250 nucleotides in length, 300 nucleotides in length, 350 nucleotides in length, 400 nucleotides in length, 450 nucleotides in length, 500 nucleotides in length, 550 nucleotides in length, or 600 nucleotides in length. In some aspects, the plurality of probes comprises at least 8 and no more than 145 unique probes.

In some aspects, the cell comprises a cell infected by a naturally occurring virus. In further aspects, the naturally occurring virus comprises HIV, RSV, malaria, or influenza. In some aspects, the target nucleic acid comprises latent HIV insertions. In some aspects, the portion comprises a contiguous nucleic acid segment.

In some aspects, the method further comprises: a) providing the cell further comprising a second target nucleic acid sequence; b) contacting the cell with a second plurality of probes comprising a second probe comprising a second detectable label and a probe sequence that binds to a portion of the second target nucleic acid sequence; and c) detecting a position of the detectable label in the cell relative to the second detectable label, wherein the position is used to determine the spatial position of the second target nucleic acid sequence.

In some aspects, the second plurality of probes bound to the second target nucleic acid sequence is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes.

In some aspects, the method further comprises binding at least a portion of the second plurality of probes to the second target nucleic acid sequence. In some aspects, the method further comprises washing the cell after contacting the second target nucleic acid sequence with the second plurality of probes. In some aspects, the probe sequence of at least one probe of the second plurality of probes comprises an oligonucleotide sequence.

In some aspects, the cell is an intact cell and the method further comprises: a) providing the intact cell further comprising the second target nucleic acid sequence; b) contacting the intact cell with the second plurality of probes, and c) detecting a position of the first detectable label in the intact cell relative to the second detectable label, wherein the position is used to determine the spatial position of the target nucleic acid sequence to the second target nucleic acid sequence. In some aspects, the probe sequence of at least one probe of the second plurality of probes comprises an amino acid sequence. In some aspects, the target nucleic acid is less than 2.5 kilobases in length.

In various aspects, the present disclosure provides a kit comprising a probe set and a set of instructions for any of the methods described herein. In some aspects, the probe set comprises the composition of any one of the compositions described herein.

BRIEF DESCRIPTION OF THE DRAWINGS

Various aspects of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 5A shows a schematic of simultaneous labeling and multiplexed imaging of mRNA and protein targets with multicolor QDots via DNA encoding. In general, each molecular target is encoded by target-specific ssDNA-tagged affinity molecule (e.g., an antibody, aptamer, oligonucleotide, etc.). The resulting array of target-bound ssDNA tags can be sequentially or simultaneously labeled by complementary imaging probes, enabling multiplexed imaging of all targets of interest (e.g., via fluorescence microscopy with hyperspectral imaging, HSI). FIG. 5B shows an exemplary multiplexed labeling of GAPDH and HSP90-alpha mRNA and corresponding proteins with QDots. DNA encoding methodology enables ssDNA tagging of mRNA targets via in situ hybridization and protein targets via immunorecognition by antibody-ssDNA bioconjugates. All ssDNA tags were simultaneously converted into distinctive optical signals by hybridization with complementary QDot-ssDNA' probes. Fluorescence microscopy with hyperspectral imaging (HIS) was employed for cell imaging and 4 individual QDot channels were unmixed. Individual grayscale channels were false-colored and merged into a composite 4-color image. Scale bar, 50 μm.

FIG. 7A shows amine crosslinking by a homobifunctional reagent BS3 used for covalent conjugation of 5' amine-terminated ssDNA oligonucleotides and PEG-coated amine-functionalized QDots. ssDNA is activated by an excess BS3, purified by desalting, and reacted with QDots overnight. QDot-ssDNA probes are purified from excess unbound ssDNA by ultrafiltration. Agarose gel electrophoresis in FIG. 7B shows an increase in QDot gel motility upon conjugation of negatively-charged ssDNA oligonucleotides, confirming successful preparation of QDot-ssDNA probes.

FIG. 8A shows rabbit anti-mouse IgG is partially reduced by treatment with TCEP to expose sulfhydryl groups for ssDNA conjugation. At the same time, 5' amine-terminated ssDNA oligonucleotides are activated by sulfo-SMCC. Mixing and a 4-hour incubation of activated ssDNA with reduced IgG yields ½IgG-ssDNA bioconjugates. PAGE analysis of bioconjugation products in FIG. 8B confirmed formation of primarily ½IgG with one ssDNA along with smaller fractions of ½IgG conjugated to two and three ssDNA tags.

FIG. 9 illustrates evaluation of a 6-color QDot panel for protein labeling via DNA encoding. FIG. 9A shows specific staining of β-tubulin via incubation with mouse anti-β-tubulin primary antibody and ssDNA-conjugated rabbit anti-mouse secondary antibody followed by immuno-labeling with anti-rabbit QDot655-2'Ab probes preserved functionality of 2'Ab-ssDNA bioconjugates. Consistent β-tubulin staining achieved via hybridization with complementary QDot-ssDNA probes in FIG. 9B confirmed successful preparation of a functional 6-color QDot-ssDNA panel. A lack of non-specific binding in FIG. 9C by QDot-ssDNA probes in control experiments that skipped incubation with primary and secondary antibodies corroborates the utility of such probes for highly specific target labeling via DNA encoding. True-color images for target staining (FIG. 9B) vs. control (FIG. 9C) were obtained at consistent exposure time for each QDot color. Scale bar, 50 μm.

In FIG. 10C, the staining of Lamin A via incubation with rabbit anti-Lamin A primary antibody and goat anti-rabbit 2'Ab-ssDNA bioconjugates followed by labeling with QDot605-ssDNA' probes confirmed the preserved specificity of ssDNA-tagged antibodies and successful antibody-ssDNA bioconjugation. At the same time, increasing non-specific binding by 2'Ab-ssDNA bioconjugates was observed with increasing number of ssDNA tags per IgG in a control experiment in which incubation with primary antibody was skipped. Thus, a volume ratio of Ab:ssDNA=2:1 in Thunder-Link reaction is considered optimal. All true-color images were obtained at consistent exposure for direct comparison of staining intensity. Scale bar, 250 μm.

Figure 14:
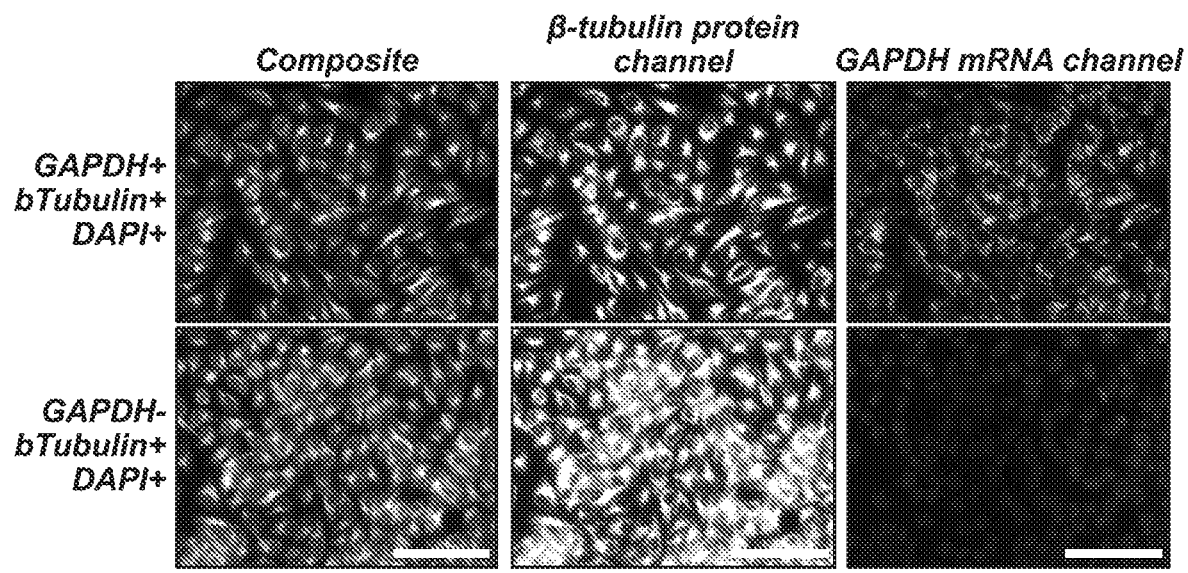

FIG. 14 shows multi-omics QDot staining via DNA encoding. Protein and mRNA targets were encoded with ssDNA tags in separate steps, each using conditions optimal for binding of a specific target type. Consequently, DNA sequence code was converted into an optical signal by hybridization with complementary QDot-ssDNA probes. Specifically, GAPDH mRNA was labeled with a 41 nt in situ hybridization (ISH) probe set followed by labeling of β-tubulin with Ab-ssDNA bioconjugates. Finally, both ssDNA tags were simultaneously hybridized with respective QDot-ssDNA' probes. Clear microtubule staining pattern of β-tubulin (false-colored green) and punctuate pattern of GAPDH mRNA (false-colored red) were observed in dual-labeled specimen (top row), whereas only β-tubulin staining was present in a control specimen that was not hybridized with GAPDH FISH probe set (bottom row). Nuclei were counterstained with DAPI (false-colored blue). Scale bar, 100 µm.

Figure 15:
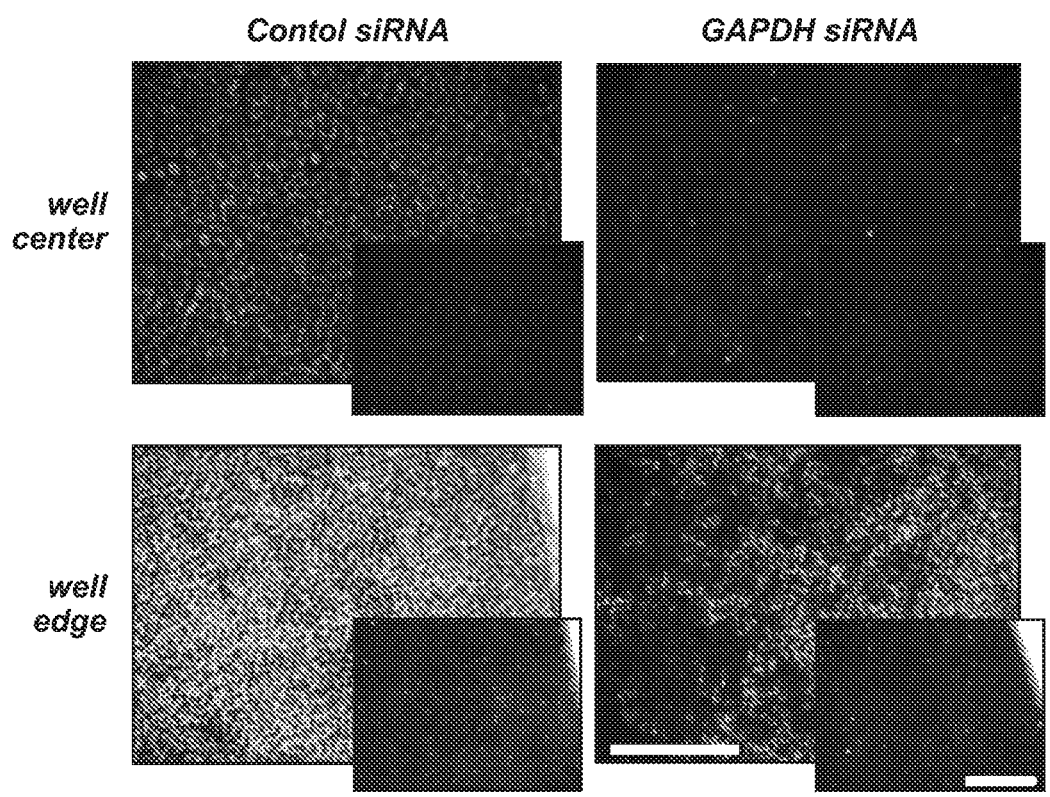

FIG. 15 illustrates the heterogeneity in GAPDH RNAi following forward transfection with siRNA. Cells were seeded into a 24-well plate, allowed to attach, grown overnight, and then transfected with GAPDH siRNA (or non-targeting control siRNA) for 24 hrs. GAPDH mRNA was encoded via in situ hybridization (ISH) with mRNA ISH probes and then labeled with QDot605-ssDNA' probes. Imaging of different areas within the well highlights heterogeneity in GAPDH knock-down, likely resulting from heterogeneity in cell transfection with siRNA. Specifically, complete GAPDH mRNA degradation was observed throughout cells in the well center (top right panel), whereas cells at the crowded well edge still expressed regular levels of GAPDH mRNA (bottom right panel) consistent with GAPDH expression in cells transfected with control siRNA (left panels). Substantial number of non-transfected cells might explain an average silencing efficiency of 78% as determined by RT-PCR. Insets: control experiments showed lack of QDot non-specific binding in the absence of complementary ssDNA probes. All images were obtained with true-color camera at the same exposure time for direct comparison of signal intensity. Scale bar, 250 µm.

Figure 16:
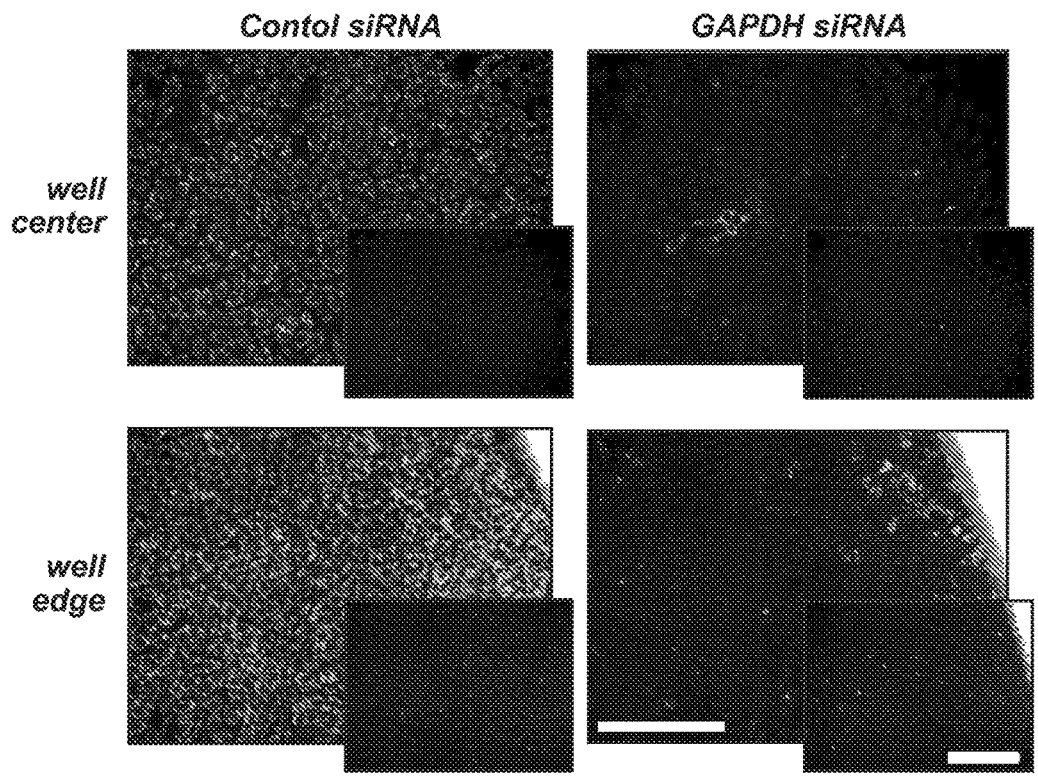

FIG. 16 illustrates the heterogeneity in GAPDH RNAi following reverse transfection with siRNA. Cells were mixed with GAPDH siRNA (or non-targeting control siRNA) in suspension and then seeded to 24-well plate for transfection and growth for 24 hrs. GAPDH mRNA was encoded via in situ hybridization (ISH) with mRNA ISH probes and then labeled with QDot605-ssDNA' probes. As evident from imaging of different areas within the well, reverse transfection achieved a more uniform transfection and GAPDH knock-down compared to forward transfection (see FIG. 12). Complete GAPDH mRNA degradation was observed throughout majority of cells, with only occasional colonies with full GAPDH expression forming from non-transfected cells, which is consistent with an improved average silencing efficiency of 95% as determined by RT-PCR. Insets: control experiments showed lack of QDot non-specific binding in the absence of complementary ssDNA probes. All images were obtained with true-color camera at the same exposure time for direct comparison of signal intensity. Scale bar, 250 µm.

Figure 17:
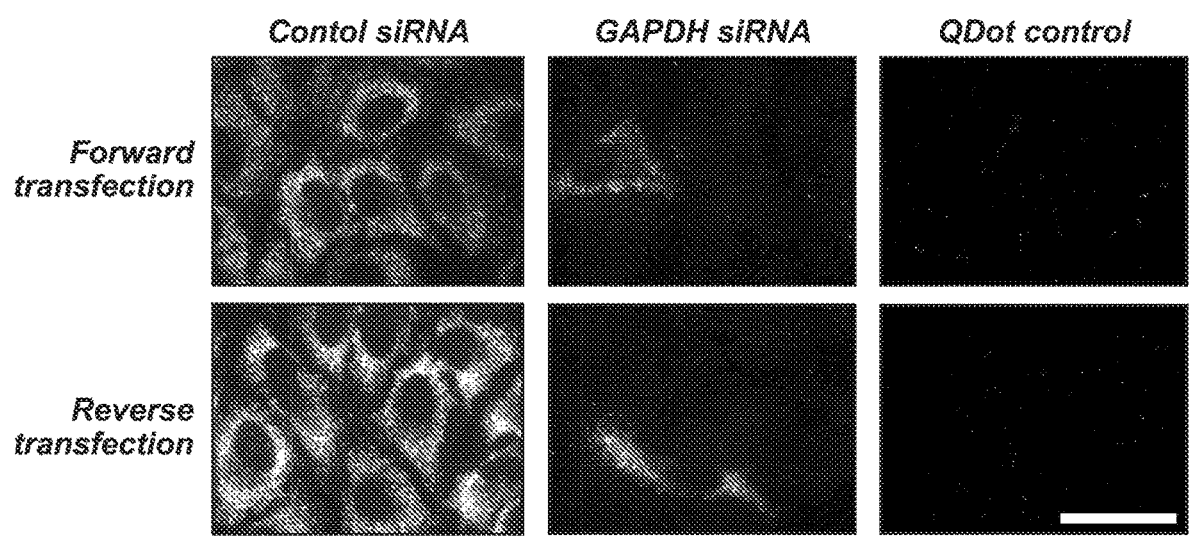

FIG. 17 shows the comparison of RNAi effect on GAPDH mRNA expression following forward vs. reverse transfection with siRNA. Both transfection methods had no effect on GAPDH expression when non-targeting control siRNA was used (left panels) and yielded efficient GAPDH knock-down with GAPDH-targeting siRNA (middle panels), as evident from the lack of mRNA staining above non-specific QDot background (right panels). At the same time, small fraction of cells failed to get transfected and, as a result, expressed normal levels of GAPDH mRNA consistent with control experiments. This observation corroborates an all-on/all-off effect of RNAi regardless of the transfection method used. All images were obtained with hyperspectral imaging (HIS) and were normalized for direct comparison of signal intensity. Scale bar, 50 µm.

Figure 18:
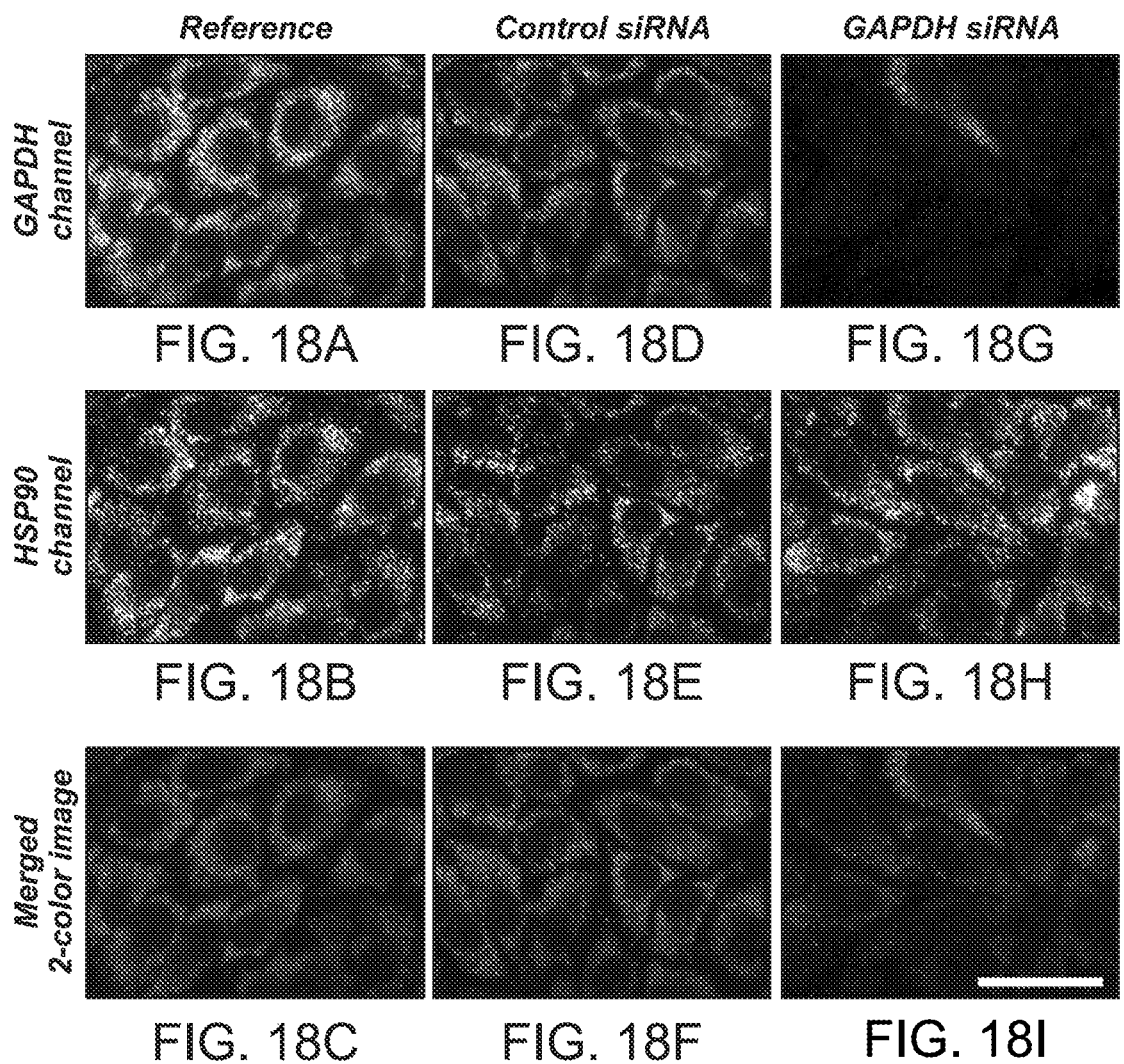

FIG. 18 shows assessment of heterogeneity in cell transfection with siRNA. Dual-labeling of GAPDH and HSP90-alpha mRNA with QDots enables direct visualization of siRNA transfection effect at a single-cell level. Cells were either grown under regular culture conditions (FIG. 18A, FIG. 18B, and FIG. 18C), transfected with control non-targeting siRNA (FIG. 18D, FIG. 18E, and FIG. 18F), or transfected with GAPDH-targeting siRNA (FIG. 18G, FIG. 18H, and FIG. 18I). After a 24-hour treatment with GAPDH siRNA, the majority of cells had completely degraded GAPDH mRNA, as evident from the lack of GAPDH mRNA staining (FIG. 18G). At the same time, HSP90-alpha mRNA not targeted by RNAi machinery remained unperturbed (FIG. 18H). Interestingly, a single cell in the field of view failed to transfect with GAPDH siRNA (FIG. 18G, FIG. 18H, and FIG. 18I), expressing regular levels of GAPDH mRNA consistent with cells treated with control siRNA (FIG. 18D, FIG. 18E, and FIG. 18F) and reference cells not transfected with siRNA (FIG. 18A, FIG. 18B, and FIG. 18C), suggesting an all-on/all-off effect of RNAi. Dual-color images were obtained with hyperspectral imaging (HIS) and were unmixed in QDot channels. Panels for individual channels (FIG. 18A, FIG. 18B, FIG. 18D, FIG. 18E, FIG. 18G, and FIG. 18H) were normalized for direct comparison of signal intensity. In merged 2-color images (FIG. 18C, FIG. 18F, and FIG. 18I) The GAPDH channel was false-colored green and the HSP90-alpha channel was false-colored red. Scale bar, 50 µm.

Figure 19:
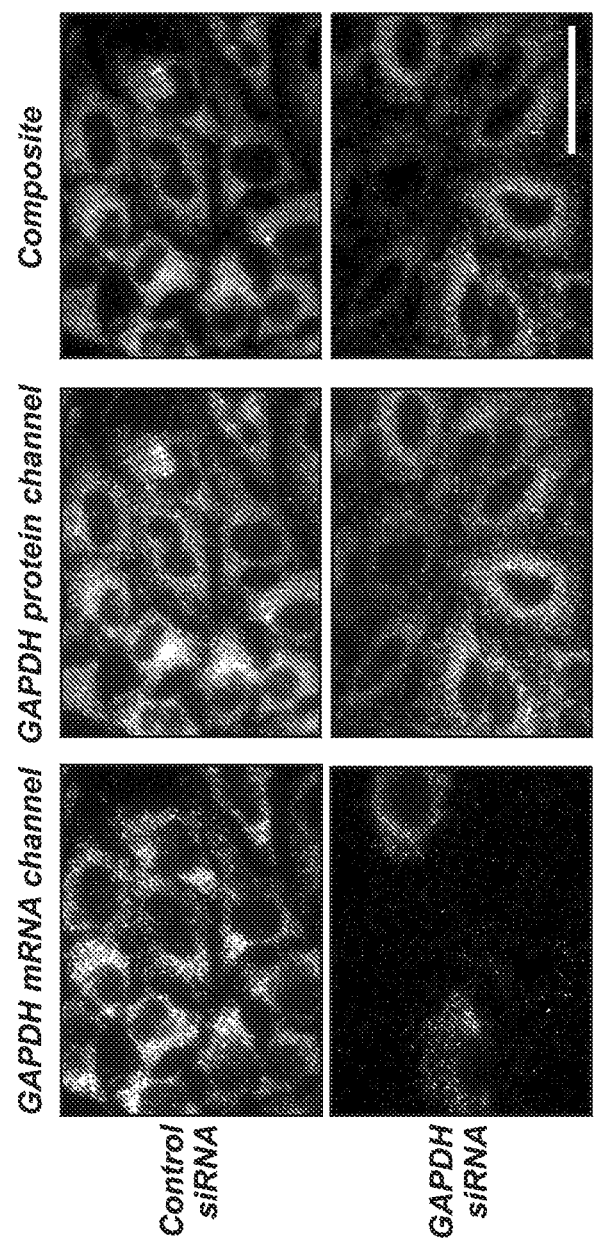

FIG. 19 shows assessment of GAPDH RNAi heterogeneity at mRNA and protein levels with multi-omics imaging. Dual labeling of GAPDH mRNA and protein 24 hrs post-transfection with GAPDH-targeting siRNA highlights heterogeneity in mRNA expression levels (bottom left panel) along with the lack of RNAi effect on the protein level (bottom middle panel) at this time point. Transfection with non-targeting control siRNA (top row) failed to affect GAPDH expression, yielding uniform mRNA and protein staining throughout all cells. Dual-color images were obtained with hyperspectral imaging (HSI), and individual channels were normalized for direct comparison of signal intensity. The GAPDH mRNA channel was false-colored red and the GAPDH protein channel was false-colored green in a composite 2-color image. Scale bar, 50 µm.

Figure 20A:
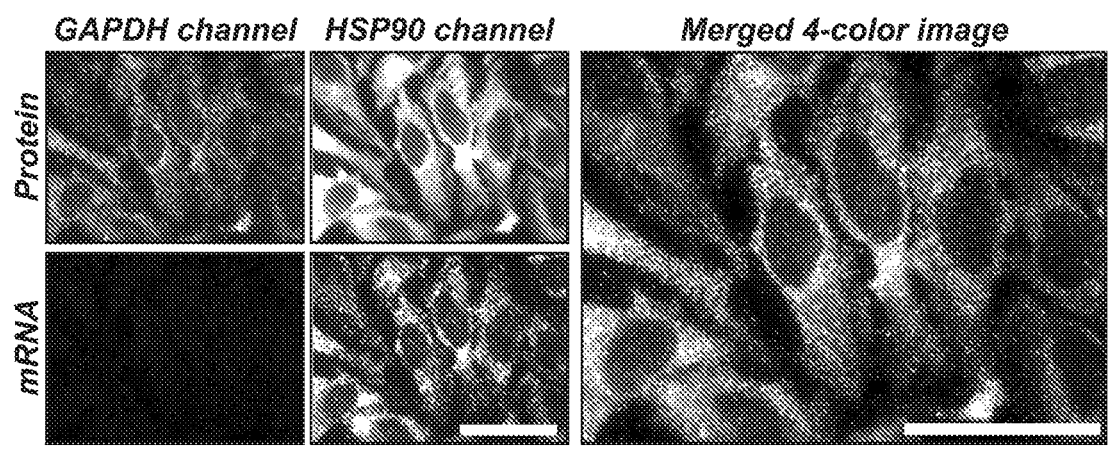
Figure 20B:
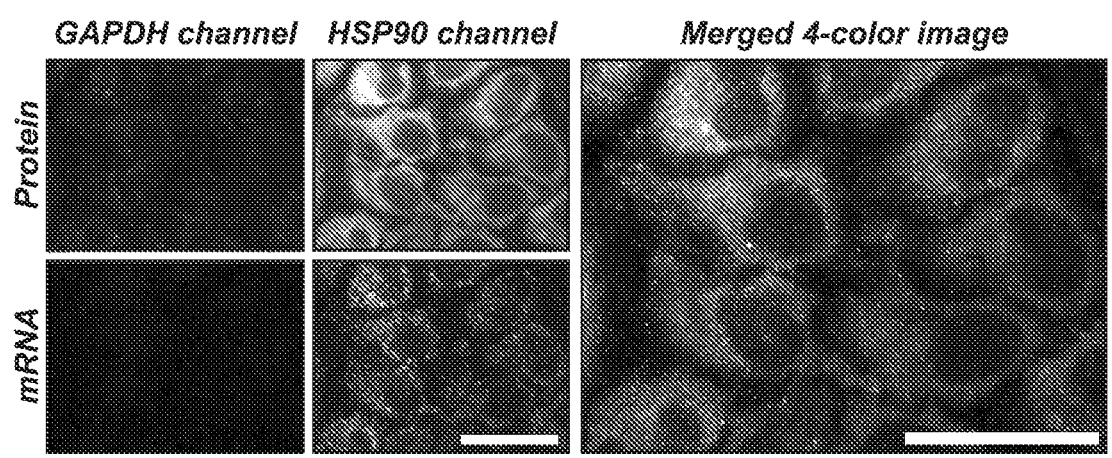

FIG. 20A and FIG. 20B show assessment of disparity in RNAi kinetics at mRNA and protein levels. HeLa cells were transfected with GAPDH siRNA for 24 hours (FIG. 20A) and 48 hours (FIG. 20B). GAPDH and HSP90-alpha mRNA, along with corresponding proteins, were simultaneously assessed with QDot-based multi-omics imaging methodology. Consistent with mRNA-only analysis, multi-omics imaging highlights complete and selective degradation of GAPDH mRNA 24 hours post-transfection, whereas GAPDH protein level remained nearly unperturbed (FIG. 20A). Lagging mRNA knock-down 48 hours post-transfection selective degradation of GAPDH protein was observed (FIG. 20B). All grayscale images were normalized to HSP90 protein channel for direct comparison of staining intensities. In a merged 4-color image the GAPDH protein channel was false-colored yellow, the HSP90-alpha protein channel was false-colored blue, the GAPDH mRNA channel was false-colored green, and the HSP90-alpha mRNA channel was false-colored red. Scale bar, 50 µm.

Figure 21A:
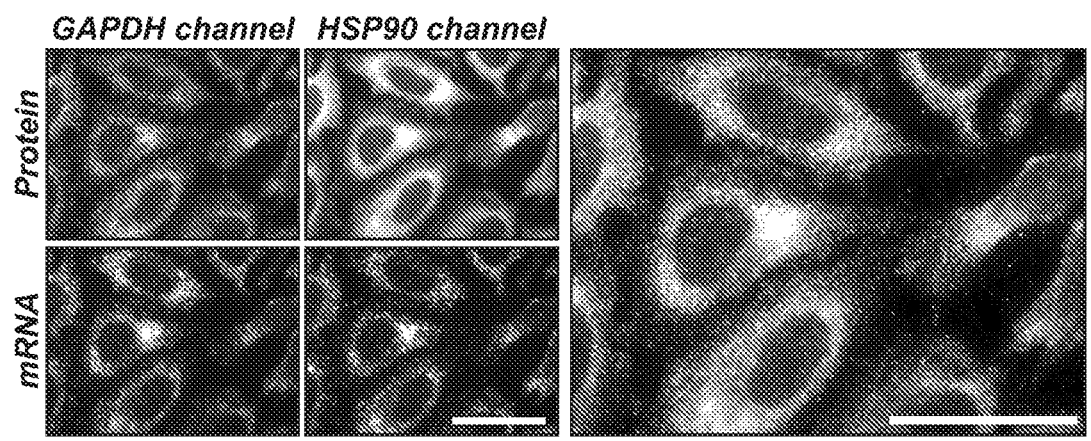
Figure 21B:
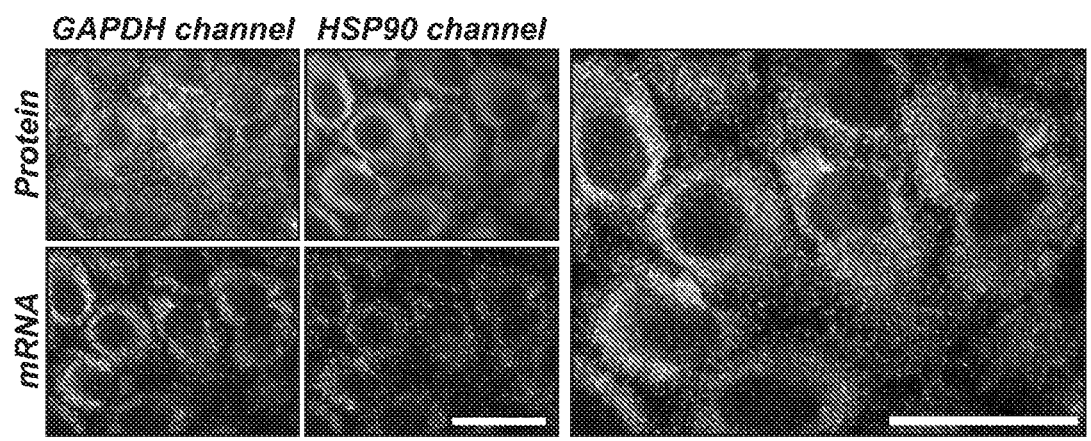

FIG. 21A and FIG. 21B show multi-omics evaluation of GAPDH and HSP90-alpha expression at mRNA and protein levels under regular cell culture conditions. To provide a reference of normal GAPDH and HSP90 expression levels to RNAi experiments, cells were grown under regular cell culture conditions for 24 hrs (FIG. 21A) and 48 hrs (FIG. 21B). All targets of interest were labeled via a 2+2 encoding procedure to produce a 4-plex staining. Consistent with expected fast growth of HeLa cells, cell density increased with time. However, GAPDH and HSP90 expression remained constant through 48 hrs of incubation, as evident from consistent intensity of mRNA and protein labeling. Multiplex images were obtained with hyperspectral imaging (HIS), and individual channels were normalized for direct comparison of signal intensity. The GAPDH mRNA channel was false-colored green, the HSP90 mRNA channel was false-colored red, the GAPDH protein channel was false-colored yellow, and the HSP90 protein channel was false-colored blue in a composite 4-color image. Scale bar, 50 µm.

Figure 22A:
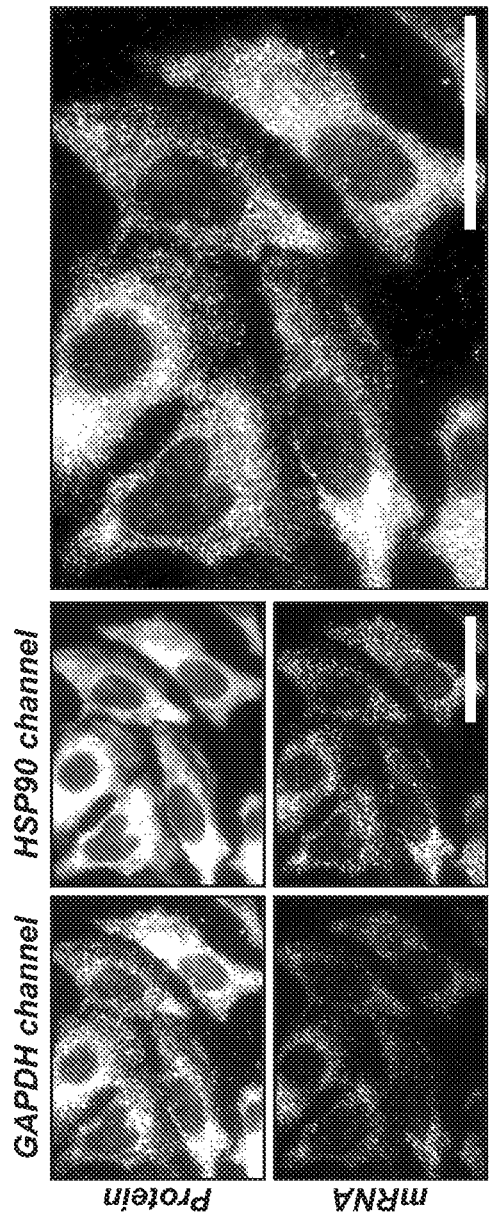
Figure 22B:
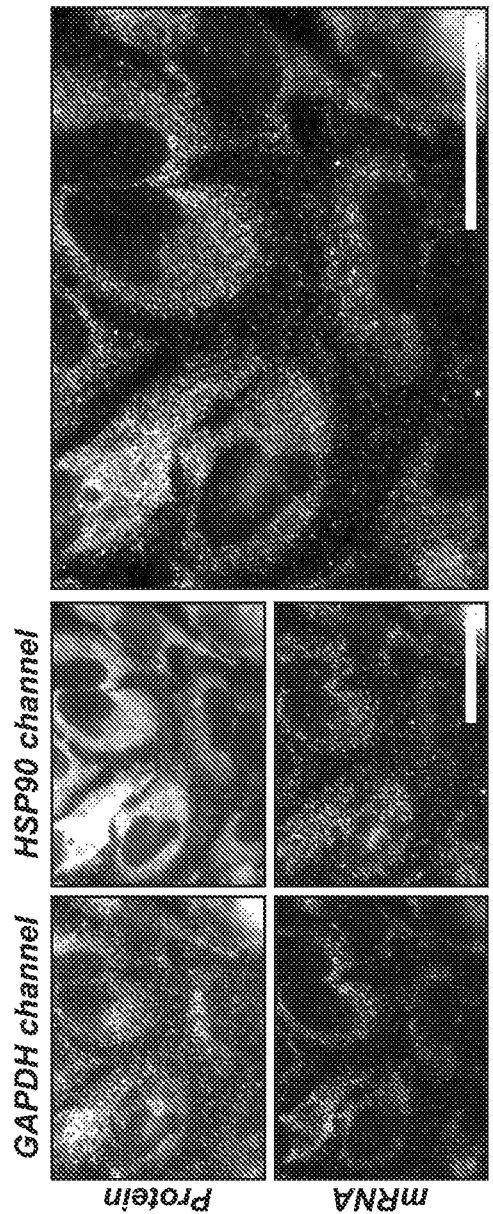

FIG. 22A and FIG. 22B show multi-omics evaluation of GAPDH and HSP90-alpha expression at mRNA and protein levels following transfection with a control (non-targeting) siRNA. To assess an effect of transfection on molecular expression profiles in reference to GAPDH RNAi experiments, cells were reverse transfected with non-targeting control siRNA for (FIG. 22A) 24 hrs and (FIG. 22B) 48 hrs. All targets of interest were labeled via a 2+2 encoding procedure to produce a 4-plex staining. Consistent with expected lack of RNAi with control siRNA, GAPDH and HSP90 expression remained constant through 48 hrs of incubation, as evident from consistent intensity of mRNA and protein labeling. Multiplex images were obtained with hyperspectral imaging (HSI), and individual channels were normalized for direct comparison of signal intensity. The GAPDH mRNA channel was false-colored green, the HSP90 mRNA channel was false-colored, the GAPDH protein channel was false-colored yellow, and the HSP90 protein channel was false-colored blue in a composite 4-color image. Scale bar, 50 µm.

Figures 23A, 23B:
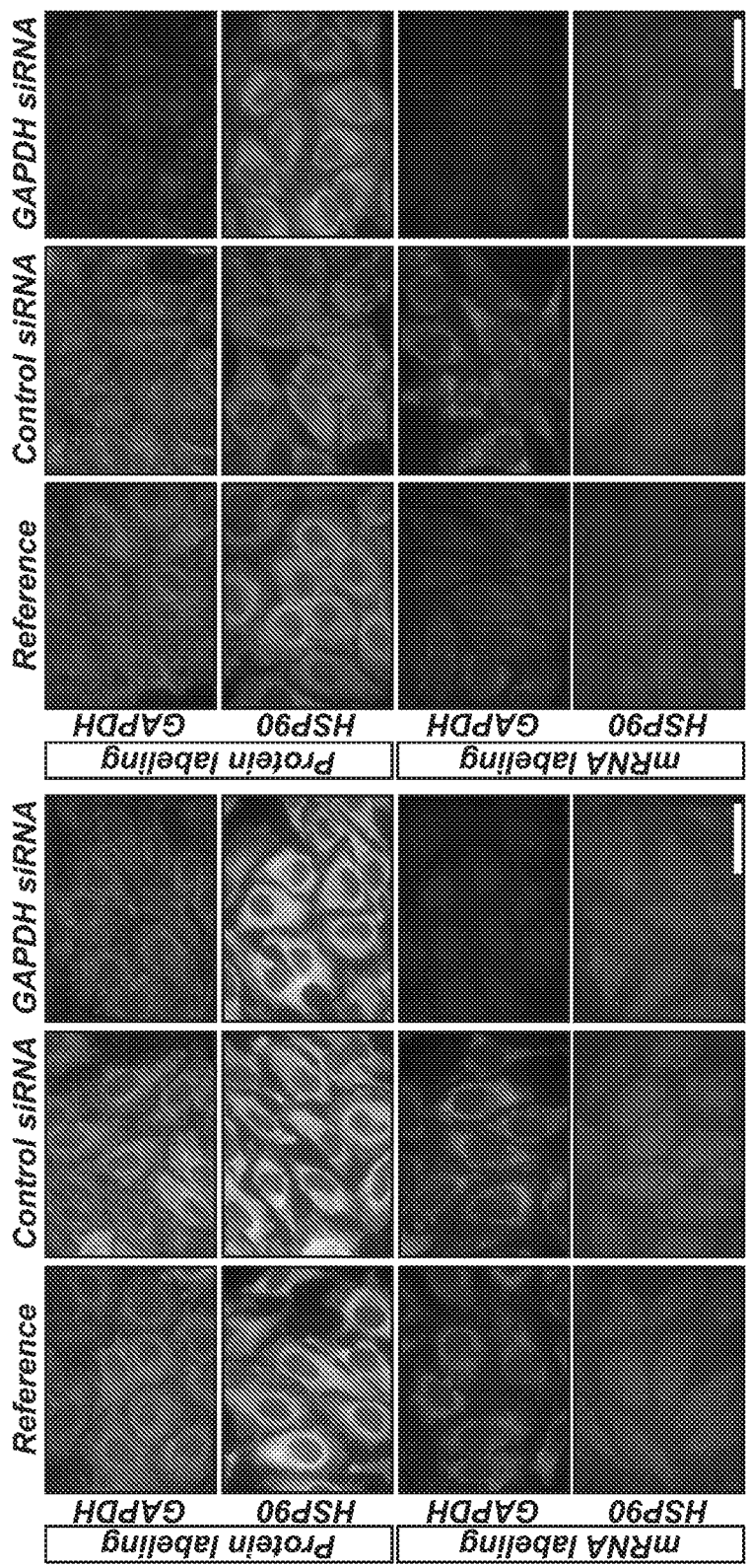

FIG. 23A and FIG. 23B show direct visualization of the effect and kinetics of GAPDH RNAi via single-plex labeling of individual protein and mRNA targets. To eliminate any potential effect of multi-omics labeling methodology and artifacts of hyperspectral (HSI) analysis, the GAPDH RNAi sample along with a reference sample and a control sample were performed on separate specimens in parallel (different wells of the same 24-well plate), followed by a single-plex labeling of individual targets and direct true-color imaging under consistent imaging conditions. Cells were reverse transfected for 24 hrs (FIG. 23A) and 48 hrs (FIG. 23B) prior to fixation and staining. Consistent with multi-omics analysis, single-plex imaging confirmed efficient and specific degradation of GAPDH mRNA within 24 hrs post-transfection, whereas the RNAi effect on GAPDH protein level can be observed only 48 hrs post-transfection. Scale bar, 50 µm.

Figure 24:
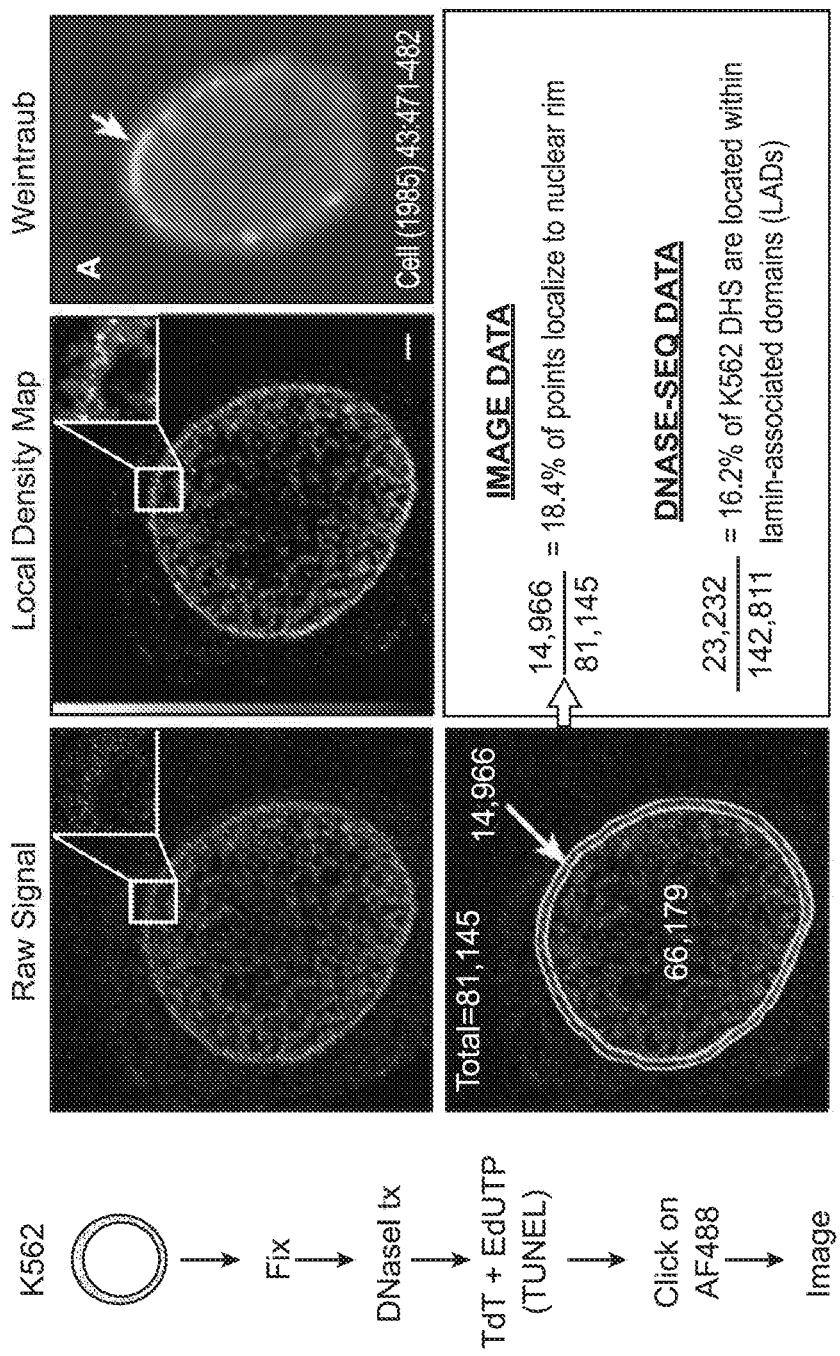

FIG. 24 shows the labeling of DNaseI cut sites in a cell's nucleus using a terminal deoxynucleotidyl transferase dUTP nick end labeling (TUNEL) assay.

Figure 25:
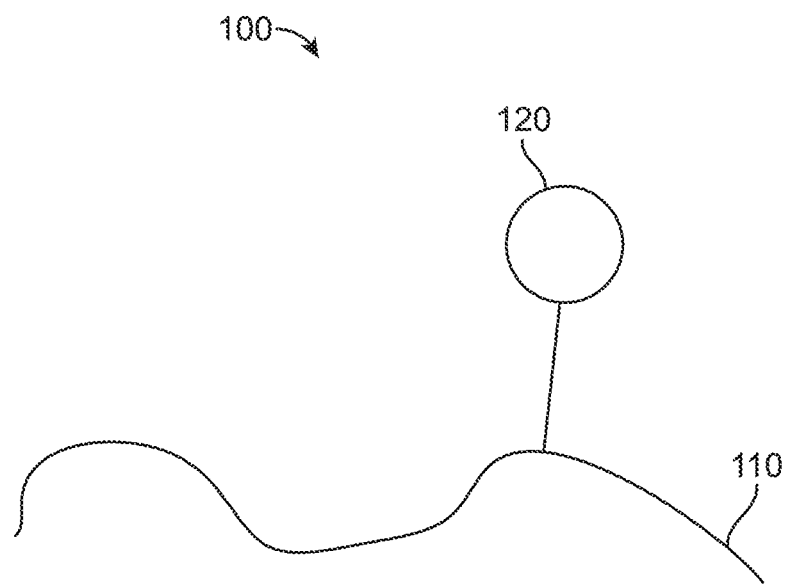

FIG. 25 shows a schematic of a detection agent comprising a probe, a detectable moiety, and a conjugating moiety.

Figure 26:
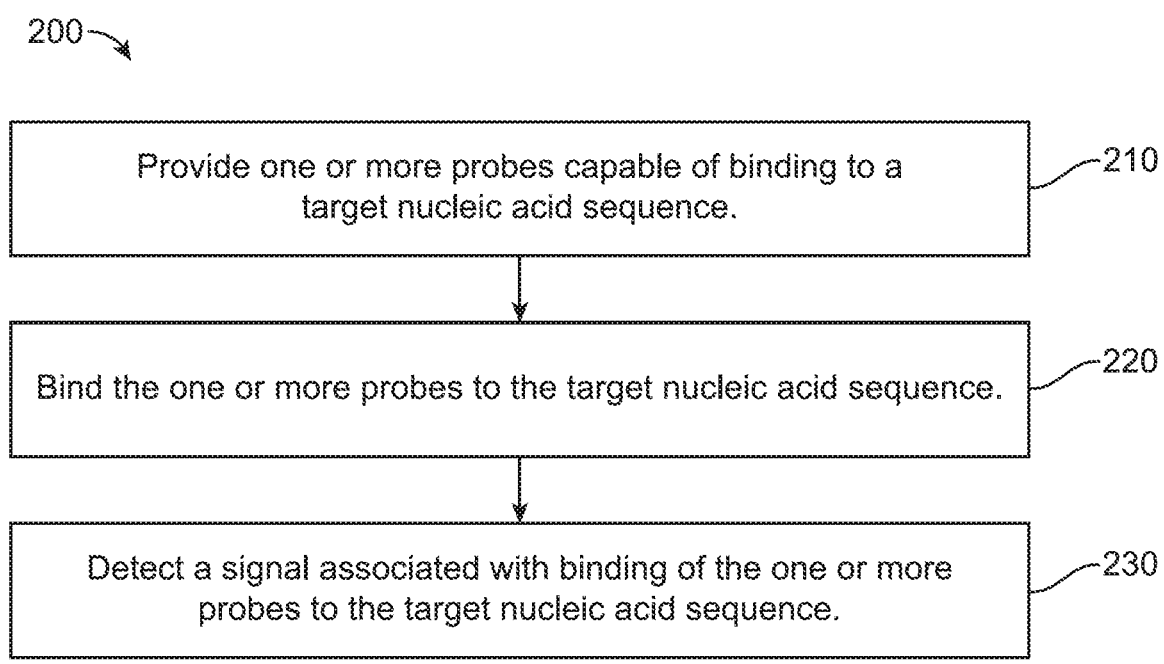

FIG. 26 shows a flowchart for a method of detecting a nucleic acid sequence.

Figure 27:
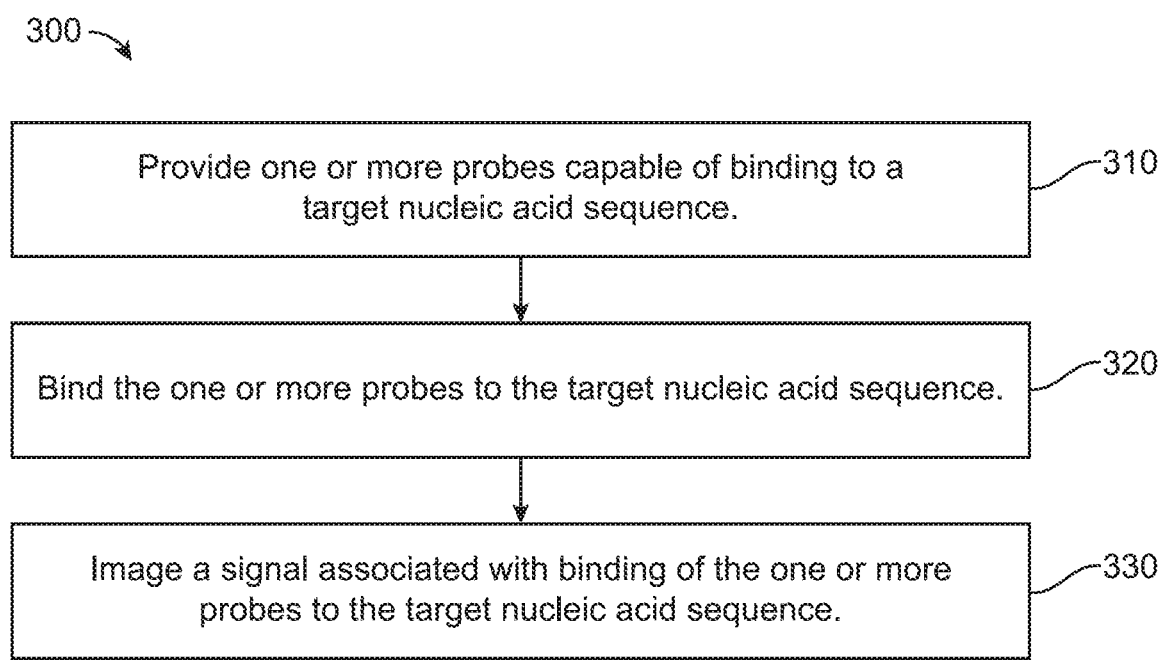

FIG. 27 shows a flowchart for a method of determining the spatial position of a nucleic acid sequence.

Figure 28:
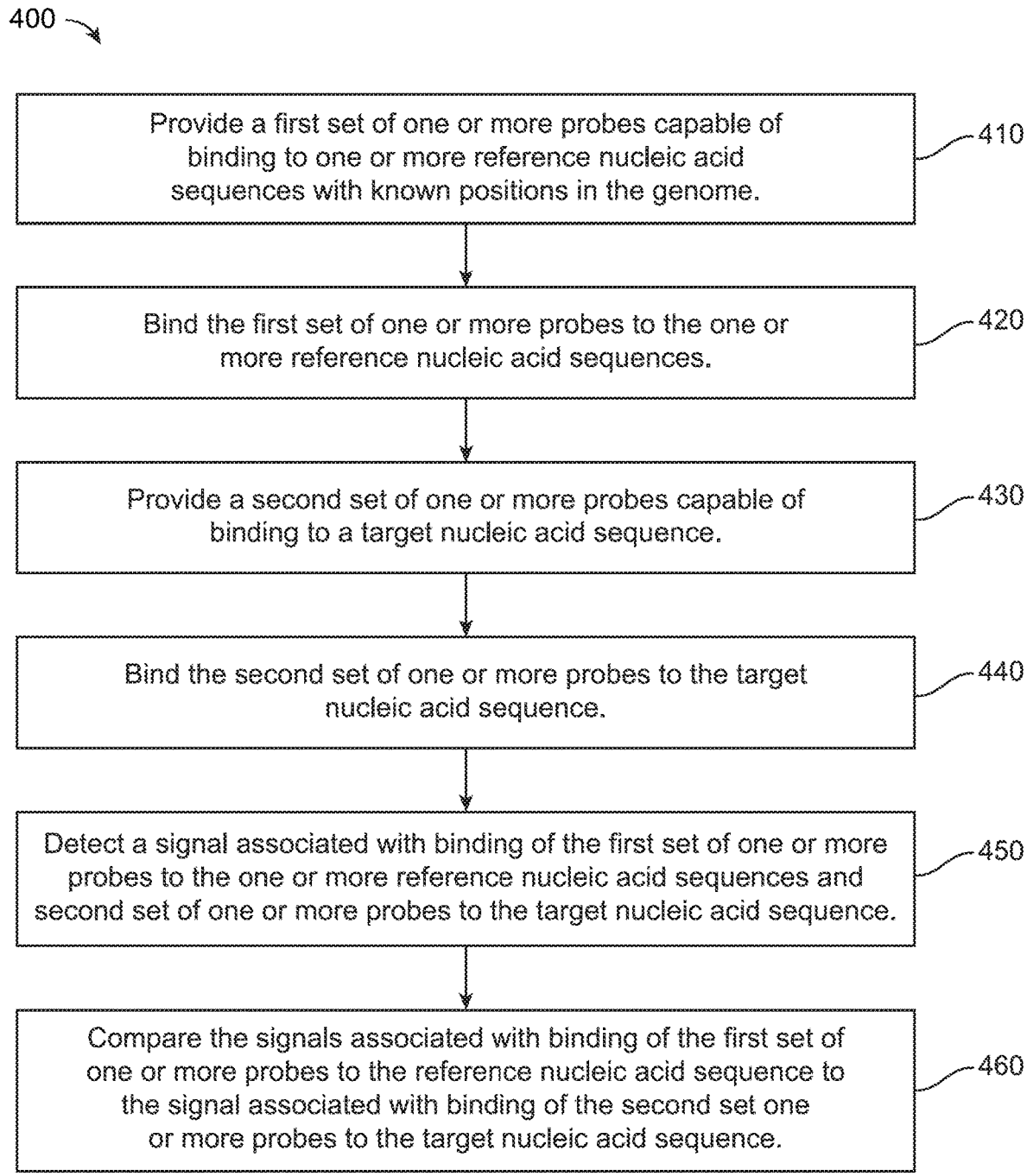

FIG. 28 shows a flowchart for a method of detecting the sequence position of a nucleic acid sequence.

Figure 29:
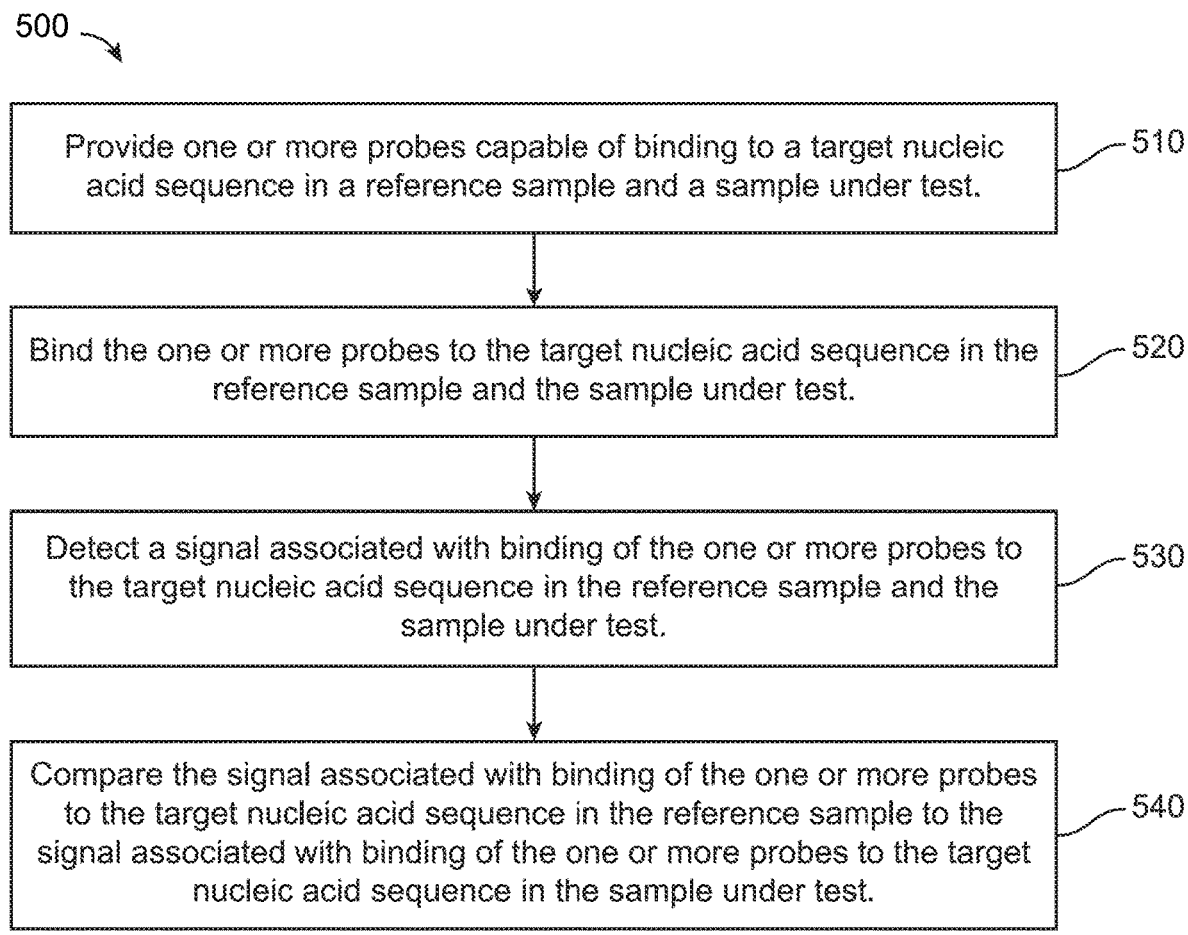

FIG. 29 shows a flowchart for a method of detecting a nucleic acid in a sample relative to a control.

Figure 30:
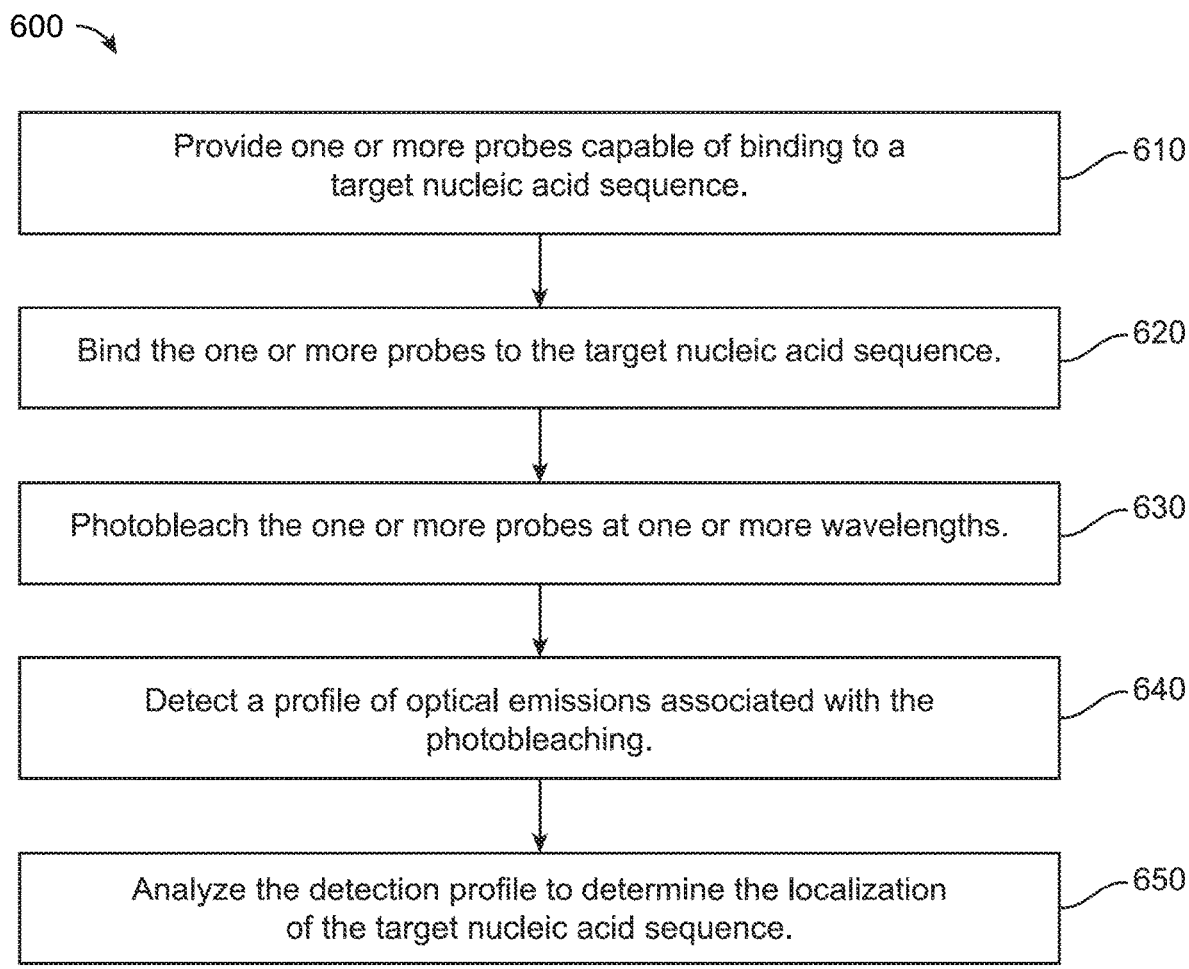

FIG. 30 shows a flowchart for a method of fluorescently detecting a target nucleic acid sequence.

Figure 31:
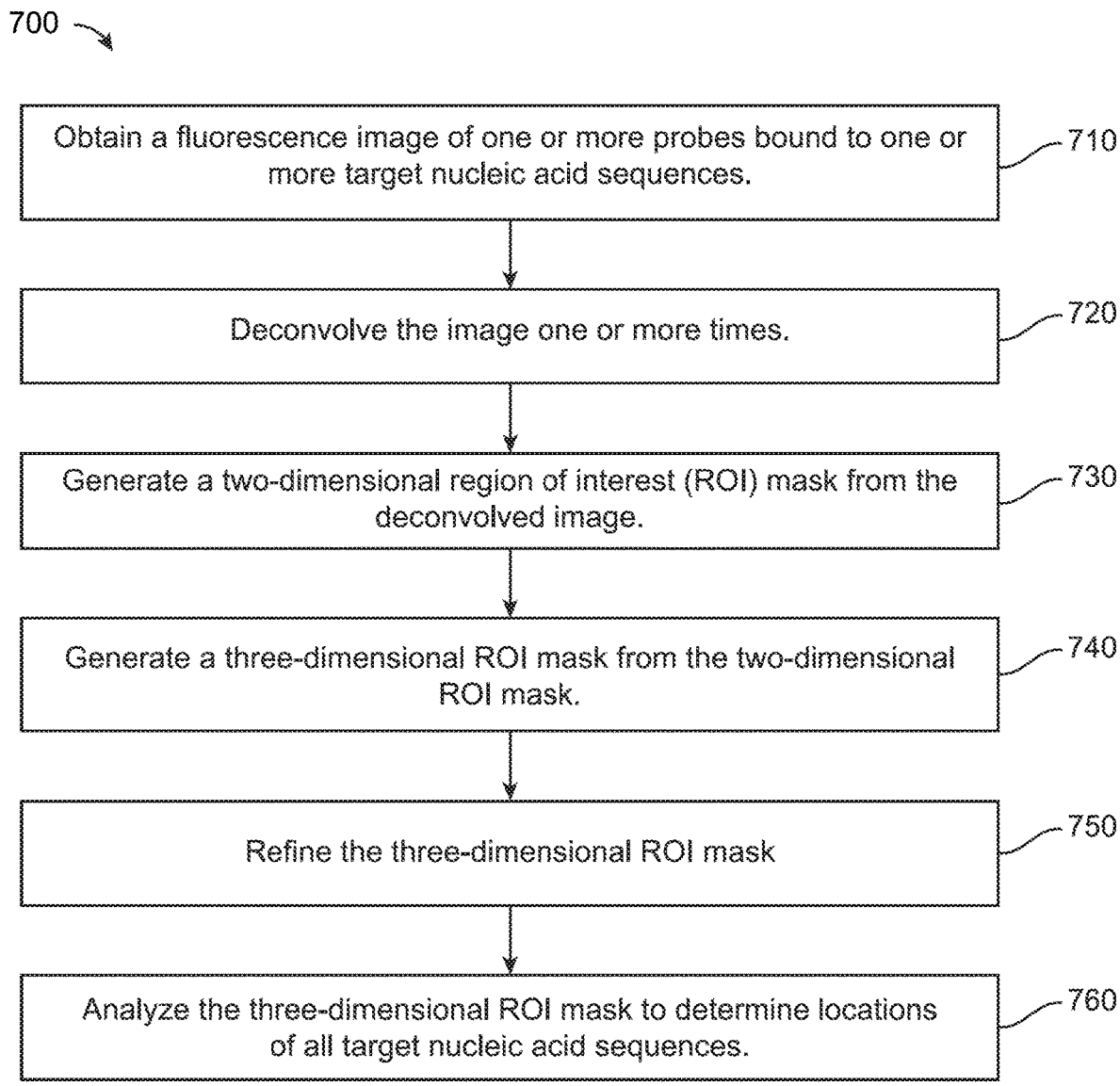

FIG. 31 shows a flowchart for a method of analyzing a fluorescence image of one or more target nucleic acid sequences.

Figure 32:
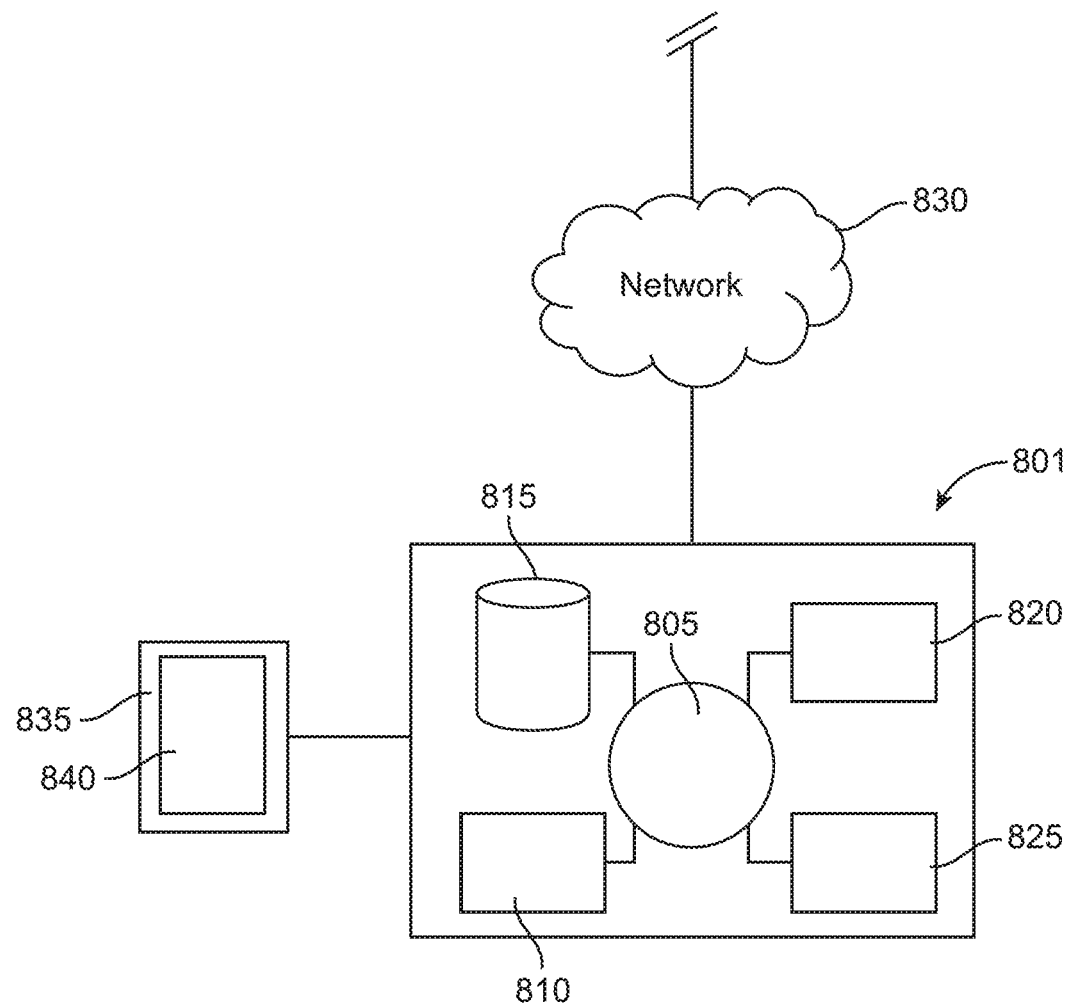
Figure 34A:
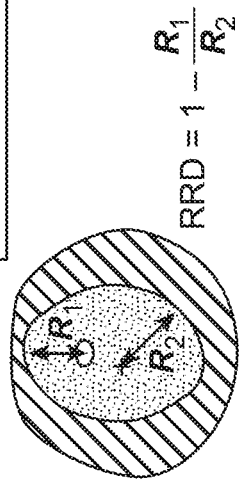
Figure 34B:
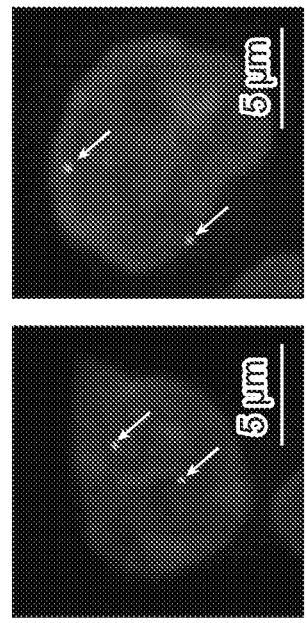
Figure 34C:
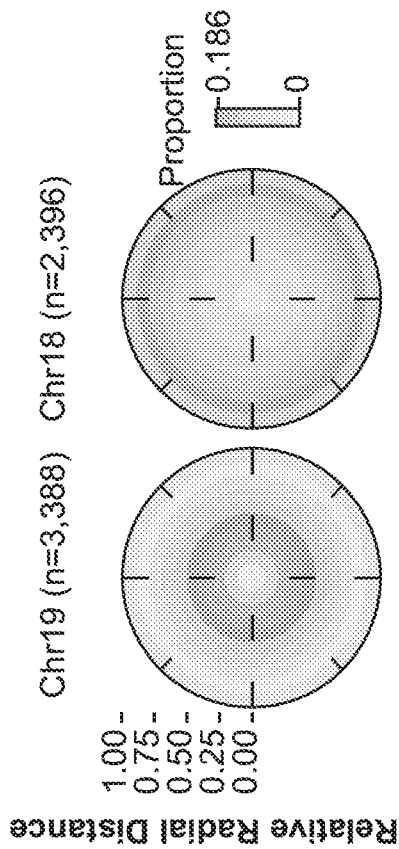
Figure 34D:
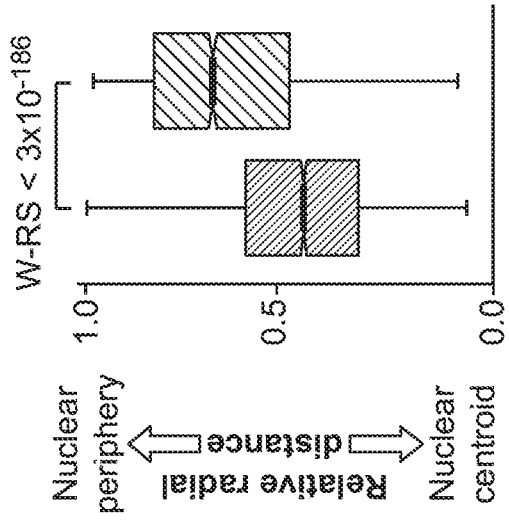

FIG. 32 illustrates a conceptual schematic of an exemplary computer server to be used for processing one or more methods described herein.

FIG. 33 shows the use of Nano-FISH to detect a 1.8 kb nucleic acid sequence. FIG. 33A shows a schematic of the Nano-FISH experiment. FIG. 33B shows the application of the Nano-FISH strategy to detect a 1.8 kb region encompassing the HS2 hypersensitive site of the β-globin locus control region (LCR) in triploid K562 erythroleukemia cells. FIG. 33C shows colocalization of the Nano-FISH signals (~1.8 kb target region) with those from standard BAC-derived probes (conventional DNA-FISH; ~170 kb target region), confirming the specificity of the detected Nano-FISH signal. FIG. 33D shows the efficiency and resolution of detection using Nano-FISH may be tuned according to the number of probes being used. FIG. 33E shows a comparison of the size of detected FISH spots between conventional FISH, pooled HS1-5 probes, and HS2 Nano-FISH. FIG. 33F shows a comparison of the intensity of detected FISH signals between conventional FISH, pooled HS1-5 probes, and HS2 Nano-FISH. FIG. 33G shows Nano-FISH detected for genomic regions with varying size, such as a genomic region size ranging from about 800 bp to 2.1 kb.

FIG. 34 shows the use of Nano-FISH to perform fine structural analysis of specific genomic loci within the nucleus. FIG. 34A shows the distinct spots produced by Nano-FISH probes targeting specific loci on these chromosomes. To measure the relative localization of the detected loci, the relative radial distance (RRD), a normalized measure of the position of the detected spot with respect to the nuclear centroid, was calculated. FIG. 34B shows a schematic of the relative radial distance. FIG. 34C shows that the chromosome 18 Nano-FISH signals are closer to the nuclear periphery. The distributions were obtained across 2,396 chromosome 18 signals and 3,388 chromosome 19 signals. FIG. 34D shows radial histograms of the two target loci. The differences in the distribution of signals with respect to the nuclear centroid are readily apparent in the histograms.

FIG. 35 shows the use of Nano-FISH for examining the interaction of a gene enhancer with its target gene promoter. FIG. 35A shows two-color Nano-FISH in 786-O and MCF-7 cells. The normalized inter-spot distance (NID) between these two genomic loci were compared. FIG. 35B shows a schematic of the normalized inter-spot distance. FIG. 35C shows that, on average, the spots are situated closer together in 786-O cells compared to MCF-7 cells. FIG. 35D shows that, in spite of this, absolute colocalization (NID=0) was actually a rare event in both cell types.

FIG. 36 shows the use of Nano-FISH to detect small genomic structural variations such as small losses or gains of DNA. ZFN-mediated genome editing was used to generate a triploid homozygous deletion of the β-globin locus control region (LCR, ~18 kb) in K562 cells, as shown in FIG. 36A. Cells imbued with this deletion are referred to as ΔLCR. Probes targeting either the HS2 or HS3 hypersensitive sites within the deleted region were utilized to detect loss of LCR in the genome edited cells, as shown in FIG. 36B and FIG. 36C. For the converse scenario, using TALEN-mediated homology directed repair, a sequence encoding for eGFP was inserted into the AAVS1 safe harbor locus on chromosome 19, as shown in FIG. 36D. This exogenously-derived sequenced was readily identified by Nano-FISH, as shown in FIG. 36E and FIG. 36F.

FIG. 37 shows the combination of Nano-FISH and super-resolution microscopy to obtain very fine-scale genome localization. FIG. 37A shows that these closely apposed loci are readily discernible as distinct spots by STED microscopy. Pair-wise measurements of other closely situated genomic segments such as HS1-HS4 (~12 kb) and HS2-HGB2 (~25 kb) were also readily obtained and revealed non-linear compaction of the β-globin locus control region and the surrounding genome which contains its target genes, as shown in FIG. 37B. Importantly, the high-throughput STED microscopy approach enables calculation of the distribution of actual distances between these various loci, as shown in FIG. 37C.

FIG. 38 shows a series of experiments to determine the optimal operating parameters for a Nano-FISH experiment. FIG. 38A shows how the labeling efficiency of the Nano-FISH procedure depends on denaturation temperature. With increasing temperature, the efficiency of Nano-FISH labeling increases, until a plateau is reached at a temperature of 78° C. FIG. 38B shows that the Nano-FISH labeling procedure is repeatable across experiments. FIG. 38C shows Nano-FISH detected for genomic regions with varying size, such as a genomic region size ranging from about 800 bp to 2.1 kb. FIG. 38D shows how the labeling efficiency of the Nano-FISH experiment depends on the number of oligo probes used. The labeling efficiency increases with the number of oligo probes used, attaining a maximum efficiency when 30 oligo probes are utilized. FIG. 38E shows how the detected fluorescence spot size depends on the number of oligo probes. FIG. 38F shows how the intensity of the fluorescence spot size depends on the number of oligo probes.

FIG. 39 shows a comparison of Nano-FISH and conventional FISH. FIG. 39A shows fluorescence images of β-globin lacking the LCR using conventional BAC probes (left panel), a pool of HS1-5 probes (middle panel), and the HS2 Nano-FISH technique (right panel). FIG. 39B shows the size of the probe sets used for the BAC, HS1-5, and HS2 experiments. As can be seen, the HS2 Nano-FISH experiment utilizes a significantly smaller nucleic acid sequence than conventional FISH techniques. FIG. 39C shows the labeling efficiency of the BAC, HS1-5, and HS2 experiments. FIG. 39D shows the size of the FISH spots for the BAC, HS1-5, and HS2 experiments. FIG. 39E shows the intensity of the FISH signals for the BAC, HS1-5, and HS2 experiments.

FIG. 40 shows the use of Nano-FISH to probe lentiviral transduction across a cell population with a broad range of multiplicity of infection FIG. 40A shows lentiviral transduction across a population of cells with a broad range of MOI. FIG. 40B shows infection by the lentivirus, including reverse transcription and random integration into cells.

FIG. 40C shows the use of Nano-FISH to assess the number of integrations in each cell in pools of cells. FIG. 40D shows the accumulation of statistics for integration of lentiviral nucleic acids as a function of MOI.

Figure 41A:
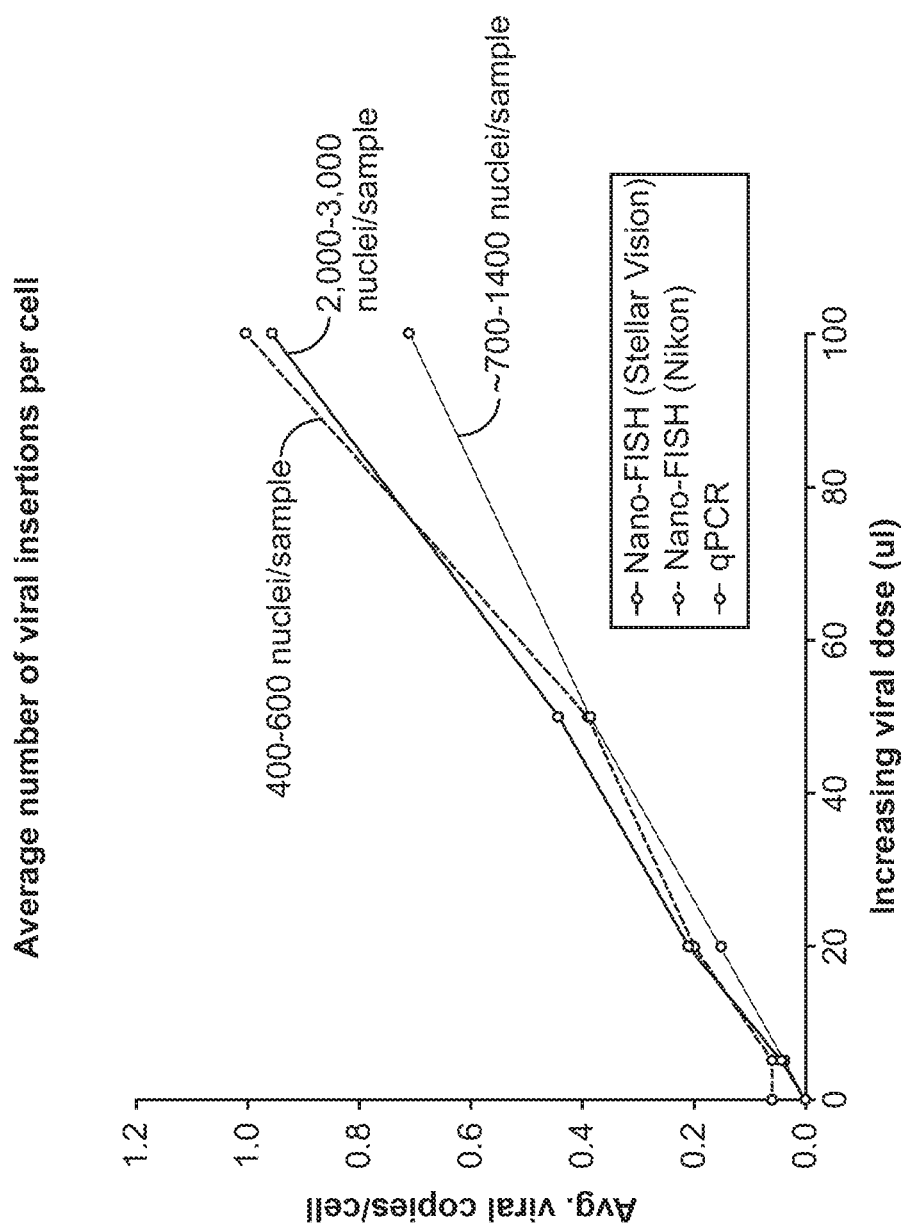
Figure 41B:
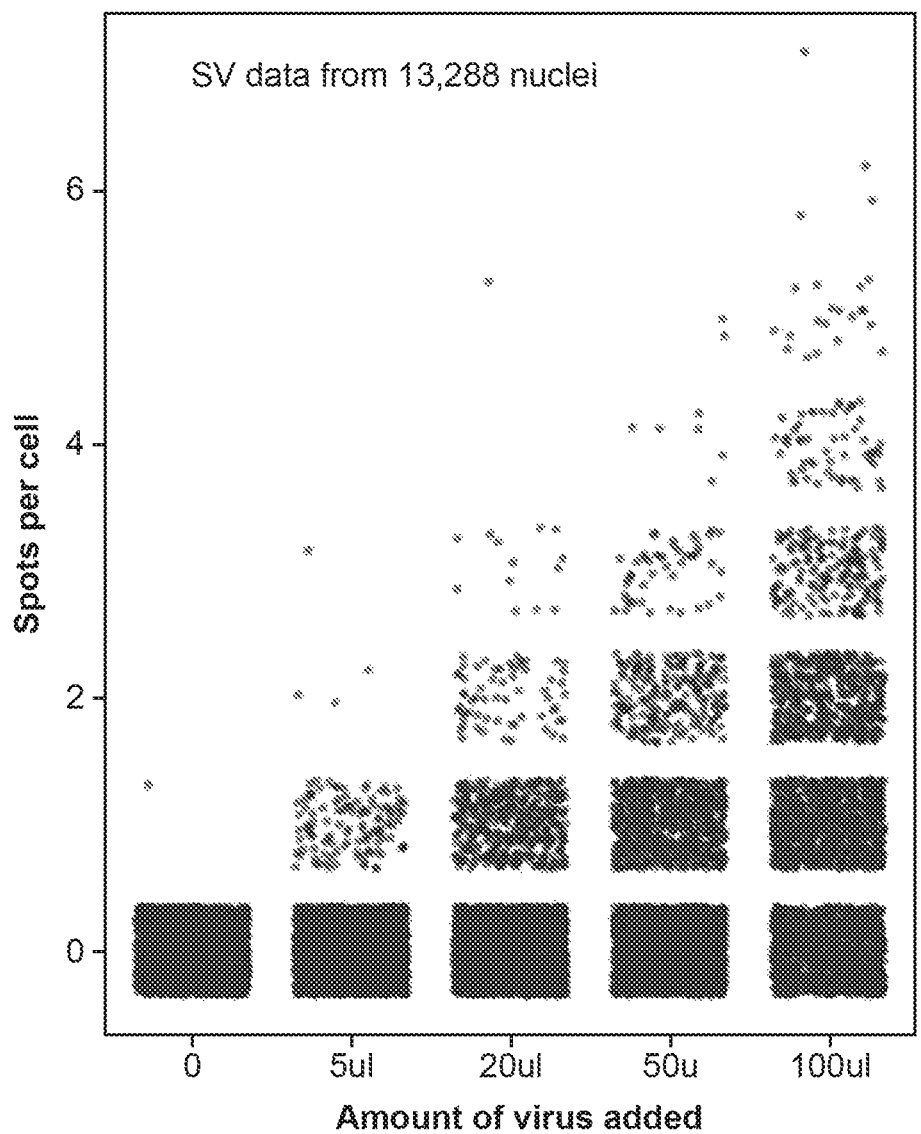

FIG. 41 shows the use of Nano-FISH combined with super-resolution imaging to probe the statistics of viral insertion. FIG. 41A shows the average number of viral insertions per cell as a function of viral concentration, probed using quantitative PCR (qPCR), a Nikon wide-field fluorescence microscope, and a Stellar Vision synthetic aperture optics (SAO) super-resolution microscope. FIG. 41B shows a histogram of the number of viral integrations in each cell imaged by the SAO super-resolution microscope.

Figure 42:
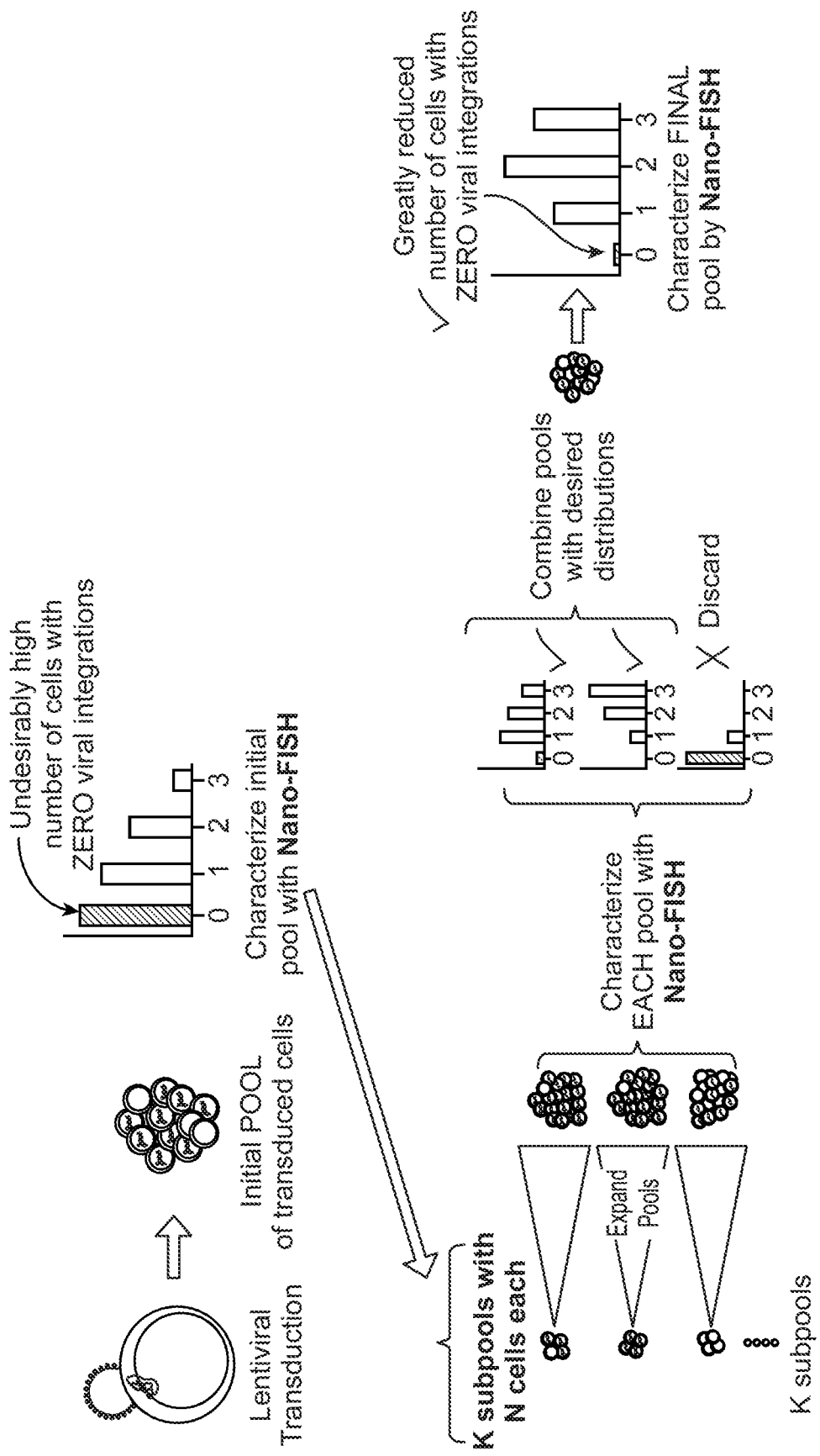

FIG. 42 shows a schematic of using Nano-FISH characterization of sorted subpools enrich for a population with the desired distribution of viral integrations after viral transduction of a cell population.

Figure 43:
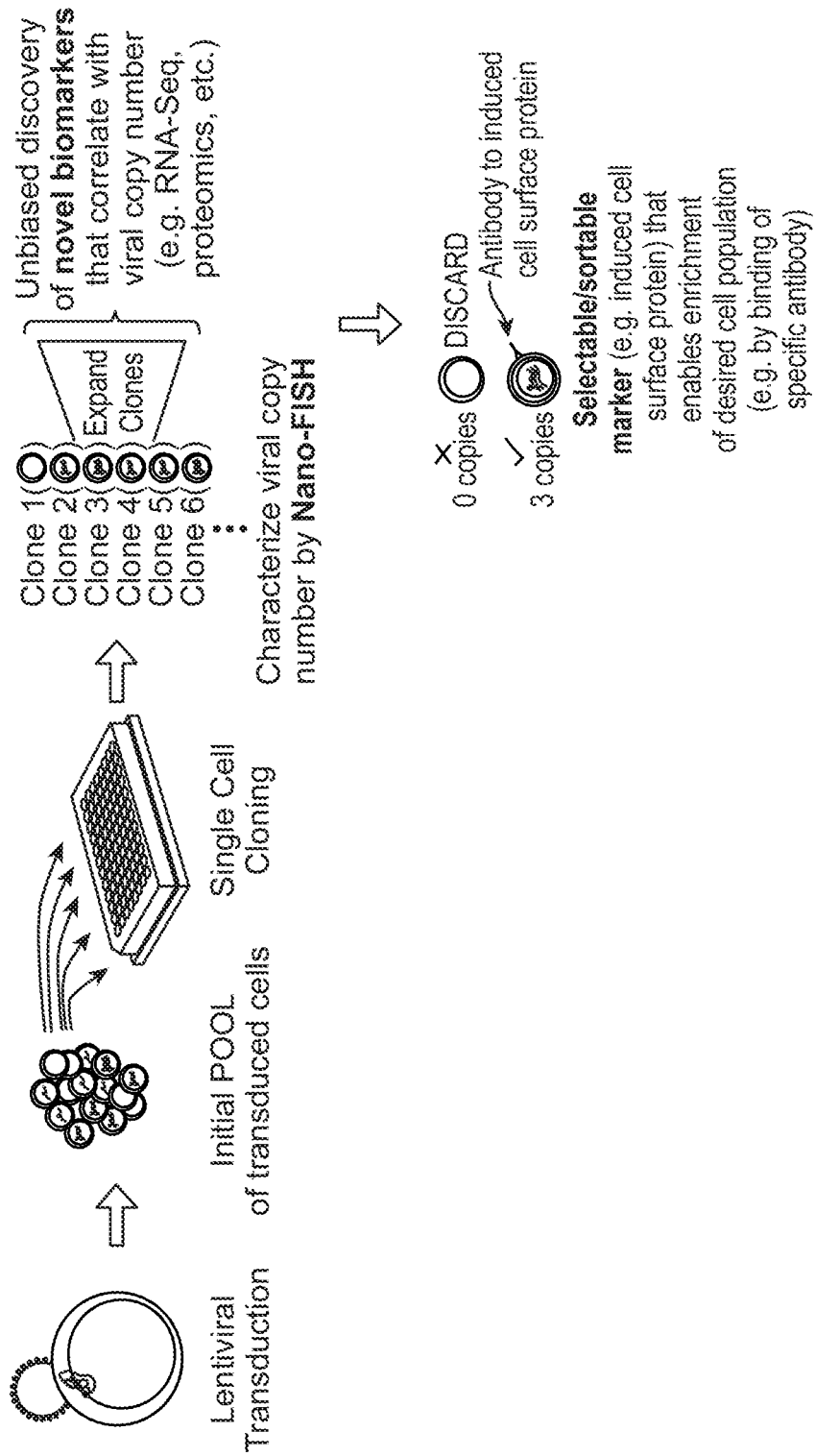

FIG. 43 shows a workflow schematic of using Nano-FISH to characterize the number of viral integrations in cells after viral transduction, clonally expand cells with a known number of viral integrations, and then perform assays to detect biomarkers. The number of viral integrations is then correlated with the expression of biomarkers, which then is used as selectable or sortable maker for cells with that number of viral integrations.

Figure 44:
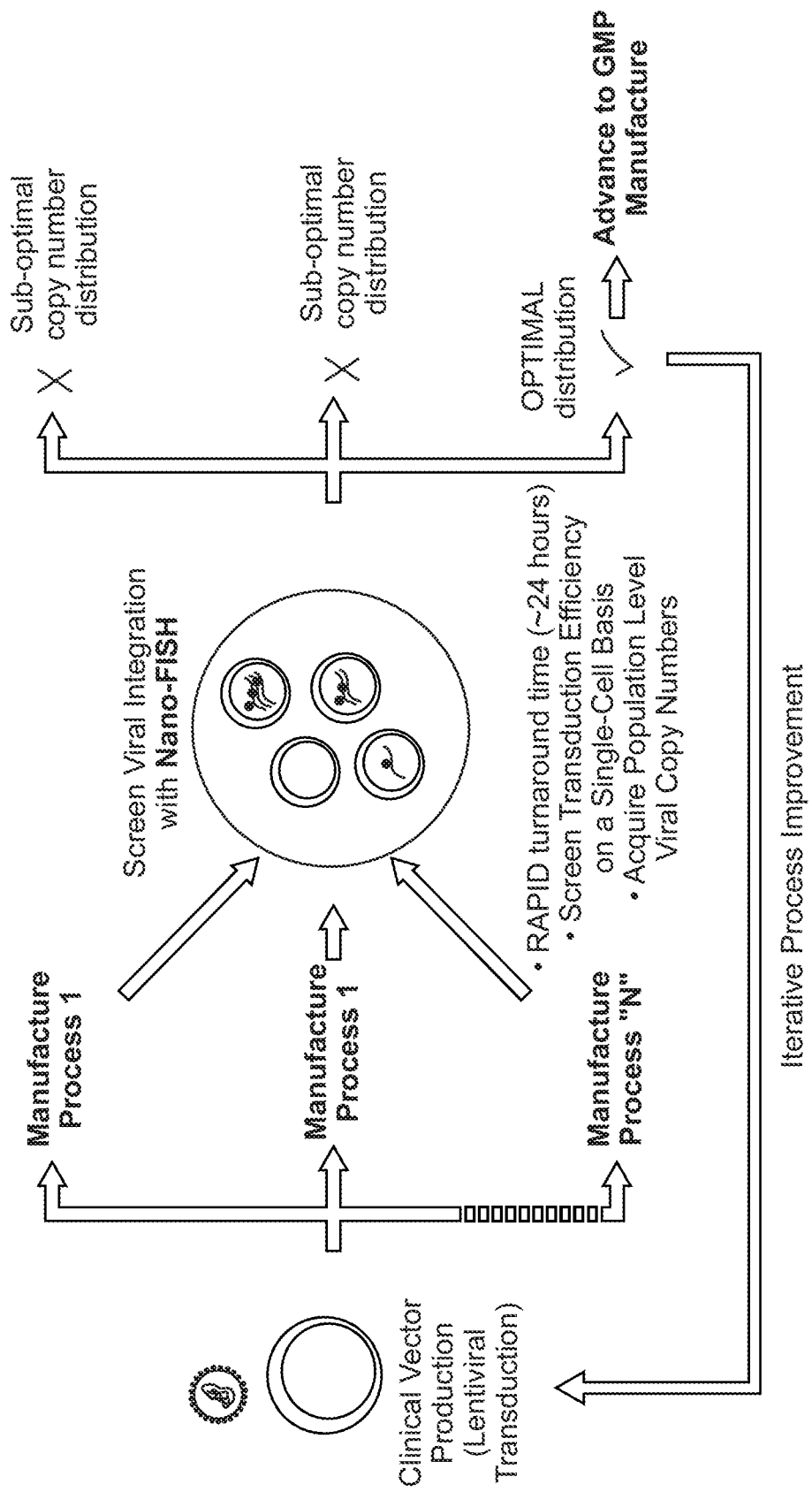

FIG. 44 shows a schematic for improved clinical vector manufacture and production by using viral Nano-FISH to sort for the optimal number of viral integrations in transduced cells, such as cells transduced to express chimeric antigen receptor (CAR) T cells.

Figure 45:
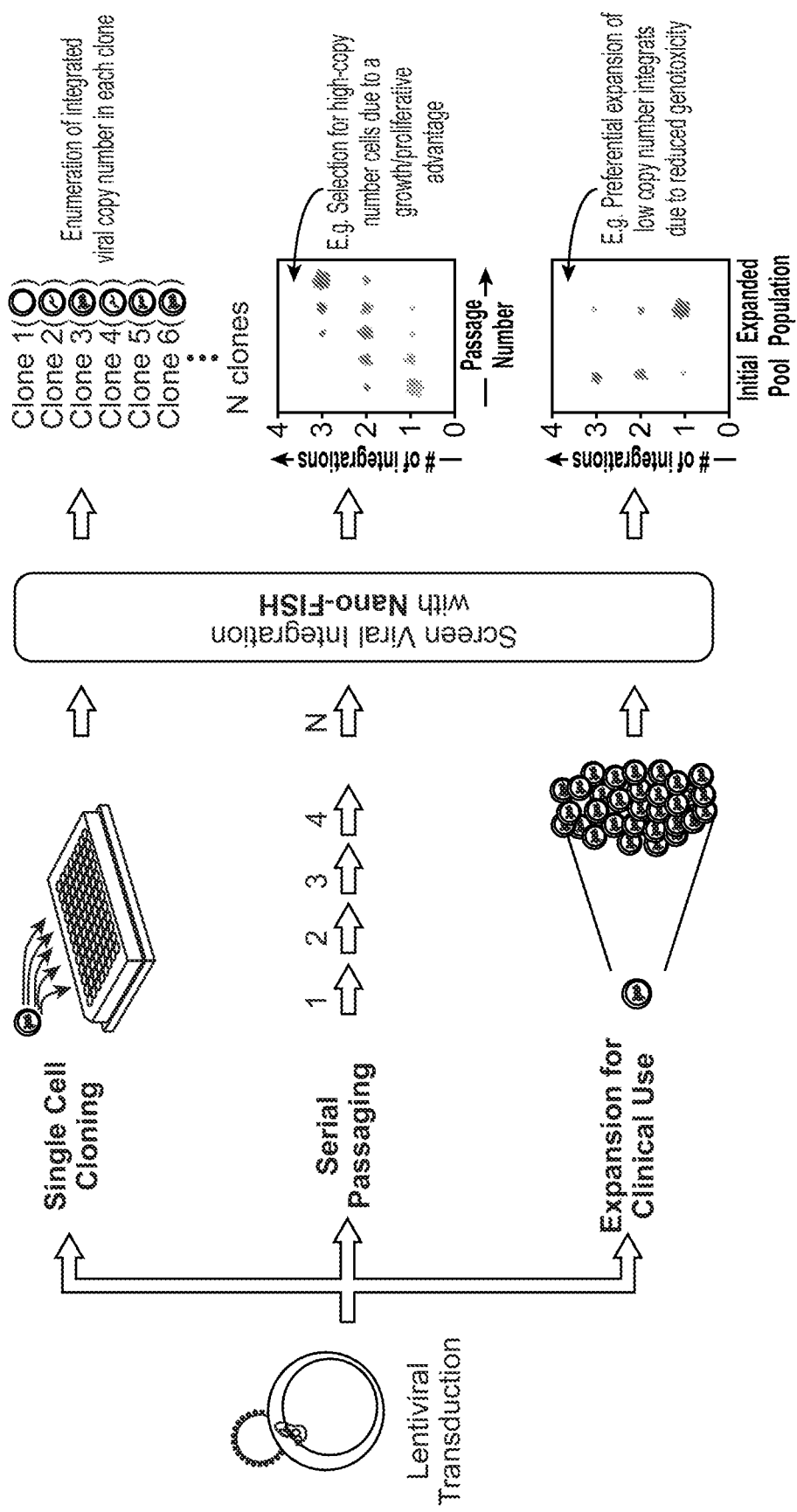

FIG. 45 shows a workflow schematic for improved quality control during the cell passage/expansion, cloning, and manufacture of cells after viral transduction for use as a therapy, such as for T cells transduced to express a CAR for cancer therapy.

Figure 46:
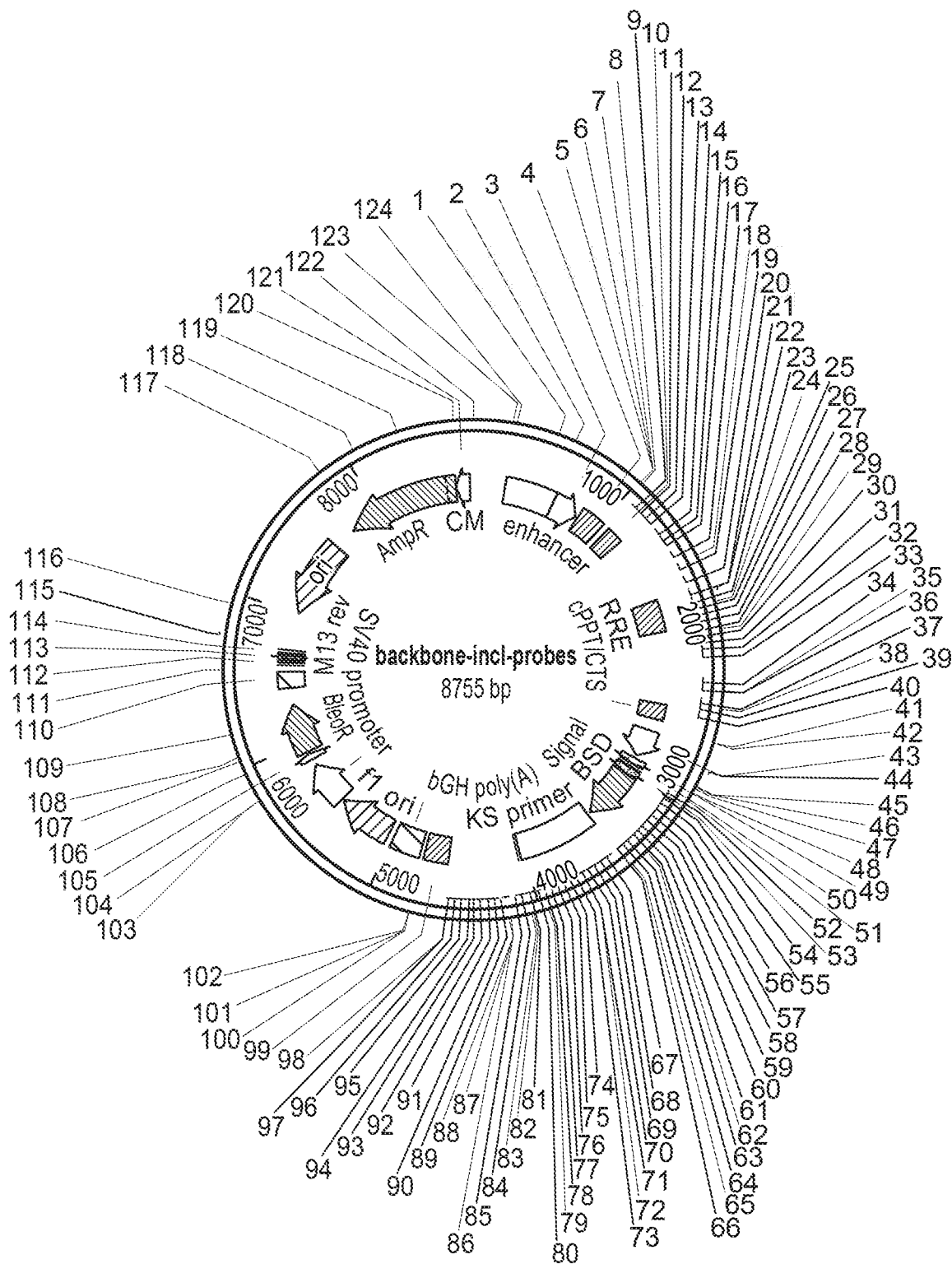

FIG. 46 shows a schematic of a lentivirus vector indicating locations of probes along the lentivirus vector that may be used for detection of the corresponding lentivirus vector nucleic acid sequence using Nano-FISH.

Figure 47A:
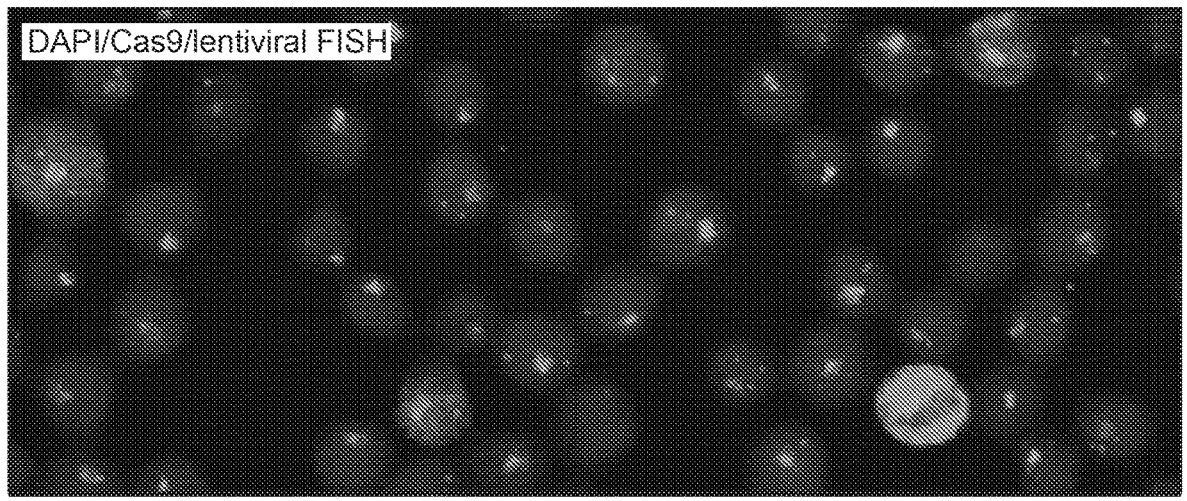

FIG. 47A shows simultaneous visualization of lentiviral integrations using Nano-FISH and transgene (Cas9) protein production using an anti-Cas9 antibody.

Figure 47B:
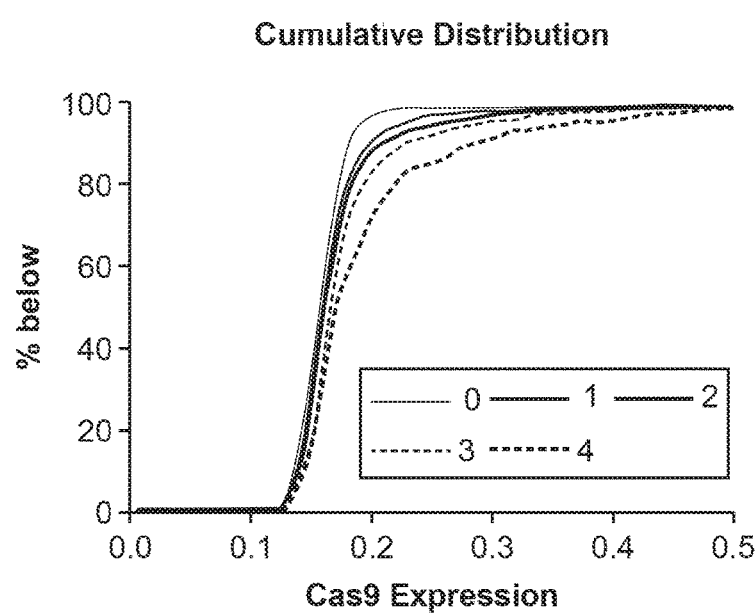

FIG. 47B shows a graph of the cumulative distribution of the number of lentiviral integrations associated with the level of Cas9 expression from b.

Figure 48:
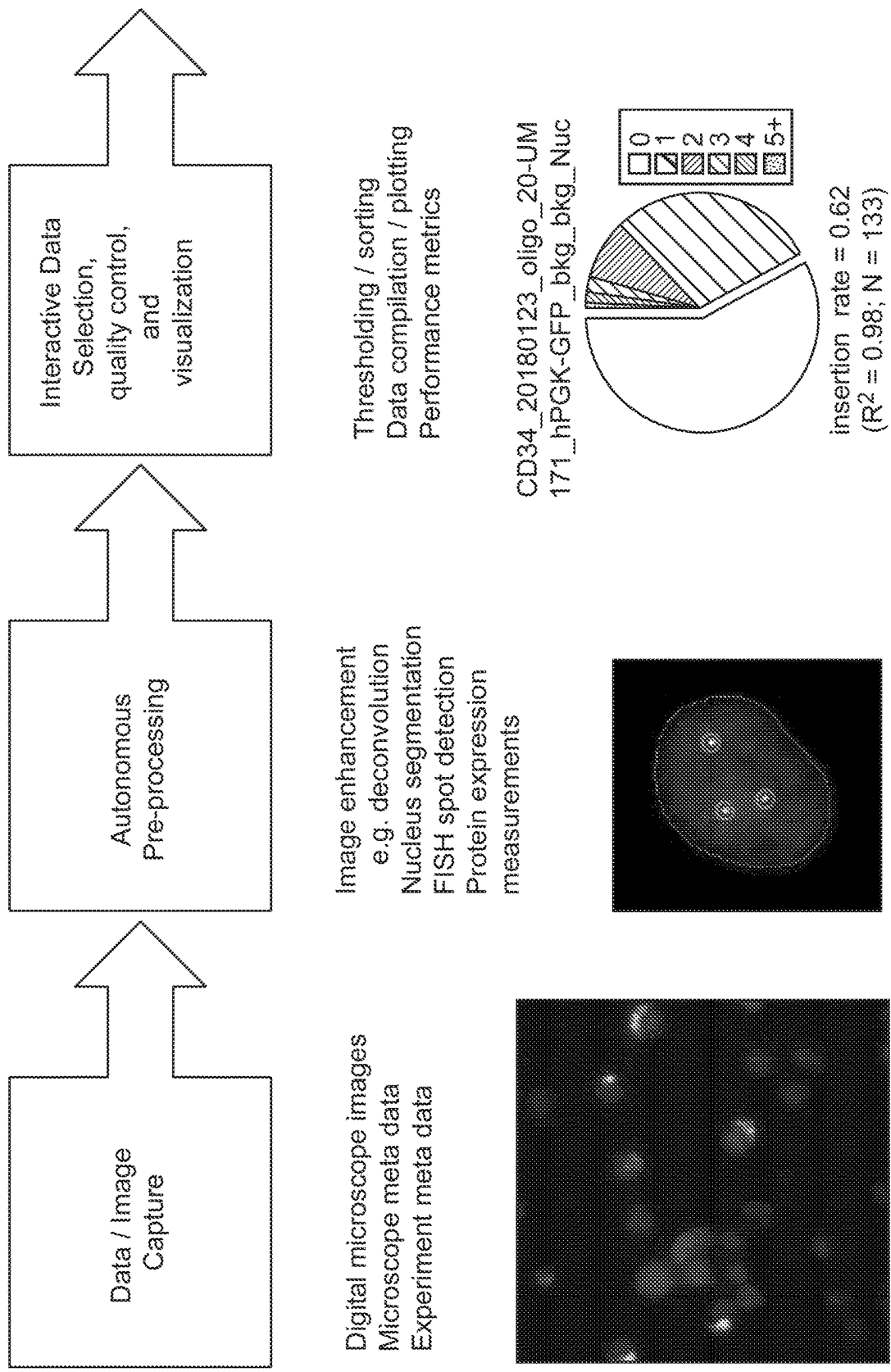

FIG. 48 illustrates a flow chart depicting the image analysis steps of the present disclosure including data/image capture, autonomous pre-processing, and interactive data selection, quality control, and visualization.

Figure 49:
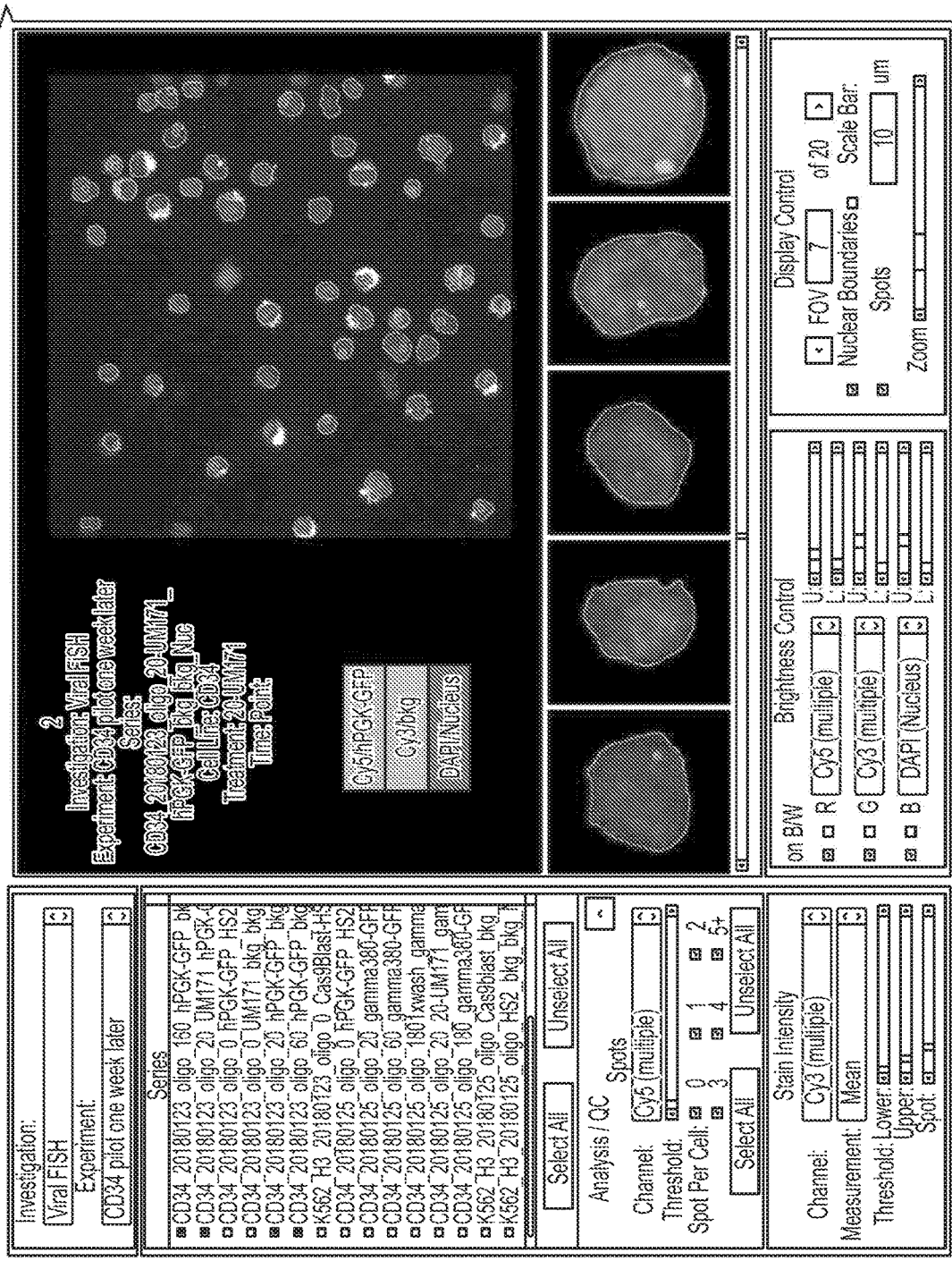
Figure 49:
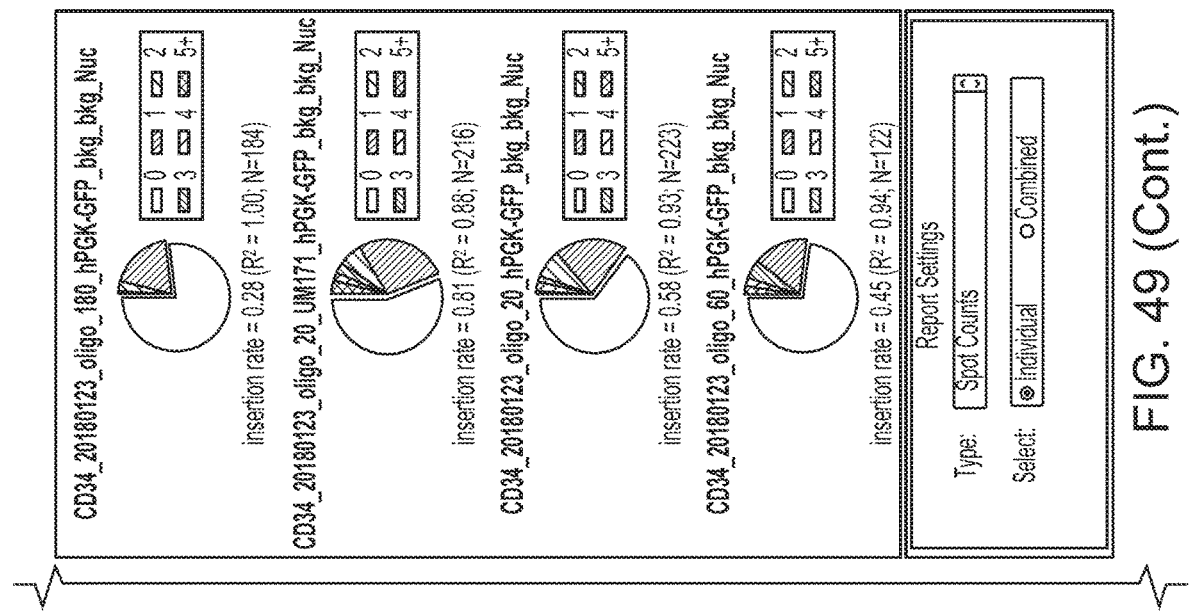

FIG. 49 shows an example quality control browser panel where images can be analyzed for spots indicating viral insertions.

Figure 50:
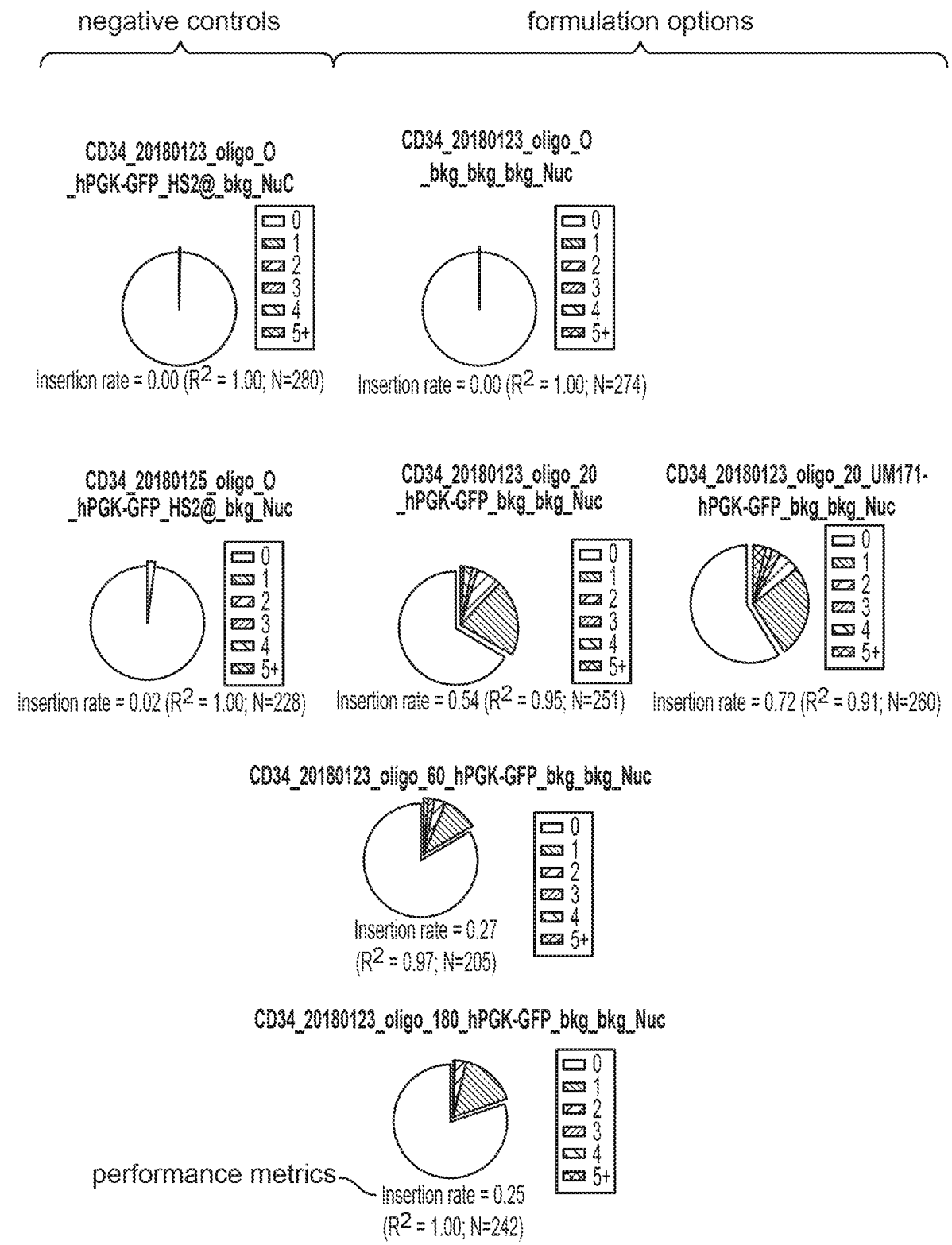
Figure 50:
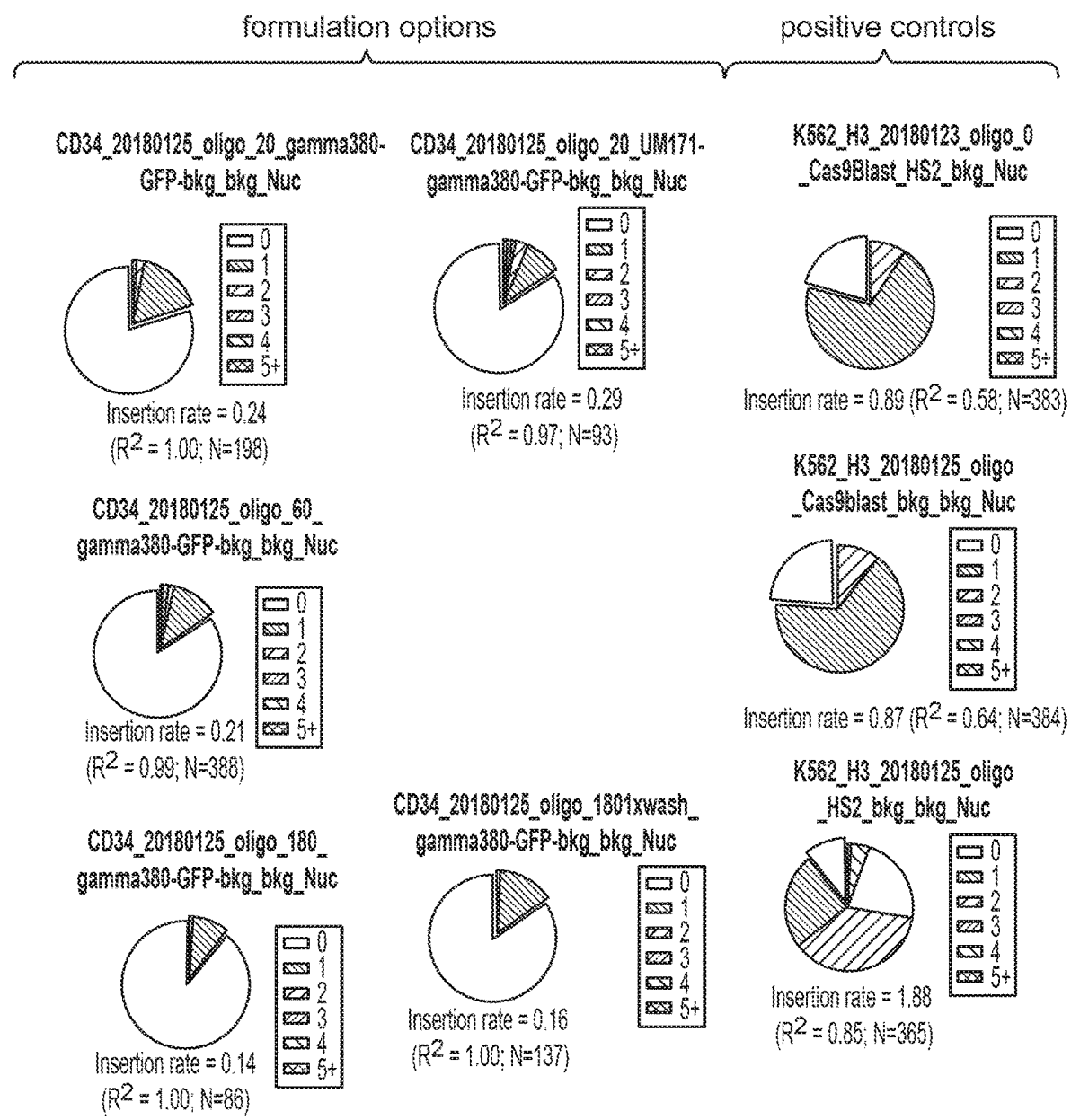

FIG. 50 illustrates an example experiment summary report with performance metrics.

Figure 51:
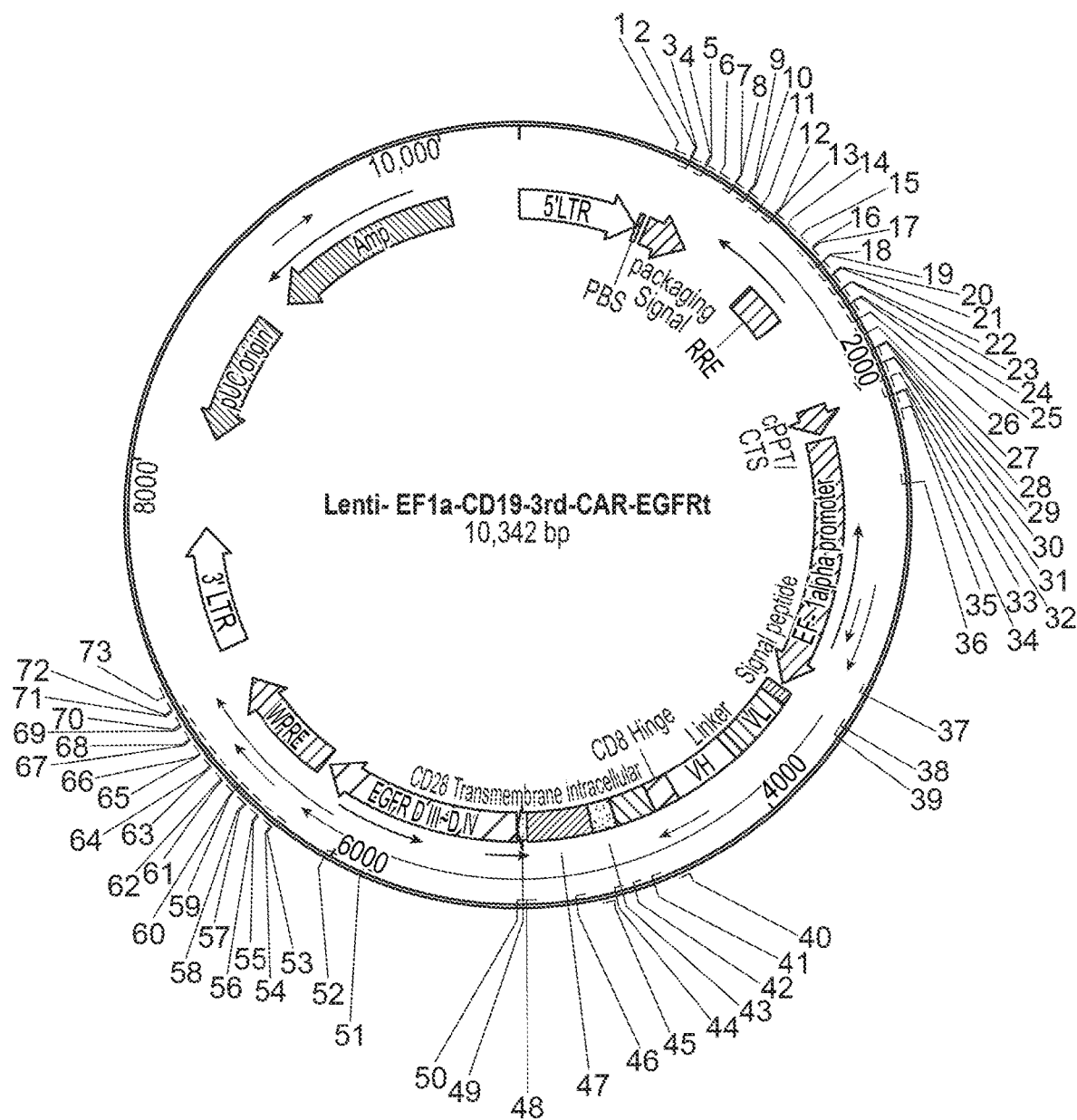

FIG. 51 illustrates a map of the binding position of each of the oligonucleotide Nano-FISH probes disclosed in TABLE 14 to a CAR transfer plasmid.

Figure 52:
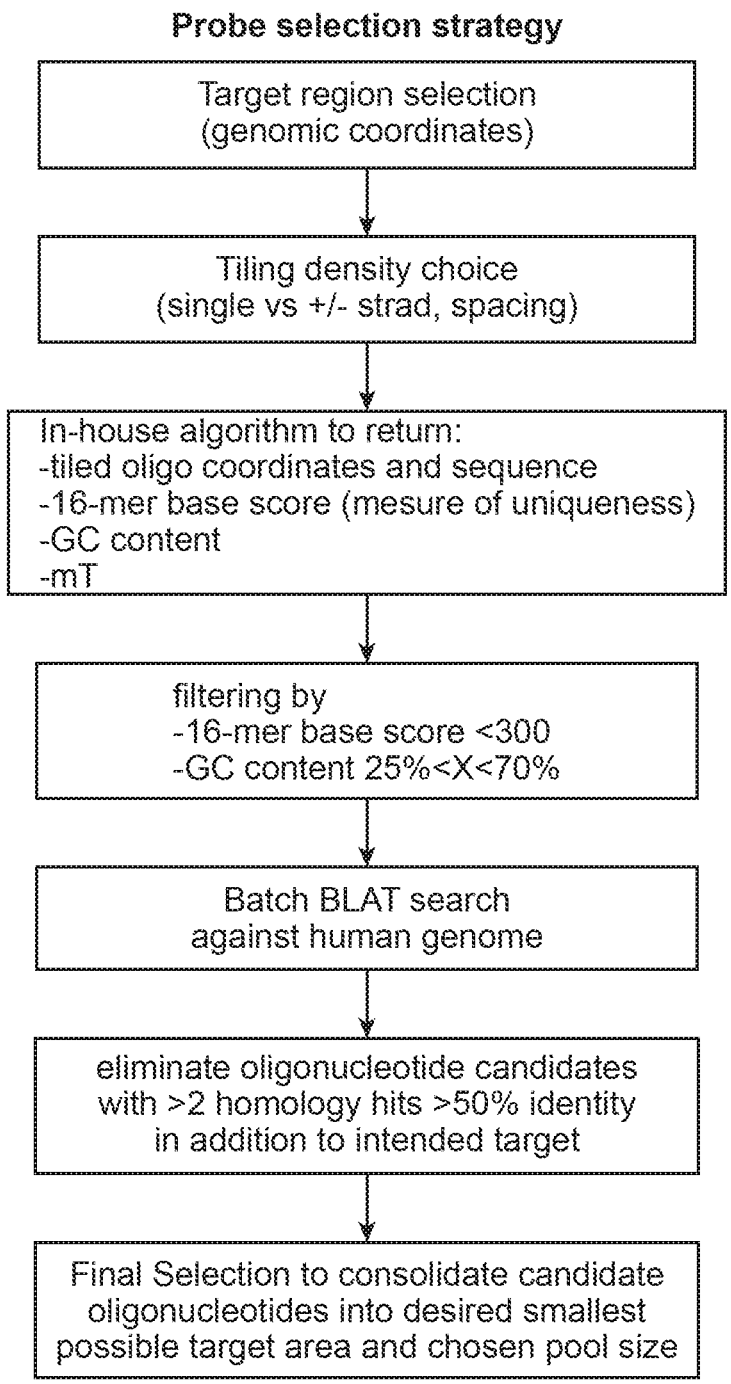

FIG. 52 illustrates the probe selection strategy of the present disclosure.

Figure 53:
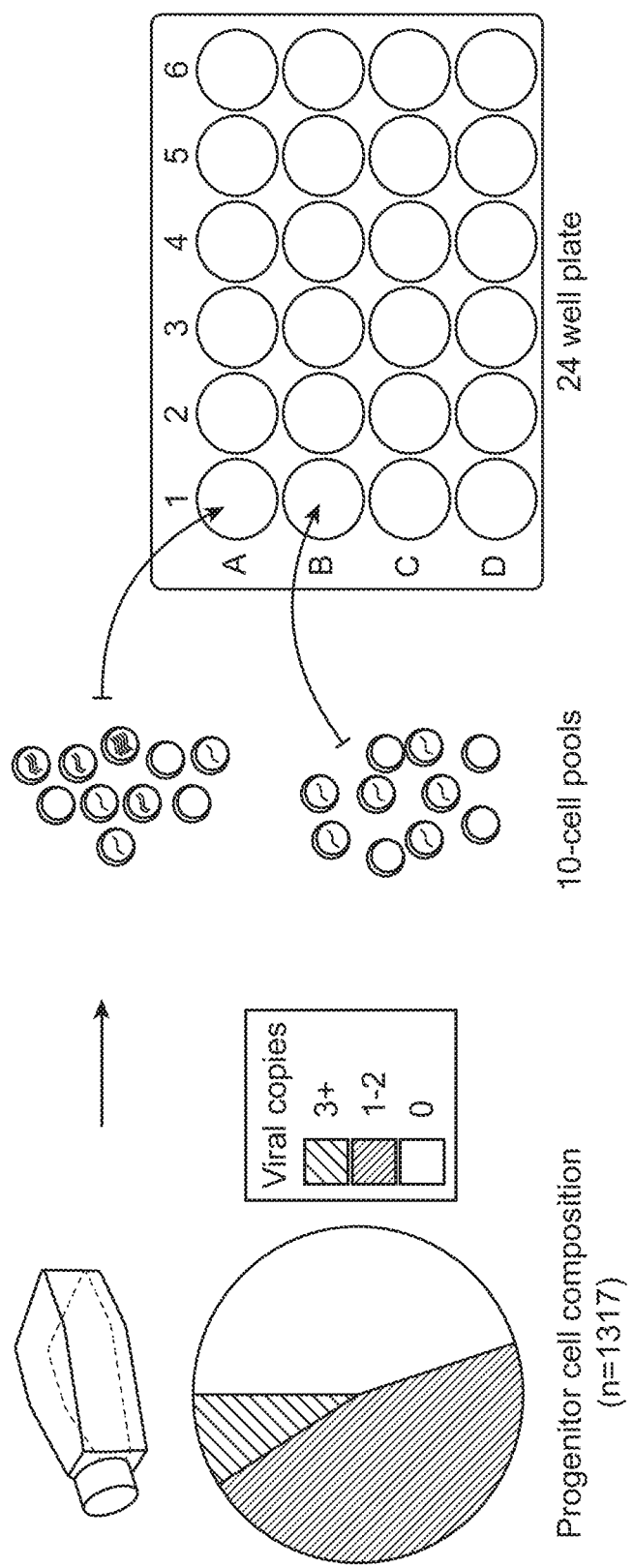

FIG. 53 illustrates sub-sampling a cell population to enrich for a desirable viral copy number. Progenitor cells from cells transduced with a lentivirus were separated into 24 subpools in a 24 well plate.

Figure 54:
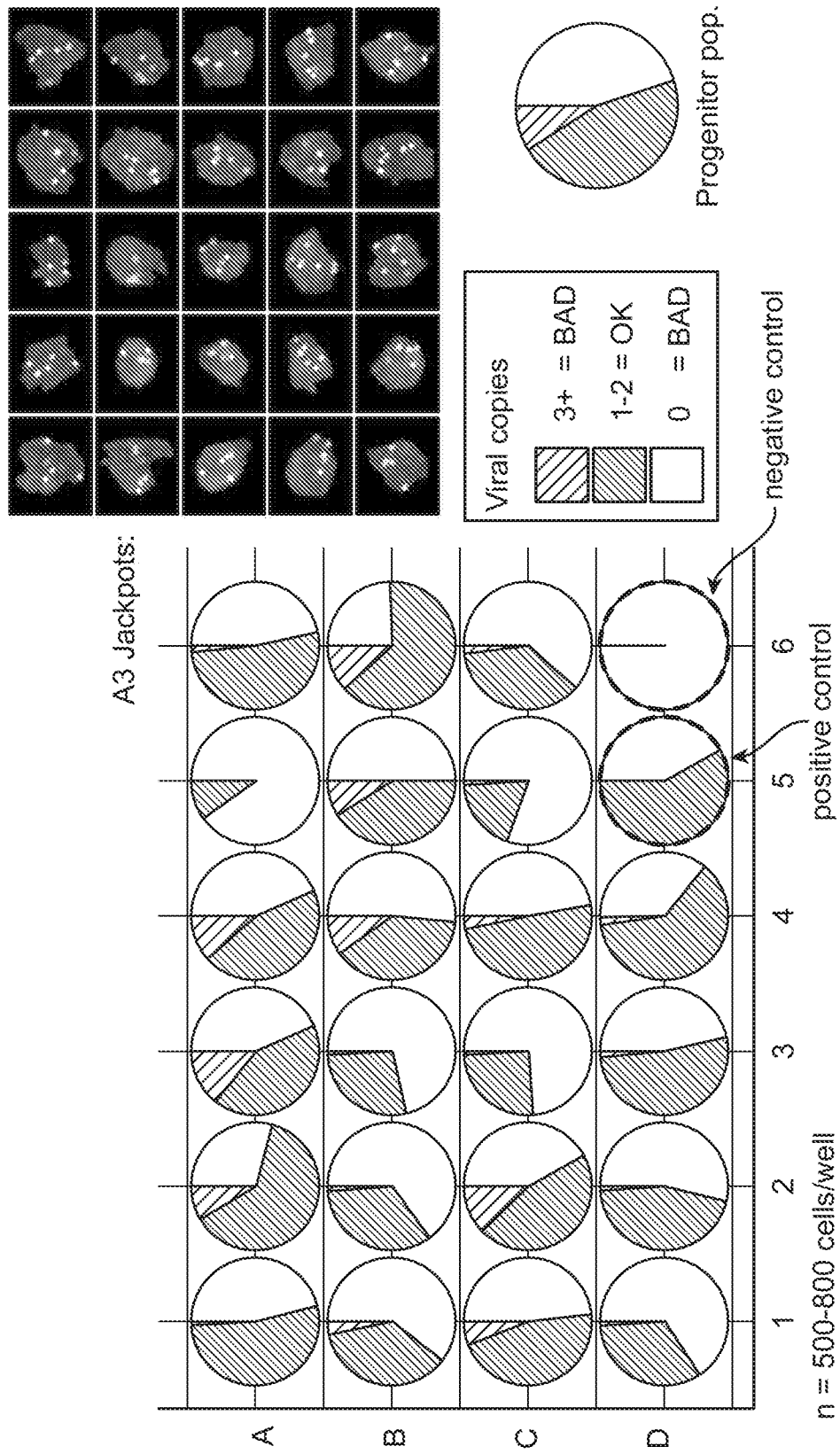

FIG. 54 illustrates that each subpool was expanded to 500-800 cells/well and that cells from each subpool were imaged by the Nano-FISH methods of the present disclosure to characterize the number of viral sequence insertions. FIG. 54 additionally shows images of "Jackpot" cells, which contain 5+ viral insertions.

Figure 55:
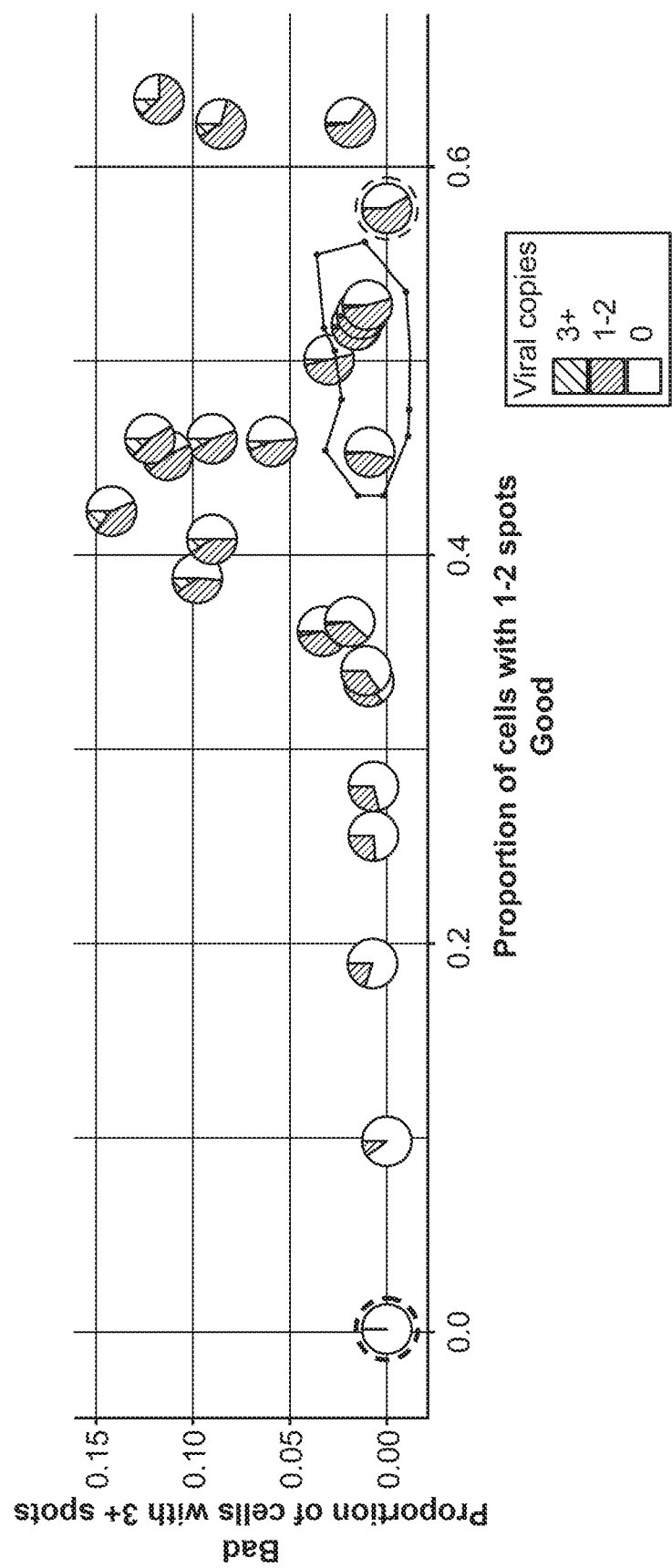

FIG. 55 illustrates stratification of cells from each subpool by "good" or "bad" viral insertion profiles.

Figure 56:
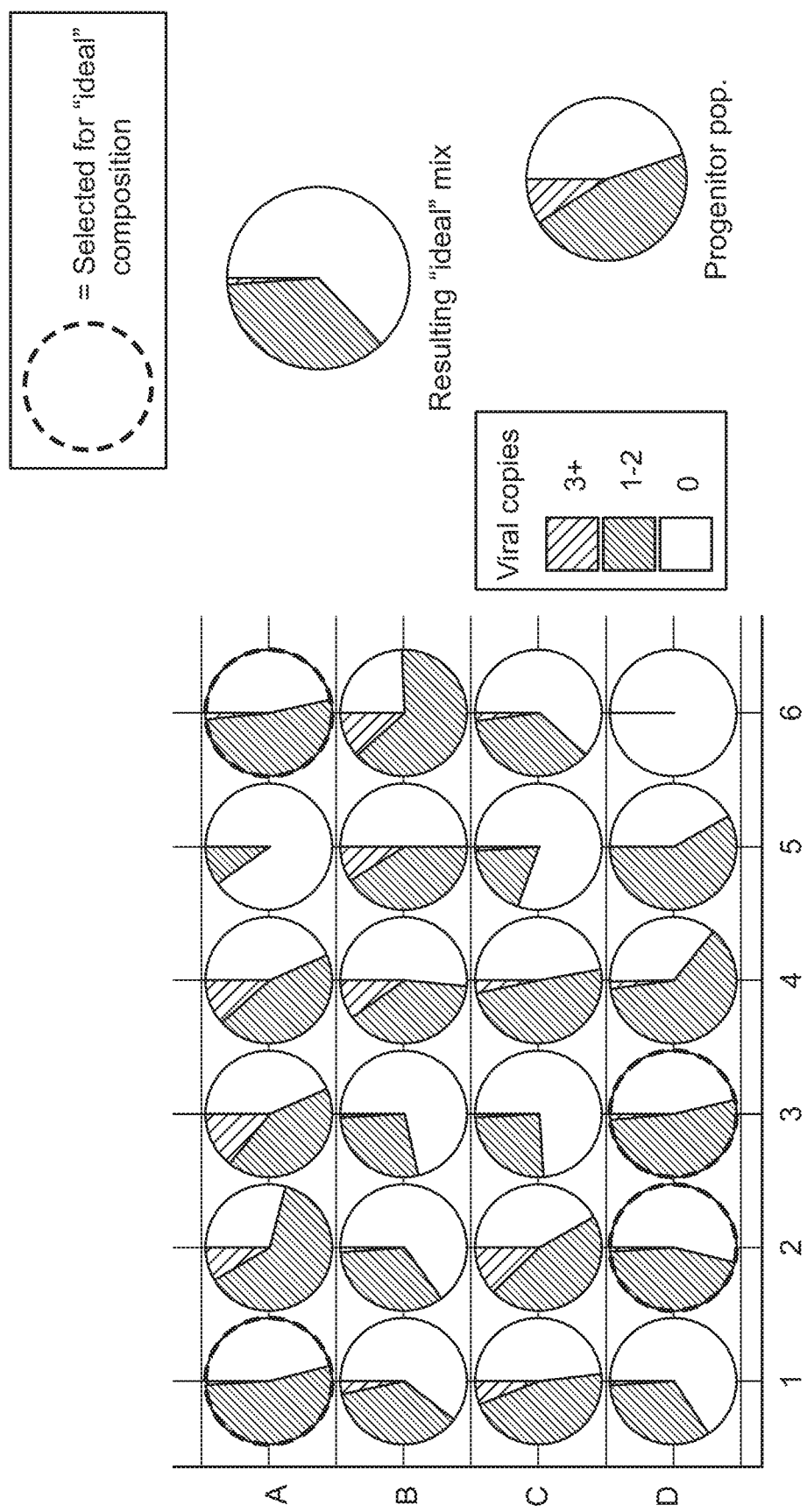

FIG. 56 illustrates selection of subpools deemed to have a good viral insertion profile (mainly 1-2 viral insertions).

FIG. 57 illustrates Nano-FISH detection of viral insertions from a CD19 CAR transfer plasmid in T cells.

Figure 57A:
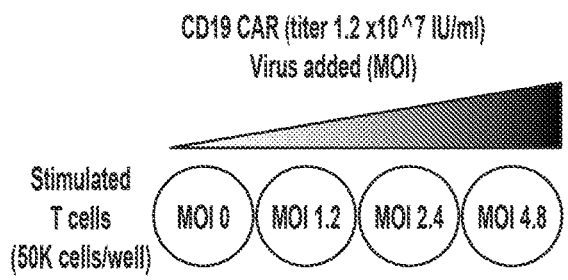

FIG. 57A illustrates a schematic of T cells transduced with the CD19 CAR transfer plasmid at a multiplicity of infection (MOI) of 0, 1.2, 2.4, and 4.8.

Figure 57B:
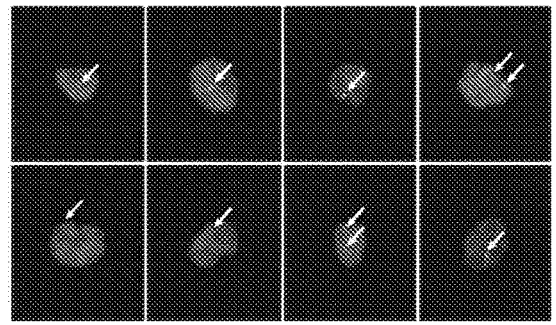

FIG. 57B illustrates fluorescence images of cell nuclei wherein the viral insertions are indicated by arrows and appear as punctate spots.

Figure 57C:
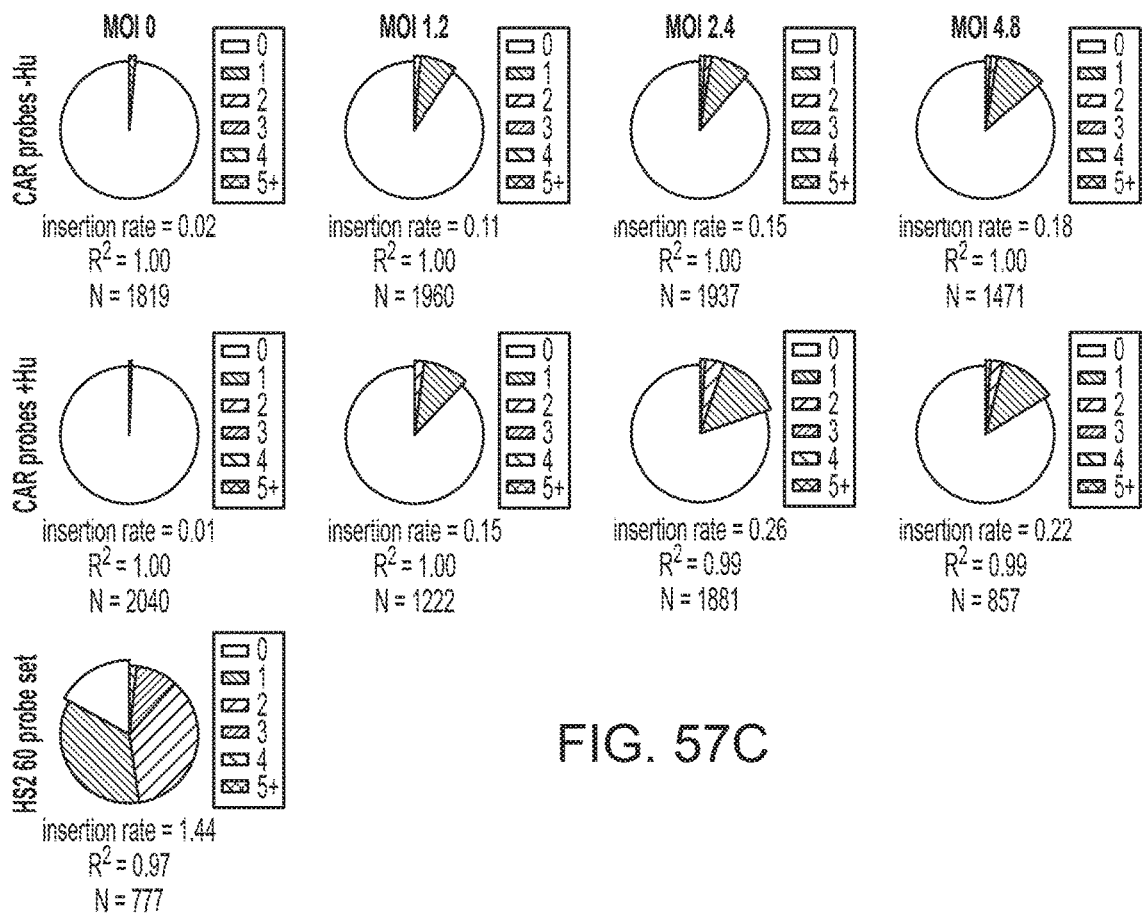

FIG. 57C illustrates the experiment summary report indicating the insertion rate, insertion rate $R^2$, and the sample size.

FIG. 58 illustrates Nano-FISH detection of viral insertions from a hPGK-EGFP-C1 vector and a gamma-Globin380-eGFP-C1 vector.

Figure 58A:
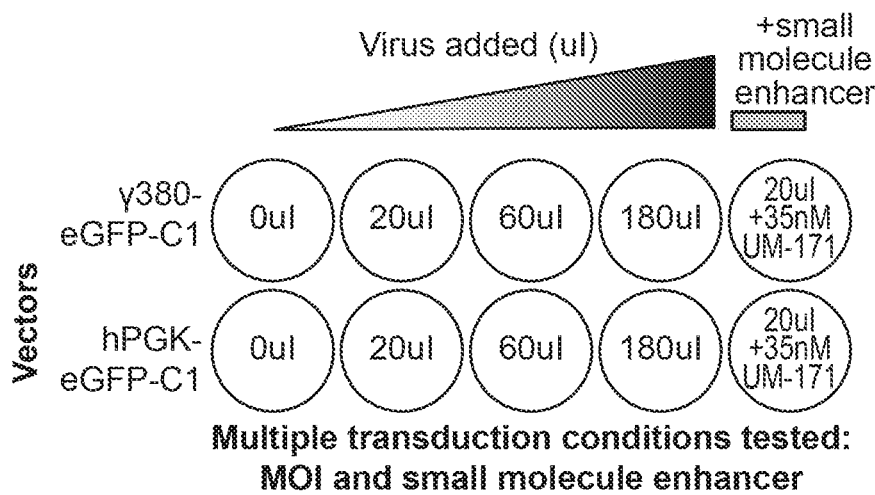

FIG. 58A illustrates a schematic of CD34+ cells transduced with the hPGK-EGFP-C1 vector and a gamma-Globin380-eGFP-C1 vector with 0 μl, 20 μl, 60 μl, or 180 μl of virus. Samples also included cells transduced with 20 μl of virus with 35 nM of UM171 (a small molecule to stimulate replication of HSCs).

Figure 58B:
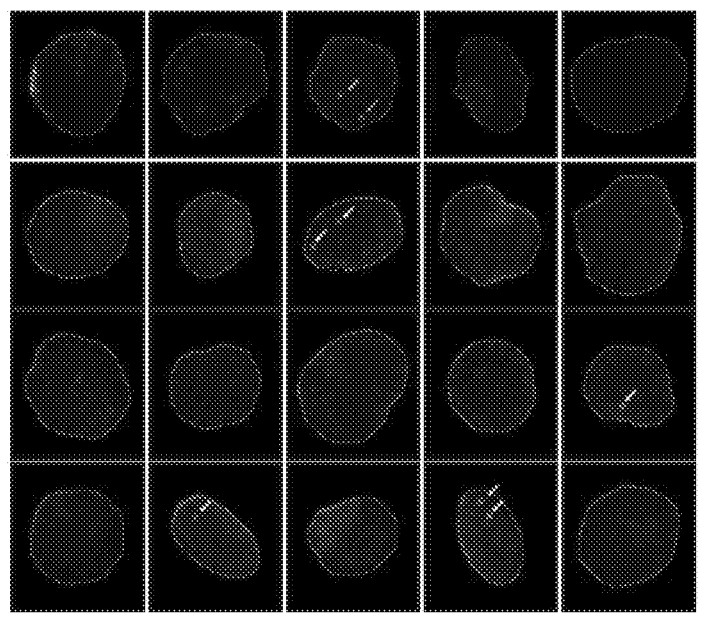

FIG. 58B illustrates fluorescence images of cell nuclei wherein the viral insertions are indicated by arrows and appear as punctate spots.

Figure 58C:
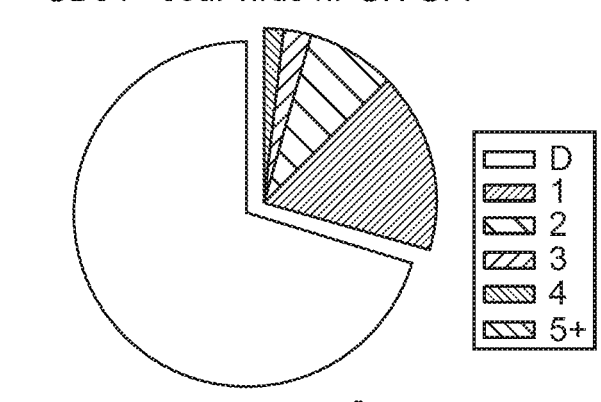

FIG. 58C illustrates the experiment summary report indicating the insertion rate.

FIG. 59 illustrates Nano-FISH detection of viral insertions in CD34+ cells. FIG. 59A illustrates a sample of CD34+ cells taken from a well of a 24-well plate after transduction with gammaGlobin380-eGFP-C1 vector at a multiplicity of infection (MOI) of 35 using retronectin and protamine sulfate. FIG. 59B illustrates the number of viral insertions per nucleus of cells from the sample in FIG. 59A as detected by probes to the lentivirus vector backbone and to eGFP using Nano-FISH. FIG. 59C shows fluorescent images of cell nuclei with 5-10 viral insertions per cell from the sample in FIG. 59A. Each circle/punctum indicates a viral insertion.

FIG. 60 illustrates Nano-FISH detection of viral insertions in T cells. FIG. 60A illustrates a sample of T cells taken from a well of a 24-well plate after CD19 CAR lentivirus vector transduction at a multiplicity of infection (MOI) of 10 using retronectin and protamine sulfate. FIG. 60B illustrates the number of viral insertions per nucleus of cells from the sample in FIG. 60A as detected by probes to the lentivirus vector backbone and to select regions of the CD19 CAR using Nano-FISH. FIG. 60C shows fluorescent images of cell nuclei with 0-5+ viral insertions per cell from the sample in FIG. 60A. Each circle/punctum indicates a viral insertion.

Figure 61A:
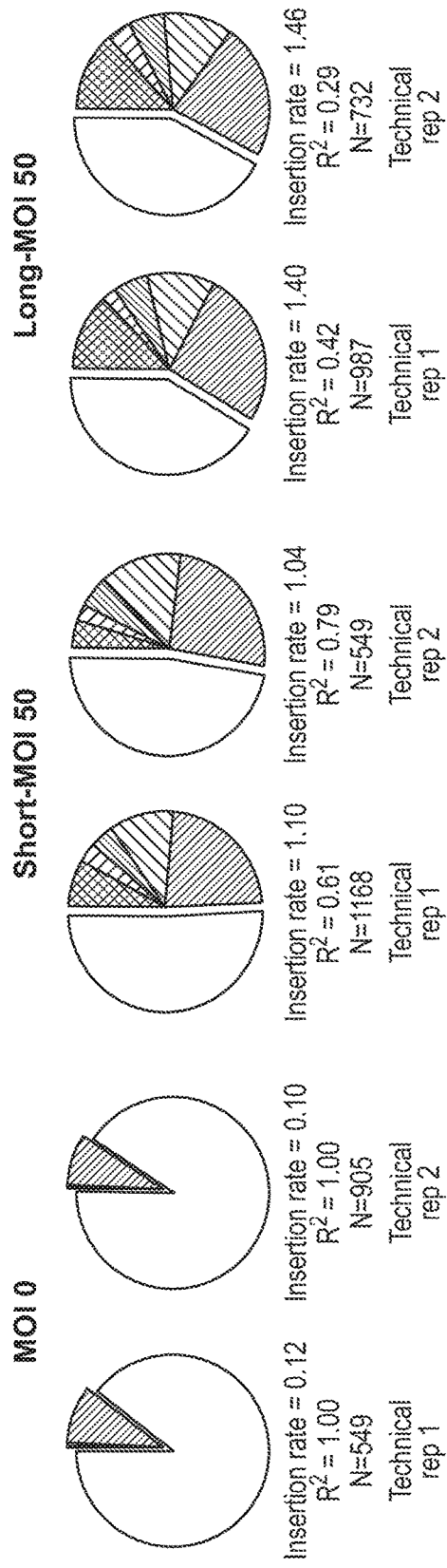
Figure 61B:
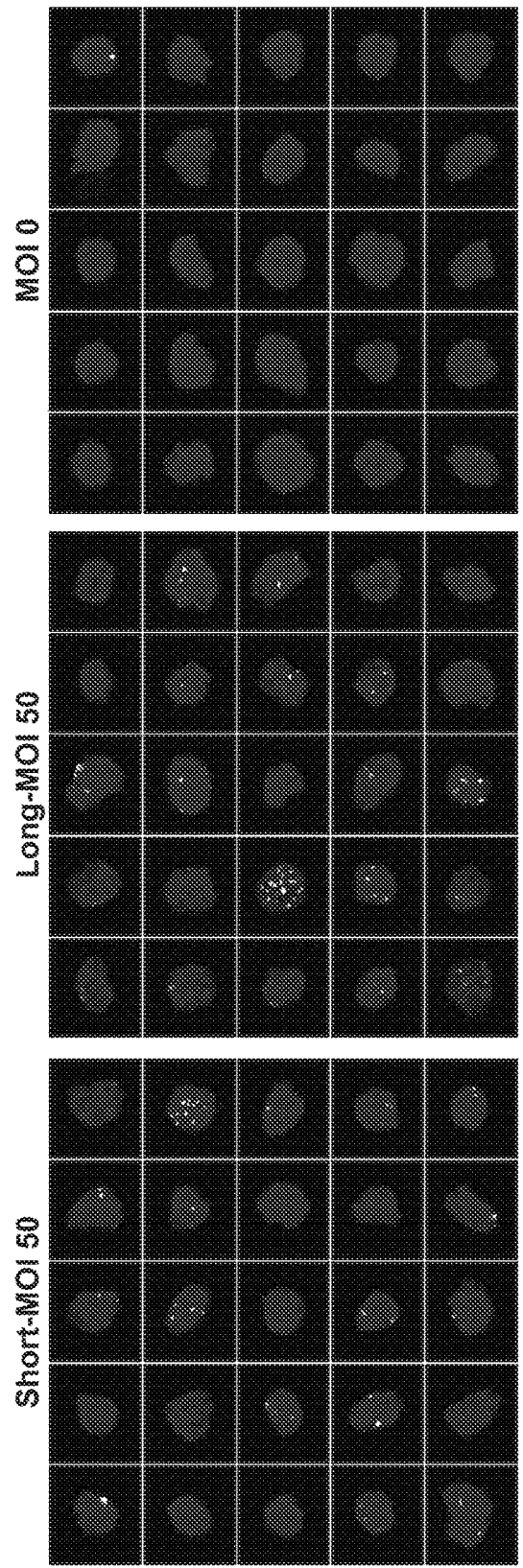

FIG. 61 shows analysis of viral insertions in T cell nuclei using Nano-FISH. FIG. 61A shows fluorescent images of T cell nuclei after hPGK-eGFP-C1 vector transduction of T cells at a multiplicity of infection (MOI) of 10. A pink punctum indicates a viral insertion as detected by Nano-FISH. FIG. 61B illustrates the simultaneous detection of viral insertions and eGFP expression in T cell nuclei after hPGK-eGFP-C1 vector transduction of T cells at a MOI of 10 using retronectin and protamine sulfate. The viral insertions were detected using probes to the lentivirus backbone and to eGFP and are shown as pink puncta. The eGFP expression was detected using a rabbit anti-GFP primary antibody and a secondary anti-rabbit antibody labeled with Alexa-488 dye.

Figure 62A:
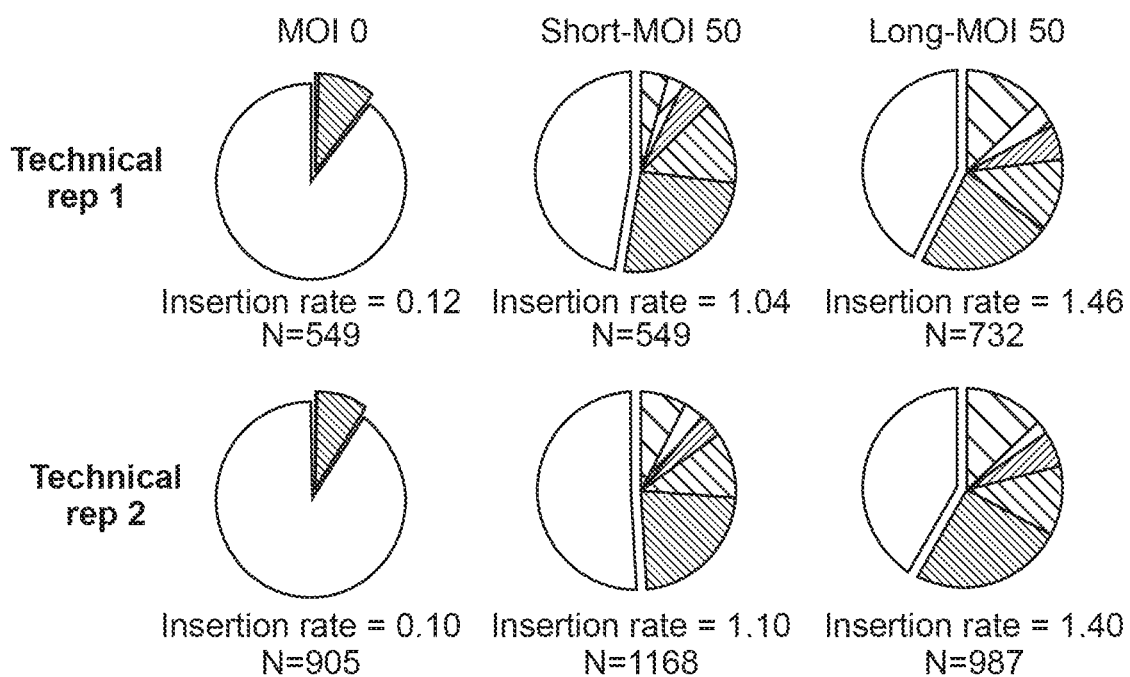
Figure 62B:
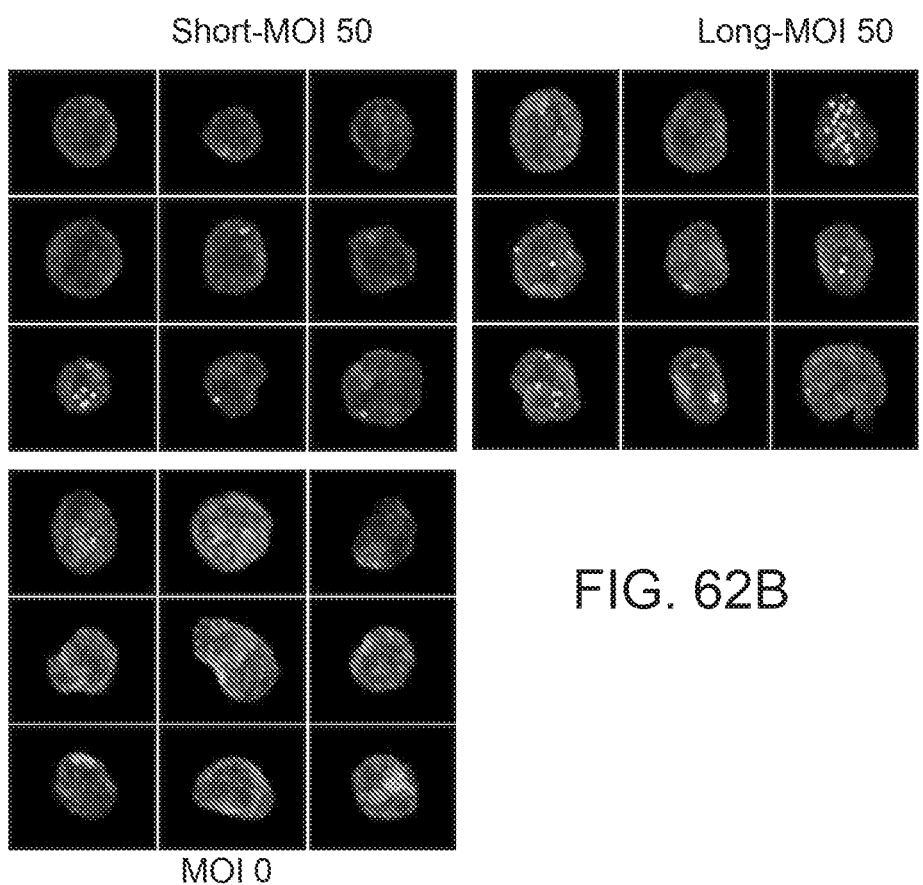

FIG. 62 shows the result of different exposure times to cytokines prior to transduction. FIG. 62A shows the insertion rates for MOIs of 0, 25 (short exposure (24 hrs)), and 25 (long exposure (48 hrs)). FIG. 62B shows 25 randomly-selected nuclei from MOI 50 short-exposure (24 hrs, left) to cytokines, long exposure (48 hrs, middle) to cytokines, and MOI 0 (right).

FIG. 63 shows a representative set of four nuclei for each probe set tested in the K562 with a single CAR insertion (K562 single-insert clone), and a wild type negative control (K562 wild-type). The nuclei were DAPI stained and are shown in blue, and the Nano-FISH signal is shown in yellow. The three oligo probe sets (FIG. 63A-FIG. 63F, top three rows) showed clear, mostly singular spots and low background signal, whereas the nick-translated probes (FIG. 63G-FIG. 63J, bottom two rows) showed relatively high background signal, even in the negative control cells (FIG. 63, FIG. 63J).

FIG. 64 shows a representative set of nine nuclei for each probe set tested in the K562 with a single CAR insertion (K562 single-insert clone), and a wild type negative control (K562 wild-type). The nuclei are DAPI stained and shown in blue, and the Nano-FISH signal is shown in yellow. The oligo probe sets (FIG. 64A-FIG. 64B, top row) showed clearly delineated, mostly singular spots and low background signal, whereas the nick-translated probes (FIG. 64C-FIG. 64F, middle and bottom row) showed relatively high background signal, even in the negative control cells.

Figure 65:
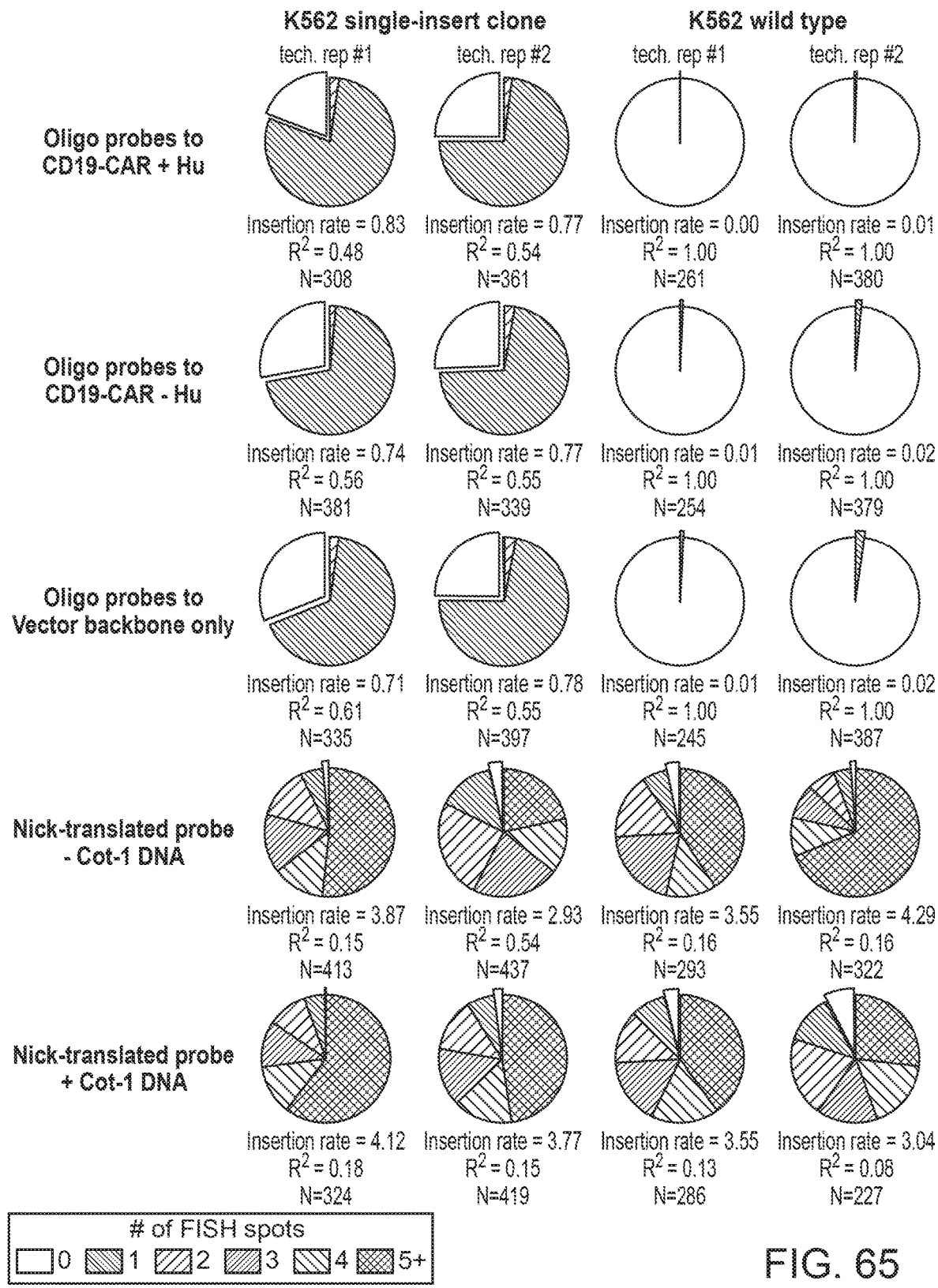

FIG. 65 shows diagrams indicating the number of FISH spots per cell. FISH spots were automatically detected, and then thresholded based on visual inspection (magnitude 8 for Cy5 and magnitude 18 for Cy3 channels). The oligo probes (specific to CD19 CAR+Hu, CD19 CAR—Hu, and the vector backbone only) clearly distinguished single-insert cells from the negative, wild type control, whereas the positive and negative cells were indistinguishable with nick-translated probes. These results demonstrate the significantly higher signal accuracy for Nano-FISH compared to conventional nick translated probes.

FIG. 66 shows the resulting distribution of viral integrations observed in stimulated CD4+ T cells and CD34+ cells. Primary stimulated CD4+ T cells and CD34+ cells were transduced with Vesicular Stomatitis Virus Glycoprotein (VSVG)-enveloped lentiviral vectors at an MOI of 10. Post-transduction cells were harvested and profiled for lentiviral insertion with a vector only probe set of 60 backbone probes, more than 30 of those probes bind to the target vector backbone sequences used in the transductions. FIG. 66A shows the resulting distribution of viral integrations observed in T cells. The transduction efficacy of viral insertions followed a Poisson distribution with very few cells occurring with more than 5 integrations (0.3%). FIG. 66B shows randomly selected T cell nuclei with 5 or more clearly delineated spots per cell (0.3%), and T cell nuclei from the MOI 0 negative control experiment showing no spots per cell and low background signal. FIG. 66C shows the resulting distribution of viral integrations in CD34+ where a large number of cell with greater than five viral integrations were observed, and an unexpectedly large fraction of cells had zero integrations. FIG. 66D shows randomly selected CD34+ cell nuclei with 5 spots or more per cell (12%), and CD34+ cell nuclei from the MOI 0 negative control experiment showing no spots per cell and low background signal.

DETAILED DESCRIPTION

Cellular activation and extinction patterns can encode information on cell identity, maturation state, cellular memory, and disease state. Tissues are composites of cells which can have one or more morphologically distinct cell types. In some instances, all of the cells in a tissue are processed simultaneously, yielding compounded information with limited sensitivity for cellular activities and/or rare cell types. Alternative approaches employ disaggregation and sorting of tissue components but in the process can destroy cellular architecture and potentially introduce artifacts such as biological stressors and perturbations.

Figure 1:
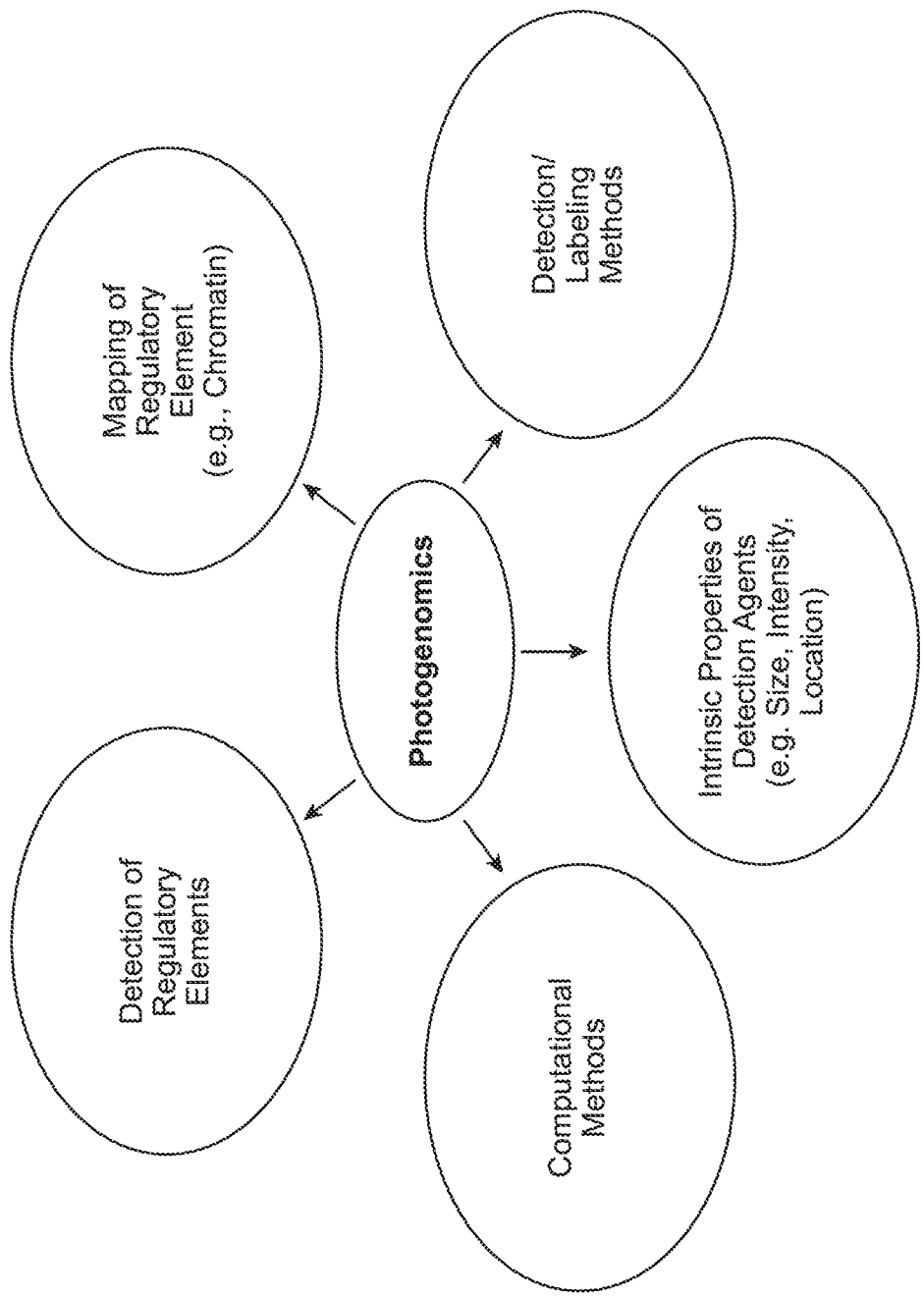
FIG. 1 represents a conceptual illustration of methods described herein.
Figure 2:
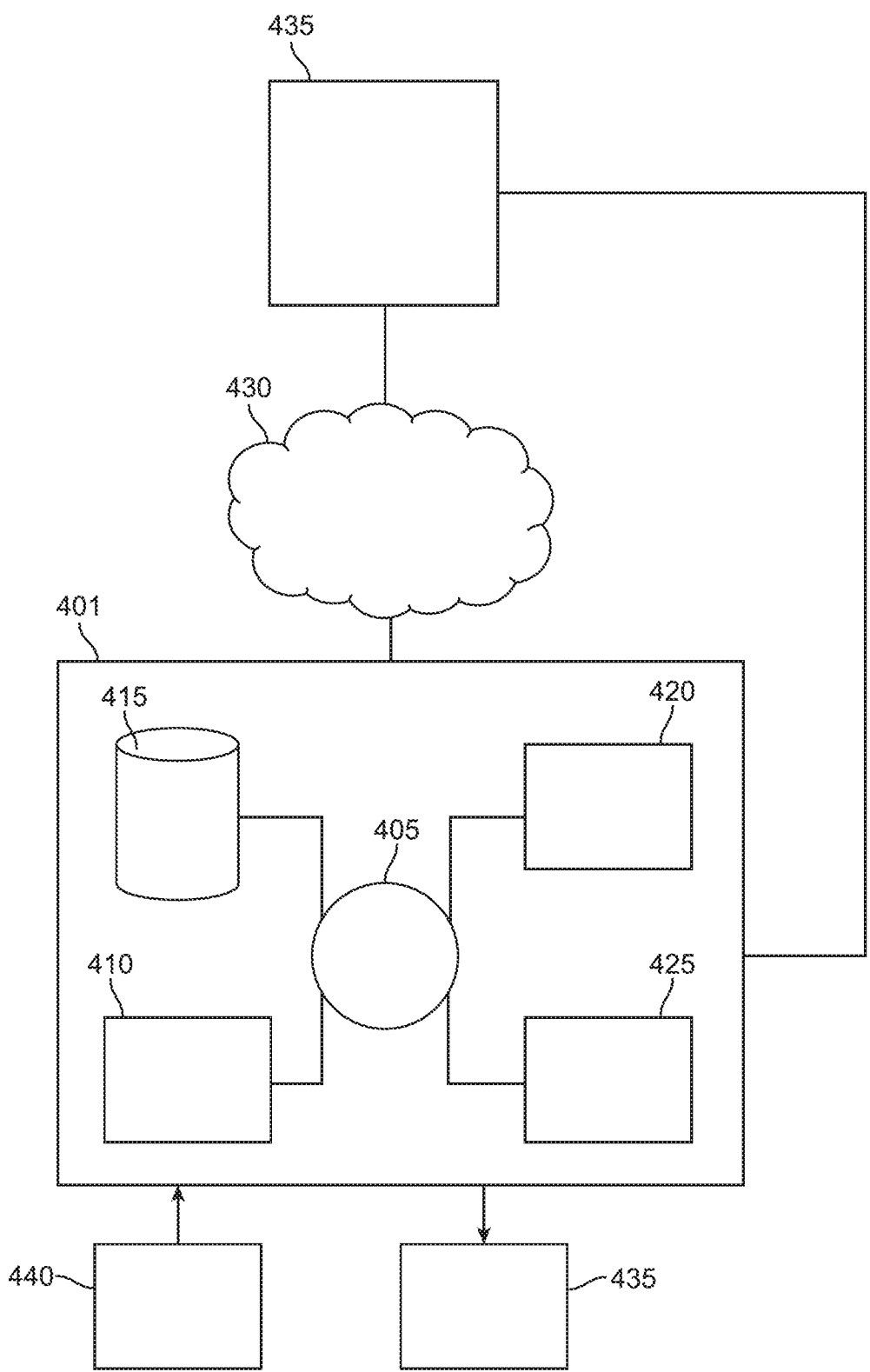
FIG. 2 illustrates a conceptual schematic of an exemplary computer server to be used for processing a method described herein.

Described herein are methods of detecting a cellular regulatory element in situ utilizing various microscopy (e.g., super-resolution microscopy) techniques to determine the presence, absence, and/or activity of a regulatory element. Also described herein are methods of detecting different types of regulatory elements simultaneously utilizing a heterogeneous set of detection agents, and translating the molecular information from the different types of regulatory elements to determine the activity state of a cell. The activity state of a cell may correlate to a localization, expression level, and/or interaction state of a regulatory element. One or more of the methods described herein may further interpolate 2-dimensional images to generate β-dimensional maps which enable detection of localization, interaction states, and activity of one or more regulatory elements. Intrinsic properties such as size, intensity, and location of a detection agent further may enable detection of a regulatory element. Described herein are methods of determining the localization of a regulatory element and measuring the activity of a regulatory element. The methods provided herein may avoid the introduction of artifacts such as biological stressors and perturbations or destroys cellular architecture. Exemplary properties associated with the methods described herein are illustrated in FIG. 1.

One or more methods described herein may detect different types of regulatory elements, distinguish between different types of regulatory elements, and/or generate a map of a regulatory element (e.g., chromatin). For example, a regulatory element may be labeled by one or more different types of detection agents. The one or more different types of detection agents may include DNA detection agents, RNA detection agents, protein detection agents, or combinations thereof. The detection agent may comprise a probe portion, which may interact (e.g., hybridize) to a target site within the regulatory element, and optionally comprise a detectable moiety. The detectable moiety may include a fluorophore, such as a fluorescent dye or a quantum dot. The detection agent may be an unlabeled probe which can be further conjugated to an additional labeled probe. Upon labeling, the regulatory element may be detected by stochastic or deterministic super-resolution microscopy method. The stochastic super-resolution microscopy method may be a synthetic aperture optics (SAO) method. The SAO method may generate a detection profile, which can encompass fluorescent signal intensity, size, shape, or localization of the detection agent. Based on the detection profile, the activity state, the localization, expression level, and/or interaction state of the regulatory element may be determined. A map based on the detection profile of the regulatory element may also be generated, and may be correlated to cell type identification (e.g., cancerous cell identification). The regulatory element may be further analyzed in the presence of an exogenous agent or condition, such as a small molecule fragment or a drug, or under an environment such as a change in temperature, pH, nutrient, or a combination thereof. The perturbation of the activity state of the regulatory element in the presence of the exogenous agent or condition may be measured. A report may further be generated and provided to a user, such as a laboratory clinician or health care provider.

The systems and methods disclosed herein also relate to a novel nanoscale fluorescence in situ hybridization methodology (hereinafter referred to as "Nano-FISH") to reliably label and detect localized small (less than 12 kb in size) DNA segments in cells. In some cases, Nano-FISH can utilize defined pools or sets of synthetic fluorescent dye-labeled oligonucleotides (probe pools or probe sets) to reliably detect small genomic regions in large numbers of adherent or suspension cells in situ. In some instances, Nano-FISH can be conducted utilizing conventional widefield microscopic imaging. In other embodiments, Nano-FISH can be conducted using imaging techniques (e.g., super-resolution imaging).

In some cases, Nano-FISH can be coupled with an automated image informatics pipeline to enable high-throughput detection and 2D and/or 3D spatial localization of small genomic DNA elements in situ in hundreds of, thousands of, or more individual cells per experiment. In some instances, to facilitate rigorous statistical analyses of the resulting large image data sets, a scalable image analysis software suite can reliably identify and quantitatively annotate labeled loci on a single-cell basis.

In some cases, Nano-FISH can allow detection of the precise localization of specific regulatory genomic elements in 3D nuclear space, the identification of small-scale structural genomic variations (such as sequence gains or losses), the quantitation of spatial interactions between regulatory elements and their putative target gene(s), or the detection of genomic conformational changes that induce stimulus-dependent gene expression. In some instances, Nano-FISH can allow the visualization of the precise localization of a target nucleic acid sequence. The target nucleic acid sequence can be an endogenous nucleic acid sequence, a nucleic acid sequence derived from an exogenous source, or a combination thereof. An exogenous nucleic acid sequence can be introduced into a first cell and can be further detected in progeny of the first cell. An exogenous target nucleic acid sequence can be introduced to a cell through electroporation, lipofection, transfection, microinjection, viral transduction, or a gene gun. Non-limiting examples of vector systems that can be used to introduce a target nucleic acid sequence into a cell may include viral vector, episomal vector, naked RNA (recombinant or natural), naked DNA (recombinant or natural), bacterial artificial chromosome (BAC), and RNA/DNA hybrid systems used separately or in combination. Vector systems can be used without additional reagents meant to aid in the incorporation and/or expression of desired mutations. A non-limiting list of reagents meant to aid in the incorporation and/or expression of desired mutations can include Lipofectamine, FuGENE, FuGENE HD, calcium phosphate, HeLaMONSTER, Xtreme Gene. An endogenous nucleic acid sequence can be a gene sequence or fragment thereof. An endogenous nucleic acid sequence can be a sequence in a chromosome. An endogenous nucleic acid sequence can be a nucleic acid sequence resulting from somatic chromosomal rearrangement, such as the nucleic acid sequence of a B cell receptor, T cell receptor, or fragment thereof. In some instances, Nano-FISH can allow the detection of the precise localization of exogenous nucleic acids inserted or integrated into a genome. In some embodiments, Nano-FISH can allow the detection of the precise localization of exogenous DNA inserted into a genome, as may be inserted by a genetic engineering technique or by viral infection or transduction. In some instances, Nano-FISH can allow the detection of an episomal nucleic acid sequence.

The systems and methods described herein can be useful in detecting or determining the presence, absence, identity, or quantity of a target nucleic acid sequence in a sample. In particular, the methods, compositions, and systems described herein can be used to efficiently detect, to identify, and to quantify a target nucleic acid sequence that is a short nucleic acid sequences. In some cases, a short nucleic acid sequence that can be detected or quantified using the disclosures of the present application may be from 1 kilobase (kb) in length to about 12 kb in length. A short nucleic acid sequence can be less than 1 kb. A short nucleic acid sequence can be less than 12 kb, less than 11 kb, less than 10 kb, less than 9 kb, less than 8 kb, less than 7 kb, less than 6 kb, less than 5 kb, less than 4 kb, less than 3 kb, less than 2.5 kb, less than 2 kb, less than 1.5 kb, less than 1.2 kb, less than 0.8 kb, or less than 0.5 kb. A short nucleic acid sequence can be from 240 nucleotides to 1 kb in length. A short nucleic acid sequence can be from 360 nucleotides to 1 kb in length. A short nucleic acid sequence can be from 240 nucleotides to 2 kb, 15 nucleotides to 2.5 kb, 240 nucleotides to 3 kb, 15 nucleotides to 4 kb, 240 nucleotides to 5 kb, 15 nucleotides to 6 kb, 240 nucleotides to 7 kb, 240 nucleotides to 8 kb, 240 nucleotides to 9 kb, 15 nucleotides to 10 kb, 240 nucleotides to 11 kb, or 240 nucleotides to 12 kb in length. A short nucleic acid sequence can be from 360 nucleotides to 2 kb, 360 nucleotides to 2.5 kb, 360 nucleotides to 3 kb, 360 nucleotides to 4 kb, 360 nucleotides to 5 kb, 360 nucleotides to 6 kb, 360 nucleotides to 7 kb, 360 nucleotides to 8 kb, 360 nucleotides to 9 kb, 360 nucleotides to 10 kb, 360 nucleotides to 11 kb, or 360 nucleotides to 12 kb in length.

Methods for the detection, identification, and/or quantification of a short nucleic acid sequence of a sample can comprise contacting the short nucleic acid sequence with a probe comprising a detectable label and determining the presence, absence, or quantity of probes bound to the target nucleic acid sequence. Determination of the sequence position of the short nucleic acid sequence relative to other nucleotides or another short nucleic acid sequence (for instance, using a second probe capable of binding to a second target sequence of the nucleic acid) can be a step in the methods described herein. The methods described herein can also comprise determining the spatial position of the short nucleic acid sequence. For example, Nano-FISH can be used to measure the normalized inter-spot distance between a first short nucleic acid sequence encoding an enhancer or portion thereof and a second nucleic acid encoding a promoter of a gene or portion thereof, which can be used to study changes in genome conformation that may be associated with gene function.

The methods described herein can comprise comparing the presence, absence, spatial position, sequence position, or quantity of a short nucleic acid sequence of a sample to a reference value. A non-limiting example of quantifying detection of a short nucleic acid sequence in a cell can comprise quantifying the number of copies of a nucleic acid sequence that has been incorporated into a modified cell (for example, a cell modified by the introduction of a nucleic acid sequence into the cell by genetic editing), which can be used as quality control for modified cells produced by cell engineering strategies.

The degree of precision and accuracy in nucleic acid sequence detection, identification, and quantification made possible by the methods, compositions, and systems of the present disclosure can enable the detection of viral nucleic acid sequences, which commonly range from about 1 kb in length to about 10 kb in length. For example, viral genomes of the lentivirus family range from about 7.4 kb in length to about 9.8 kb in length, viral genomes of the papovavirus family (which includes papillomavirus) range from about 5.1 kb in length to about 7.8 kb in length, viral genomes of the parvovirus family ranges from about 4 kb in length to about 6 kb in length, and viral genomes of the circovirus family ranges from about 1.7 kb in length to about 2.3 kb in length.

Also described herein are methods, compositions, and systems useful in characterizing and/or quantifying the presence, absence, position, or identity of a target nucleic acid sequence in a cell or sample derived therefrom relative to a reference nucleic acid sequence in the same cell or sample or relative to a control cell or sample. For example, improvements to the efficiency of detection and to a detection threshold, as described herein, can allow for the detection and characterization of short nucleic acid sequences (for instance, non-repeating nucleic acid sequence insertions) during analysis or validation of cell samples or cell lines.

Additionally, described herein, are methods, compositions, and systems for correlating protein expression with target nucleic acid sequence detection. For example, a target nucleic acid sequence can be associated with the expression of a target protein. Using Nano-FISH, the presence, absence, or quantity of the target nucleic acid sequence can be detected, and a detectable label may be used to detect a target protein expression, which therefore can allow for the correlation between the presence, absence, or quantity of the target nucleic acid sequence and the expression of the target protein.

The Nano-FISH methods as described herein can be used as a diagnostic for the detection, identification, and/or quantification of a short nucleic acid sequence of a sample. For example, Nano-FISH can be used as a diagnostic for HIV by detecting HIV nucleic acid sequences in a sample. The Nano-FISH methods as described herein can be used with therapeutics by detecting, identifying, and/or quantifying a short nucleic acid sequence of a sample. For example, Nano-FISH can be used with therapeutics in which a short nucleic acid sequence is integrated into a cell's DNA (e.g., chimeric antigen receptor T cell therapeutics) to determine, detect, identify, and/or quantify the short nucleic acid sequence integration. This can be important for any type of viral-mediated (e.g., lentiviral-mediated) transgene integration because these integrations can be heterogeneous (i.e., some cells do not get infected, others are infected multiple times), and integrations occur randomly in the genome (i.e., inactive sequences, or active genes). In contrast to Nano-FISH, existing methods to measure transgene integration and expression suffer from limitations including lacking single-cell resolution (qPCR), providing data about protein products without DNA information (flow cell sorting), or being laborious (single-cell cloning).

Furthermore, the Nano-FISH compositions and methods as described herein can be used to determine the biodistribution of a target nucleic acid sequence (e.g., an exogenous nucleic acid sequence) in a cell population. Biodistribution, as used herein, can also be referred to as a population distribution or a cellular distribution. Specifically, biodistribution, population distribution, and cellular distribution can all describe determinating of the number of nucleic acid insertions on a per cell basis in a plurality of cells. In other words, the Nano-FISH compositions and methods of the present disclosure can be used to determine which cells of a given cell population comprise the target nucleic acid sequence and which cells do not. Using the visualization methods as described herein, the biodistribution of the target nucleic acid sequence (e.g., a viral insertion) in a cell population can be visualized and quantitatively assessed. In some embodiments, this method can be used to determine the transduction efficacy of a vector (e.g., a viral vector), thereby quantitating the distribution of nucleic acid insertions from a vector (e.g., a viral vector) in a population of cells on a per cell basis. The transduction efficacy of a vector may be limited by the expression of a cell surface receptor that an envelope protein of the vector binds to in order to facilitate transduction. Thus, the compositions and methods described herein can be used to determine the cells that express the receptor (i.e., target nucleic acid sequence is detected within the cell) and the cells that do not express the receptor (i.e., target nucleic acid sequence is not detected within the cell). Thus, the compositions and methods as described herein can be further used to test for novel envelope proteins that allow for higher transduction efficacy in cells that are currently not very susceptible to infection. For example, the compositions and methods as described herein can be used to screen for envelope proteins that exhibit optimal binding profiles across a cell population to ensure homogeneous transfection with an exogenous nucleic acid sequence (e.g. a CAR gene). Moreover, the compositions and methods as described herein can be used as a quality control tool to assess the efficacy and homogeneity of transfection within a clinically relevant cell population. For example, the clinical management of chimeric antigen receptor (CAR) T cell treatments currently lacks reliable, cost-effective, and easy-to-use quality control tools to assess the number of CAR gene insertions per cell within the engineered CAR T cell population. Thus, the Nano-FISH compositions and methods of the present disclosure can be used to increase the therapeutic efficacy and safety of cell (e.g., CAR T cell) therapies by providing more accurate and efficient methods for determining the presence of a target nucleic acid sequence in a cell or in a cell population.

Additionally, Nano-FISH is a significantly improved and distinct tool from conventional FISH for numerous reasons related to control over design of the probe set, which enable the detection of short nucleic acid sequences at high throughput and at a high signal-to-noise ratio. For example, Nano-FISH shows short nucleic acid sequences as clearly delineated, mostly singular spots with low background signal. On the contrary, conventional probes, i.e., the nick-translated probes, show relatively high background signal even in negative control cells, demonstrating the high probability of non-specific conventional probe binding compared to the Nano-FISH oligonucleotide probes.

In some embodiments, Nano-FISH probe sets of the present disclosure can comprise one or more short oligonucleotide probes designed against a target, which allows for complete control over probe size. For example, using the Nano-FISH methods described herein, one or more oligonucleotide Nano-FISH probes of exact size can be designed against a transfer plasmid backbone. The oligonucleotide Nano-FISH probes of the present disclosure can be from 30 to 60 nucleotides in length, from 30 to 35 nucleotides in length, from 35 to 40 nucleotides in length, from 40 to 45 nucleotides in length, from 45 to 50 nucleotides in length, from 50 to 55 nucleotides in length or from 55 to 60 nucleotides. In certain embodiments, the oligonucleotide Nano-FISH probes of the present disclosure can be 40 nucleotides in length. In contrast, conventional FISH techniques require the use of fosmids (varying in size from 40-50 kilobases), BACs (varying in size from varying in size from 100-250 kilobases), or plasmids (varying in size from 5-10 kilobases), which are conventionally nick translated to incorporate hapten or fluorescently labeled-dUTP (or other nucleotide). The result of nick translating fosmids, BACs, and/or plasmids to obtain conventional FISH probes is the generation of a highly heterogeneous pool of probes of varying sizes. Conventional FISH probes average around 500 nucleotides in length but exhibit a size distribution from 100 bases to anywhere around 1.5 kilobases, which is up to 50 times larger than an oligonucleotide Nano-FISH probe. Alternatively, conventional probes can be generated by means of PCR with the incorporation of labeled nucleotides during the reaction. Thus, in contrast to the oligonucleotide Nano-FISH probes of this disclosure, there is poor control over the resulting probe size of nick translated conventional FISH probes made from fosmids, BACs, or plasmids.

In some embodiments, the Nano-FISH probes of the present disclosure are precisely controlled to introduce an exact number of fluorescent dye molecules per probe. For example, in some embodiments, each oligonucleotide Nano-FISH probe of the present disclosure can have exactly a detectable agent at the 3' end. The detectable agent can be any dye molecule, such as a Quasar Dye (e.g., Q570 and Q670). Oligonucleotide Nano-FISH probes of the present disclosure may be synthesized from the 3' to 5' end, and the fluorophore may be included on the first nucleotide at the 3'end. In some embodiments, an oligonucleotide Nano-FISH probe of the present disclosure can have 2 fluorescent dye molecules. For example, a Nano-FISH oligonucleotide probe of the present disclosure with a size of 55 to 60 nucleotides can have 2 fluorescence dye molecules. In this case, the second dye molecule may be placed on an internal nucleotide or at the 5' end. Additionally, since the oligonucleotide Nano-FISH probes of the present disclosure directly incorporate a fluorophore at the 3'end of each probe, the present disclosure provides a probe set that can be directly labeled and, thus, offers direct labeling and detection of a target nucleotide sequence without any need for signal amplification.

In contrast, because conventional FISH probes can be nick translated to incorporate hapten-dUTPs or other labeled nucleotides for subsequent secondary detection by a fluorescent antibody/reagent, there is no control over the exact number of fluorescent dye molecules that are incorporated in a given probe. Thus, the resulting conventional FISH probes are a heterogeneous mixture with various degrees of fluorescent dye labels. Moreover, while some conventional FISH probes can directly incorporate a fluorescent dye, most conventional FISH probes contain Digoxigenin or biotin-labeled nucleotides, which are subsequently reacted to an antibody-fluorophore conjugate or a streptavidin-fluorophore conjugate. Thus, conventional FISH probes are indirectly labeled with a fluorophore. In contrast, the oligonucleotide Nano-FISH probes of the present disclosure are directly labeled with a fluorophore.

In some embodiments, the Nano-FISH probes of the present disclosure are designed to precisely target a desired strand of a target (e.g., the Watson strand, the Crick strand, or both strands). In contrast, since conventional FISH probes are nick translated as described above, the resulting probes are directed to both the Watson or the Crick strand. The "Watson strand" can be referred to herein as a "plus strand" or a "top strand" and the "Crick strand" can be referred to herein as a "minus strand" or a "bottom strand." Thus, the oligonucleotide Nano-FISH probes of the present disclosure can be more precisely targeted to a particular region on a particular strand of a target. Moreover, the oligonucleotide Nano-FISH probes of the present disclosure can be designed to overlap by at least 5 base pairs. For example a first oligonucleotide Nano-FISH probe can be designed to target the Watson strand of a target sequence and a second oligonucleotide Nano-FISH probe can be designed to target an adjacent region on the Crick strand of a target sequence. The first and second probe can overlap by at least 5 nucleotides, can be directly adjacent to each other, or can be spaced apart by at least several nucleotides. In some embodiments, the first and second probe can overlap by 5-20 nucleotides, 5-10 nucleotides, 10-15 nucleotides, or 15-20 nucleotides. Overlapping probes on the plus and minus strands can allow for the design and hybridization of larger probe sets to target smaller nucleic acid sequences.

Finally, the oligonucleotide Nano-FISH probes of the present disclosure are designed and selected according to certain criteria in order to precisely target and detect an exogenous sequence (e.g., a viral nucleic acid sequence), while minimizing off-target binding that would increase the background noise during imaging. For example, a target can be selected and the hg38 coordinates can be determined. Next, a tiling density can be selected from all on one strand, a fixed 2 base pair spacing between adjacent oligonucleotide Nano-FISH probes, or a spacing of 30 base pairs on each DNA strand with a 5 base pair overlap between the top and bottom strands at each end. In some embodiments, the overlap between two oligonucleotide Nano-FISH probes is from 5 base pairs to 15 base pairs. In some embodiments, the overlap between two oligonucleotide Nano-FISH probes is less than 15 base pairs. In some embodiments, oligonucleotide Nano-FISH probes of the present disclosure are tiled across a target to avoid steric hindrance between molecules. Next, oligonucleotide Nano-FISH probe sequences are tiled across regions of interest, such as the human genome or the human genome with an artificial extra chromosome representing the target (e.g., the CAR). In some embodiments, a program can be used to tile oligonucleotide Nano-FISH probes across the region of interest. As an example, a 40 base pair probe pool can be generated by tiling 40 base pair oligonucleotide probes at a predetermined spacing between oligonucleotides across a target sequence. The tiled 40 base pair probe pool can be designed to provide a minimum spacing of 2 base pairs between each consecutive oligonucleotide Nano-FISH probe.

Each oligonucleotide Nano-FISH probe in the resulting probe pool can be compared to a 16-mer database of genomic sequences to identify partial matches of probes to genomic sequences (e.g., hg38 human reference genome) that can result in off-target background staining, which would negatively affect the signal-to-noise ratio. An oligonucleotide Nano-FISH probe that comprises a total of 24 matches or less to the 16-mer database may be considered to be unique in the human genome and, thus, can be selected to move forward. Matches can refer to when an oligonucleotide Nano-FISH probe of the present disclosure has 100% identity to sequences from a database of genomic sequences (e.g., a 16-mer database). A probe with more than 300 matches to the 16-mer database of genomic sequences can be discarded from consideration as it generates too many non-target hits. In other words, oligonucleotide Nano-FISH probes of the present disclosure can comprise more than 50% contiguous homology to fewer than 3 genomic sequences from a species of a cell of interest. The number of matches of an oligonucleotide Nano-FISH probe can have to the 16-mer database of genomic sequences may depend on the size of the probe. For example, a 30 base pair long oligonucleotide Nano-FISH probe that exhibits a total of 14 matches or less to the 16-mer database may be considered to be unique in the human genome and, thus, may be selected to move forward. A 50 base pair long oligonucleotide Nano-FISH probe that exhibits a total of 34 matches or less to the 16-mer database may be considered to be unique in the human genome and, thus, may be selected to move forward. A 60 base pair long oligonucleotide Nano-FISH probe that exhibits a total of 44 matches or less to the 16-mer database may be considered to be unique in the human genome and, thus, may be selected to move forward. Thus, an oligonucleotide Nano-FISH probe of the present disclosure between 30 to 60 base pairs in length may exhibit 14 to 44 matches or less to the 16-mer database and be considered unique in the human genome. Oligonucleotide Nano-FISH probes of the present disclosure have less than 300 matches to the 16-mer database of genomic sequences. Pools of at least 30 oligonucleotide Nano-FISH probes that satisfied all design criteria can be selected to carry forward.

Additional selection criteria that can be applied when selecting the oligonucleotide Nano-FISH probes of the present disclosure include percent GC content. For example, oligonucleotide Nano-FISH probes can have a percent GC content above at least 25%, from 25-70%, from 30-70%, from 30-35%, from 35-40%, from 40-45%, from 45-50%, from 50-55%, from 55-60%, from 60-65%, or from 65-70%. In some embodiments, oligonucleotide Nano-FISH probes of the present disclosure are selected for use if they have less than 5 hits, less than 4 hits, less than 3 hits, less than 2 hits, or less than 1 hit of at least a 50% contiguous homology elsewhere in the human genome (e.g., by a BLAT search of each oligo against the genome (using the hg38 human reference genome)). In some embodiments, oligonucleotide Nano-FISH probes of the present disclosure comprise more than 50% contiguous homology to fewer than 3 genomic sequences from a species of a cell of interest. A BLAT search of each oligo against the genome may result in larger stretches of homology. A probe that exhibits less than 50% (~20 bases) homology may be considered to be unique and, thus, may be selected to move forward. In other words, a probe that comprises more than 50% contiguous homology to fewer than 3 sequences may be considered to be unique and, thus, may be selected move forward. When designing a probe set for enhanced resolution, the probe set can be designed to have a limited number of oligonucleotide Nano-FISH probes, such as 25-35 probes, that can be closely spaced. When designing a probe set for enhanced detection, the probe set can be designed include from 100-150 probes.

When using databases of genomic sequences, as described above, the database can comprise genomic sequences of a species of a cell of interest. For example, if the cell of interest is a human cell, the oligonucleotide Nano-FISH probes would be screened against a human genomic sequence database (e.g., k-mer databases or BLAT searches). Genomic databases of human, *Caenorhabditis elegans*, a mouse, a rat, a dog, a pig, or a horse can be used when the cell of interest is from, respectively, a human, *Caenorhabditis elegans*, a mouse, a rat, a dog, a pig, or a horse. In some embodiments, when using a database of human genomic sequences, as described above (e.g., k-mer databases or BLAT searches), the hg38 human reference genome can be used.

Additionally, oligonucleotide Nano-FISH probes of the present disclosure may be selected to not include a repetitive element. For example, a repetitive element may be short interspersed nuclear elements (SINE) including ALUs, long interspersed nuclear elements (LINE), long terminal repeat elements (LTR) including retroposons, DNA repeat elements, simple repeats (micro-satellites), low complexity repeats, satellite repeats, RNA repeats such as RNA, tRNA, rRNA, snRNA, scRNA, or srpRNA, or other repeats such as the class rolling circle (RC). Any one or more of the above design criteria may be used to select the oligonucleotide Nano-FISH probes that make up a probe set of the present disclosure. As described above, the process of comparing each oligonucleotide Nano-FISH probe against a 16-mer database of human genomic sequences may result in the selecting for probes that do not comprise repetitive elements. FIG. 52 illustrates the design criteria of the present disclosure used to select oligonucleotide Nano-FISH probes.

In contrast to the designed and selected oligonucleotide Nano-FISH probes of the present disclosure, conventional FISH probes that are nick translated are not filtered for low homology to human genomic sequences (e.g., using the hg38 human reference genome). As a result, conventional FISH techniques incorporate a step of blocking the FISH probes with a blocking agent such as Cot-1 DNA, salmon sperm DNA, yeast tRNA, or any combination thereof, which bind to any regions of the conventional FISH probes that are highly repetitive. The blocked conventional FISH probes are then incubated with cells. In contrast, the present oligonucleotide Nano-FISH probes can be directly incubated with cells for hybridization with a target sequence, without the need for a blocking agent.

Furthermore, the size variation of conventional FISH probes (e.g., nick-translated FISH) probes can make it difficult to calculate the exact concentration of nick probes, resulting in inconsistencies and high variations when processing the fluorescence of probes. In contrast, the Nano-FISH probes of the present disclosure can have a defined molecular weight and sequence length, resulting in high quality fluorescent detection.

In some embodiments, a probe set is referred to herein as a "probe pool" or a "plurality of probes." For example, an oligonucleotide Nano-FISH probe set can comprise from 20-200 oligonucleotide probes that differ in the sequence targeted by the probe. In some embodiments, the probe set can comprise 20-25 oligonucleotide Nano-FISH probes, 25-30 oligonucleotide Nano-FISH probes, 30-35 oligonucleotide Nano-FISH probes, 35-40 oligonucleotide Nano-FISH probes, 40-45 oligonucleotide Nano-FISH probes, 45-50 oligonucleotide Nano-FISH probes, 50-55 oligonucleotide Nano-FISH probes, 55-60 oligonucleotide Nano-FISH probes, 60-65 oligonucleotide Nano-FISH probes, 65-70 oligonucleotide Nano-FISH probes, 70-75 oligonucleotide Nano-FISH probes, 75-80 oligonucleotide Nano-FISH probes, 80-85 oligonucleotide Nano-FISH probes, 85-90 oligonucleotide Nano-FISH probes, 90-95 oligonucleotide Nano-FISH probes, 95-100 oligonucleotide Nano-FISH probes, 100-105 oligonucleotide Nano-FISH probes, 105-110 oligonucleotide Nano-FISH probes, 110-115 oligonucleotide Nano-FISH probes, 115-120 oligonucleotide Nano-FISH probes, 120-125 oligonucleotide Nano-FISH probes, 125-130 oligonucleotide Nano-FISH probes, 130-135 oligonucleotide Nano-FISH probes, 135-140 oligonucleotide Nano-FISH probes, 140-145 oligonucleotide Nano-FISH probes, 145-150 oligonucleotide Nano-FISH probes, 150-155 oligonucleotide Nano-FISH probes, 155-160 oligonucleotide Nano-FISH probes, 160-165 oligonucleotide Nano-FISH probes, 165-170 oligonucleotide Nano-FISH probes, 170-175 oligonucleotide Nano-FISH probes, 175-180 oligonucleotide Nano-FISH probes, 180-185 oligonucleotide Nano-FISH probes, 185-190 oligonucleotide Nano-FISH probes, 190-195 oligonucleotide Nano-FISH probes, 195-200 oligonucleotide Nano-FISH probes, 30-60 oligonucleotide Nano-FISH probes, 20-150 oligonucleotide Nano-FISH probes, or 30-50 oligonucleotide Nano-FISH probes that differ in the sequence targeted by the probe.

In some embodiments of the present disclosure, the Nano-FISH probe pool can comprise a universal Nano-FISH probe set that targets the backbone of a viral vector that integrates into a cell. In some embodiments, the universal Nano-FISH probe set can comprise from 20-100 probes that differ in the sequence targeted by the probe. In some embodiments, the universal Nano-FISH probe set can comprise from 100 probes that differ in the sequence targeted by the probe. In some embodiments, the universal Nano-FISH probe set can comprise from 80 probe that differ in the sequence targeted by the probe s. In some embodiments, the universal Nano-FISH probe set can comprise from 60 probes that differ in the sequence targeted by the probe. In some embodiments, the universal Nano-FISH probe set can comprise from 40 probes that differ in the sequence targeted by the probe. In some embodiments, the universal Nano-FISH probe set can comprise from 20 probes that differ in the sequence targeted by the probe. In some embodiments, the universal Nano-FISH probe set can comprises a certain amount (e.g., percentage) of probes that specifically recognize (such as to bind to or to hybridize with) a portion of the target nucleic acid sequence. In some embodiments, the target nucleic acid sequence can be less than 10 kilobases, less than 8 kilobases, less than 5 kilobases, or less than 2.5 kilobases. In some embodiments, a universal probe set for a viral vector backbone can be used when to detect viral vector integrations when from 2-100% of the probe pool of the universal probe set are expected to hybridize to the exact target nucleic acid sequence or viral vector backbone sequence. For example, the universal Nano-FISH probe set can comprise 60 probes that differ in the sequence targeted by the probe, wherein the 60 Nano-FISH probes are expected to hybridize to the exact target nucleic acid sequence or viral vector backbone sequence. In other instances, the universal Nano-FISH probe set can comprise 60 probes that differ in the sequence targeted by the probe, wherein 50 of these Nano-FISH probes are expected to hybridize to the exact target nucleic acid sequence or viral vector backbone sequence. In other instances, the universal Nano-FISH probe set can comprise 60 probes that differ in the sequence targeted by the probe, wherein 40 of these Nano-FISH probes are expected to hybridize to the exact target nucleic acid sequence or viral vector backbone sequence. In other instances, the universal Nano-FISH probe set can comprise 60 probes that differ in the sequence targeted by the probe, wherein 30 of these Nano-FISH probes are expected to hybridize to the exact target nucleic acid sequence or viral vector backbone sequence. In other instances, the universal Nano-FISH probe set can comprise 60 probes, a wherein 20 of these Nano-FISH probes are expected to hybridize to the exact target nucleic acid sequence or viral vector backbone sequence. In other instances, the universal Nano-FISH probe set can comprise 60 probes, wherein 10 Nano-FISH probes are expected to hybridize to the exact target nucleic acid sequence or viral vector backbone sequence. In some embodiments, the universal Nano-FISH probe set can specifically bind to various regions of the target nucleic acid sequence. In some embodiments, the universal Nano-FISH probe set can specifically bind to the backbone of a viral vector and be used to detect integrations of the viral vector irrespective of the viral vector payload. For example, a universal probe set can be used to detect lentivirus vector backbone integrations irrespective of the vector payload or therapeutic use of the lentivirus vector/payload. In some embodiments, the universal Nano-FISH probe set can specifically bind to a region of the target nucleic acid sequence that encodes a target protein (e.g., a CAR). In some embodiments, the universal Nano-FISH probe set can specifically bind to a region of a CAR gene. A universal probe set can comprise probes of SEQ ID NO: 1212-SEQ ID NO: 1267. A universal probe set can comprise probes of SEQ ID NO: 930-SEQ ID NO: 988 and SEQ ID NO: 1123.

In some embodiments, a single Nano-FISH probe can be at least 20 and no more than 80 nucleotides in length. In some embodiments, a single Nano-FISH probe can be at least 30 and no more than 60 nucleotides in length. In some embodiments, a single Nano-FISH probe can be at least 40 and no more than 50 nucleotides in length. In some embodiments, a single Nano-FISH probe can be at least 10 and no more than 100 nucleotides in length. In some embodiments, a single Nano-FISH probe can be at least 200 and no more than 300 nucleotides in length. In some embodiments, a single Nano-FISH probe can be at least 400 and no more than 500 nucleotides in length. In some embodiments, a single Nano-FISH probe can be at least 600 and no more than 700 nucleotides in length. In some embodiments, a single Nano-FISH probe can be at least 800 and no more than 900 nucleotides in length. In some embodiments, a single Nano-FISH probe can be at least 1000 and no more than 1100 nucleotides in length. In some embodiments, a single Nano-FISH probe can be at least 1200 and no more than 1300 nucleotides in length. In some embodiments, a single Nano-FISH probe can be at least 1400 and no more than 1500 nucleotides in length. In some embodiments, a single Nano-FISH probe can be at least 1600 and no more than 1700 nucleotides in length. In some embodiments, a single Nano-FISH probe can be at least 1800 and no more than 1900 nucleotides in length. In some embodiments, a single Nano-FISH probe can be at least 2000 and no more than 2100 nucleotides in length. In some embodiments, a single Nano-FISH probe can be at least 2200 and no more than 2300 nucleotides in length. In some embodiments, a single Nano-FISH probe can be at least 2400 and no more than 2500 nucleotides in length. In some embodiments, a single Nano-FISH probe can be at least 2600 and no more than 2700 nucleotides in length. In some embodiments, a single Nano-FISH probe can be at least 2800 and no more than 2900 nucleotides in length. In some embodiments, a single Nano-FISH probe can be at least 3000 and no more than 3100 nucleotides in length. In some embodiments, a single Nano-FISH probe can be at least 3200 and no more than 3300 nucleotides in length. In some embodiments, a single Nano-FISH probe can be at least 3400 and no more than 3500 nucleotides in length. In some embodiments, a single Nano-FISH probe can be at least 3600 and no more than 3700 nucleotides in length. In some embodiments, a single Nano-FISH probe can be at least 3800 and no more than 3900 nucleotides in length. In some embodiments, a single Nano-FISH probe can be at least 4000 and no more than 4100 nucleotides in length. In some embodiments, a single Nano-FISH probe can be at least 4200 and no more than 4300 nucleotides in length. In some embodiments, a single Nano-FISH probe can be at least 4400 and no more than 4500 nucleotides in length. In some embodiments, a single Nano-FISH probe can be at least 4600 and no more than 4700 nucleotides in length. In some embodiments, a single Nano-FISH probe can be at least 4800 and no more than 4900 nucleotides in length. In some embodiments, a single Nano-FISH probe can be at least 5000 and no more than 5100 nucleotides in length. In some embodiments, a single Nano-FISH probe can be at least 5200 and no more than 5300 nucleotides in length. In some embodiments, a single Nano-FISH probe can be at least 5400 and no more than 5500 nucleotides in length. In some embodiments, a single Nano-FISH probe can be at least 5600 and no more than 5700 nucleotides in length. In some embodiments, a single Nano-FISH probe can be at least 5800 and no more than 5900 nucleotides in length. In some embodiments, a single Nano-FISH probe can be at least 6000 and no more than 6100 nucleotides in length. In some embodiments, a single Nano-FISH probe can be at least 6200 and no more than 6300 nucleotides in length. In some embodiments, a single Nano-FISH probe can be at least 6400 and no more than 6500 nucleotides in length. In some embodiments, a single Nano-FISH probe can be at least 6600 and no more than 6700 nucleotides in length. In some embodiments, a single Nano-FISH probe can be at least 6800 and no more than 6900 nucleotides in length. In some embodiments, a single Nano-FISH probe can be at least 7000 and no more than 7100 nucleotides in length. In some embodiments, a single Nano-FISH probe can be at least 7200 and no more than 7300 nucleotides in length. In some embodiments, a single Nano-FISH probe can be at least 7400 and no more than 7500 nucleotides in length. In some embodiments, a single Nano-FISH probe can be at least 7600 and no more than 7700 nucleotides in length. In some embodiments, a single Nano-FISH probe can be at least 7800 and no more than 7900 nucleotides in length. In some embodiments, a single Nano-FISH probe can be at least 8000 and no more than 8100 nucleotides in length. In some embodiments, a single Nano-FISH probe can be at least 8200 and no more than 8300 nucleotides in length. In some embodiments, a single Nano-FISH probe can be at least 8400 and no more than 8500 nucleotides in length. In some embodiments, a single Nano-FISH probe can be at least 8600 and no more than 8700 nucleotides in length. In some embodiments, a single Nano-FISH probe can be at least 8800 and no more than 8900 nucleotides in length. In some embodiments, a single Nano-FISH probe can be at least 9000 and no more than 9100 nucleotides in length. In some embodiments, a single Nano-FISH probe can be at least 9200 and no more than 9300 nucleotides in length. In some embodiments, a single Nano-FISH probe can be at least 9400 and no more than 9500 nucleotides in length. In some embodiments, a single Nano-FISH probe can be at least 9600 and no more than 9700 nucleotides in length. In some embodiments, a single Nano-FISH probe can be at least 9800 and no more than 9900 nucleotides in length. In some embodiments, a single Nano-FISH probe can be at least 10000 and no more than 10100 nucleotides in length. In some embodiments, a single Nano-FISH probe can be at least 10200 and no more than 10300 nucleotides in length. In some embodiments, a single Nano-FISH probe can be at least 10 nucleotides in length and no more than 10300 nucleotides in length. In some embodiments, a single Nano-FISH probe can be at least 10 nucleotides in length and no more than 10,000 nucleotides in length.

Overall, the above described properties of the Nano-FISH probes of the present disclosure, can lead to increased precision in detecting a target sequence, especially detection of small target sequences that are less than 5 kilobases, and lower background signals stemming from off target probe-DNA interactions, as compared to conventional FISH probes. In other words, the Nano-FISH probes of the present disclosure can yield a better or higher signal-to-noise ratio than conventional FISH probes.

In some embodiments, 9 oligonucleotide-Nano-FISH probes of the present disclosure may be used to visualize insertions of an exogenous nucleic acid sequence in the nucleus at a signal to noise ratio of about 1.2-1.5 to 1. In some embodiments, 15 oligonucleotide-Nano-FISH probes of the present disclosure may be used to visualize insertions of an exogenous nucleic acid sequence in the nucleus at a signal to noise ratio of about 1.5:1. In some embodiments, 30 oligonucleotide-Nano-FISH probes of the present disclosure may be used to visualize insertions of an exogenous nucleic acid sequence in the nucleus at a signal to noise ratio of about 4-8 to 1. In some embodiments, 60 oligonucleotide-Nano-FISH probes of the present disclosure may be used to visualize insertions of an exogenous nucleic acid sequence in the nucleus at a signal to noise ratio of about 5-10:1. In some embodiments, 90 oligonucleotide Nano-FISH probes of the present disclosure may result in at least one detected allele (in a triploid cell background) in about 98% of cells. In some embodiments, 60 oligonucleotide Nano-FISH probes of the present disclosure may result in at least one detected allele (in a triploid cell background) in about 92% of cells. In some embodiments, 30 oligonucleotide Nano-FISH probes of the present disclosure may result in at least one detected allele (in a triploid cell background) in about 89% of cells. In some embodiments, 15 oligonucleotide Nano-FISH probes of the present disclosure may result in at least one detected allele (in a triploid cell background) in about 34% of cells.

In some embodiments, the target exogenous nucleic acid sequence does not need to be amplified prior to detection. Thus, the exogenous nucleic acid sequences of the present disclosure are non-amplified exogenous nucleic acid sequences. In some embodiments, the signal from the oligonucleotide Nano-FISH probes of the present disclosure does not need to be amplified prior to detection. Thus, the Nano-FISH methods of the present disclosure provide methods of non-signal amplified detection. In other words, the Nano-FISH methods of the present disclosure provide methods of direct, non-amplified signal detection.

The compositions and methods provided herein can also comprise a plurality of probe sets, wherein each probe set can contain any number of oligonucleotide Nano-FISH probes described above. Within a probe set, oligonucleotide Nano-FISH probes may all be labeled with the same fluorophore. Each probe set in the plurality of probe sets may be labeled with different fluorophores. Each probe set in the plurality of probe sets may further comprise oligonucleotide Nano-FISH probes for the detection of unique target sequences (e.g., exogenous or viral nucleic acid sequences). Thus, a plurality of probe sets can be used to detect multiple target sequences simultaneously, with each target sequence being labeled with a unique fluorophore.

Types of Regulatory Elements

A regulatory element may be DNA, RNA, a polypeptide, or a combination thereof. A regulatory element may be DNA. A regulatory element may be RNA. A regulatory element may be a polypeptide. A regulatory element may be any combination of DNA, RNA, and/or polypeptide (e.g., protein-protein complexes, protein-DNA/RNA complexes, and the like).

A regulatory element may be DNA. A regulatory element may be a single-stranded DNA regulatory element, a double-stranded DNA regulatory element, or a combination thereof. The DNA regulatory element may be single-stranded. The DNA regulatory element may be double-stranded. The DNA regulatory element may encompass a DNA fragment. The DNA regulatory element may encompass a gene. The DNA regulatory element may encompass a chromosome. The DNA regulatory element may include endogenous DNA regulatory elements (e.g., endogenous genes). The DNA regulatory element may include artificial DNA regulatory elements (e.g., foreign genes introduced into a cell).

A regulatory element may be RNA. A regulatory element may be a single-stranded RNA regulatory element, a double-stranded RNA regulatory element, or a combination thereof. The RNA regulatory element may be single-stranded. The RNA regulatory element may be double-stranded. The RNA regulatory element may include endogenous RNA regulatory elements. The RNA regulatory element may include artificial RNA regulatory elements. The RNA regulatory element may include microRNA (miRNA), transfer RNA (tRNA), ribosomal RNA (rRNA), messenger RNA (mRNA), pre-mRNA, transfer-messenger RNA (tmRNA), heterogeneous nuclear RNA (hnRNA), short interfering RNA (siRNA), or short hairpin RNA (shRNA). The RNA regulatory element may be a RNA fragment. The RNA regulatory element may be an anti-sense RNA.

An RNA regulatory element may be an enhancer RNA (eRNA). An enhancer RNA may be a non-coding RNA molecule transcribed from an enhancer region of a DNA molecule, and may be from about 50 base-pairs (bp) in length to about 3 kilo base pairs in length (e.g., about 100 bp in length, about 200 bp in length, about 500 bp in length, about 1 kb in length, about 1.5 kb in length, about 2 kb in length, or about 2.5 kb in length). An enhancer RNA may be a 1D eRNA or an eRNA that may be unidirectionally transcribed. An enhancer RNA may also be a 2D eRNA or an eRNA that may be bidirectionally transcribed. An eRNA may be polyadenylated. Alternatively, an eRNA may be non-polyadenylated.

A regulatory element may be a DNaseI hypersensitive site (DHS). DHS may be a region of chromatin unoccupied by transcription factors and which is sensitive to cleavage by the DNase I enzyme. The presence of DHS regions within a chromatin may demarcate transcription factory occupancy at a nucleotide resolution. The presence of DHS regions may further correlate with activation of cis-regulatory elements, such as an enhancer, promoter, silencer, insulator, or locus control region. DHS variation may be correlated to variation in gene expression in healthy or diseased cells (e.g., cancerous cells) and/or correlated to phenotypic traits.

A DHS pattern may encode memory of prior cell fate decisions and exposures. For example, upon differentiation, a DHS pattern of a progeny may encode transcription factor occupancy of its parent. Further, a DHS pattern of a cell may encode an environmentally-induced transcription factor occupancy from an earlier time point.

A DHS pattern may encode cellular maturity. An embryonic stem cell may encode a set of DHSs that may be transmitted combinatorially to a differentiated progeny, and this set of DHSs may be decreased with each cycle of differentiation. As such, the set of DHSs may be correlated with time, thereby allowing a DHS pattern to be correlated with cellular maturity.

A DHS pattern may also encode splicing patterns. Protein coding exons may be occupied by transcription factors, which may further be correlated with codon usage patterns and amino acid choice on evolutionary time scales and human fitness. A transcription factory occupancy may further modulate alternative splicing patterns, for example, by imposing sequence constraints at a splice junction. As such, a DHS pattern may encode transcription factor occupancy of one or more exons of interest and may provide additional information on alternative splicing patterns.

A DHS pattern may encode a cell type. For example, within each cell type, about 100,000 to about 250,000 DHSs may be detected. About 5% of the detected DHSs may be located within a transcription start site and the remaining DHSs may be detected at a distal site from the transcription start site. Each cell type may contain a distinct DHS pattern at the distal site and mapping the DHS pattern at the distal site may allow identification of a cell type. An overlap may further be present within two DHS patterns from two different cell types, for example, an overlap of a set of detected DHSs within the two DHS patterns. An overlap may be less than about 70%, less than about 65%, less than about 60%, less than about 55%, less than about 50%, less than about 45%, less than about 40%, less than about 35%, less than about 30%, less than about 25%, less than about 20%, less than about 15%, less than about 10%, less than about 9%, less than about 8%, less than about 7%, less than about 6%, less than about 5%, less than about 4%, less than about 3%, less than about 2%, or less than about 1% of the detected DHSs. The presence of an overlap may not affect the identification of a cell type.

A regulatory element may be a polypeptide. The polypeptide may be a protein or a polypeptide fragment. For example, a regulatory element may be a transcription factor, DNA-binding protein or functional fragment, RNA-binding protein or functional fragment, protein involved in chemical modification (e.g., involved in histone modification), or gene product. A regulatory element may be a transcription factor. A regulatory element may be a DNA or RNA-binding protein or functional fragment. A regulatory element may be a product of a gene transcript. A regulatory element may be a chromatin.

Methods of Detecting a Regulatory Element

Described herein is a method of detecting a regulatory element. The detection may encompass identification of the regulatory element, determining the presence or absence of the regulatory element, and/or determining the activity of the regulatory element. A method of detecting a regulatory element may include contacting a cell sample with a detection agent, binding the detection agent to the regulatory element, and analyzing a detection profile from the detection agent to determine the presence, absence, or activity of the regulatory element.

The method may involve utilizing one or more intrinsic properties associated with a detection agent to aid in detection of the regulatory element. The intrinsic properties may encompass the size of the detection agent, the intensity of the signal, and the location of the detection agent. The size of the detection agent may include the length of the probe and/or the size of the detectable moiety (e.g., the size of a fluorescent dye molecule) may modulate the specificity of interaction with a regulatory element. The intensity of the signal from the detection agent may correlate to the sensitivity of detection. For example, a detection agent with a molar extinction coefficient of about $0.5-5\times10^6$ $M^{-1}$ $cm^{-1}$ may have a higher intensity signal relative to a detection agent with a molar extinction coefficient outside of the $0.5-5\times10^6$ $M^{-1}$ $cm^{-1}$ range and may have lower attenuation due to scattering and absorption. Further, a detection agent with a longer excited state lifetime and a large Stoke shift (measured by the distance between the excitation and emission peaks) may further improve the sensitivity of detection. The location of the detection agent may, for example, provide the activity state of a regulatory element. A combination of intrinsic properties of the detection agent may be used to detect a regulatory element of interest.

A detection agent may comprise a detectable moiety that is capable of generating a light, and a probe portion that is capable of hybridizing to a target site on a regulatory element. As described herein, a detection agent may include a DNA probe portion, an RNA probe portion, a polypeptide probe portion, or a combination thereof. Sometimes, a DNA or RNA probe portion may be between about 10 and about 100 nucleotides in length, between about 15 and about 100 nucleotides in length, between about 20 and about 100 nucleotides in length, between about 20 and about 80 nucleotides in length, between about 20 and about 60 nucleotides in length, between about 25 and about 55 nucleotides in length, between about 30 and about 50 nucleotides in length, between about 15 and about 80 nucleotides in length, between about 15 and about 60 nucleotides in length, between about 20 and about 40 nucleotides in length, or between about 20 and about 30 nucleotides in length. Sometimes, a DNA or RNA probe portion may be about 10, about 15, about 20, about 21, about 22, about 23, about 24, about 25, about 26, about 27, about 28, about 29, about 30, about 31, about 32, about 33, about 34, about 35, about 36, about 37, about 38, about 39, about 40, about 45, about 50, about 55, about 60, about 65, about 70, about 80, about 90, about 100, or more nucleotides in length. A DNA or RNA probe portion may be a TALEN probe, ZFN probe, or a CRISPR probe. A DNA or RNA probe portion may be a padlock probe. A polypeptide probe may comprise a DNA-binding protein, a RNA-binding protein, a protein involved in the transcription/translation process, a protein that detects the transcription/translation process, a protein that may detect an open or relaxed portion of a chromatin, or a protein interacting partner of a product of a regulatory element (e.g., an antibody or binding fragment thereof).

A detection agent may comprise a DNA or RNA probe portion which may be between about 10 and about 100 nucleotides in length, between about 15 and about 100 nucleotides in length, between about 20 and about 100 nucleotides in length, between about 20 and about 80 nucleotides in length, between about 20 and about 60 nucleotides in length, between about 25 and about 55 nucleotides in length, between about 30 and about 50 nucleotides in length, between about 15 and about 80 nucleotides in length, between about 15 and about 60 nucleotides in length, between about 20 and about 40 nucleotides in length, or between about 20 and about 30 nucleotides in length. A detection agent may comprise a DNA or RNA probe portion which may be about 10, about 15, about 20, about 21, about 22, about 23, about 24, about 25, about 26, about 27, about 28, about 29, about 30, about 31, about 32, about 33, about 34, about 35, about 36, about 37, about 38, about 39, about 40, about 45, about 50, about 55, about 60, about 65, about 70, about 80, about 90, about 100, or more nucleotides in length.

A detection agent may comprise a DNA or RNA probe selected from a TALEN probe, a ZFN probe, or a CRISPR probe.

A set of detection agents may be used to detect a regulatory element. The set of detection agents may comprise about 2, about 3, about 4, about 5, about 6, about 7, about 8, about 9, about 10, about 11, about 12, about 13, about 14, about 15, about 16, about 17, about 18, about 19, about 20, about 25, about 30, about 35, about 40, about 45, about 50, or more detection agents. Each of the detection agents within the set of detection agents may recognize and interact with a distinct region of a regulatory element. Sometimes, about 1, about 2, about 3, about 4, about 5, about 6, about 7, about 8, about 9, about 10, about 11, about 12, about 13, about 14, about 15, about 16, about 17, about 18, about 19, about 20, or more detection agents may be used for detection of a regulatory element. About 1 or more detection agents may be used for detection of a regulatory element. About 2 or more detection agents may be used for detection of a regulatory element. About 3 or more detection agents may be used for detection of a regulatory element. About 4 or more detection agents may be used for detection of a regulatory element. About 5 or more detection agents as used for detection of a regulatory element. About 6 or more detection agents may be used for detection of a regulatory element. About 7 or more detection agents may be used for detection of a regulatory element. About 8 or more detection agents may be used for detection of a regulatory element. About 9 or more detection agents may be used for detection of a regulatory element. About 10 or more detection agents may be used for detection of a regulatory element. About 11 or more detection agents may be used for detection of a regulatory element. About 12 or more detection agents may be used for detection of a regulatory element. About 13 or more detection agents may be used for detection of a regulatory element. About 14 or more detection agents may be used for detection of a regulatory element. About 15 or more detection agents may be used for detection of a regulatory element. About 20 or more detection agents may be used for detection of a regulatory element.

A detection agent may comprise a polypeptide probe selected from a DNA-binding protein, a RNA-binding protein, a protein involved in the transcription/translation process, a protein that detects the transcription/translation process, a protein that may detect an open or relaxed portion of a chromatin, or a protein interacting partner of a product of a regulatory element (e.g., an antibody or binding fragment thereof).

A detectable moiety that is capable of generating a light may be directly conjugated or bound to a probe portion. A detectable moiety may be indirectly conjugated or bound to a probe portion by a conjugating moiety. As described herein, a detectable moiety may be a small molecule (e.g., a dye) which may be directly conjugated or bound to a probe portion. A detectable moiety may be a fluorescently labeled protein or molecule which may be attached to a conjugating moiety (e.g., a hapten group, an azido group, an alkyne group) of a probe.

A profile or a detection profile or signature may include the signal intensity, signal location, or size of the signal of the detection agent. The profile or the detection profile may comprise about 100 image frames, about 500 frames, about 1000 frames, about 2000 frames, about 5000 frames, about 10,000 frames, about 20,000 frames, about 30,000 frames, about 40,000 frames, about 50,000 frames, or more frames. Analysis of the profile or the detection profile may determine the activity of the regulatory element. The degree of activation may also be determined from the analysis of the profile or detection profile. Analysis of the profile or the detection profile may further determine the optical isolation and localization of the detection agents, which may correlate to the localization of the regulatory element.

In additional cases, a detection agent may comprise a polypeptide probe selected from a DNA-binding protein, a RNA-binding protein, a protein involved in the transcription/translation process or detects the transcription/translation process, a protein that may detect an open or relaxed portion of a chromatin, or a protein interacting partner of a product of a regulatory element (e.g., an antibody or binding fragment thereof).

Sometimes, a detectable moiety that is capable of generating a light is directly conjugated or bound to a probe portion. Other times, a detectable moiety is indirectly conjugated or bound to a probe portion by a conjugating moiety. As described elsewhere herein, a detectable moiety may be a small molecule (e.g., a dye) which may be directly conjugated or bound to a probe portion. Alternatively, a detectable moiety may be a fluorescently labeled protein or molecule which may be attached to a conjugating moiety (e.g., a hapten group, an azido group, an alkyne group) of a probe.

In some instances, a profile or a detection profile or signature may include the signal intensity, signal location, or size of the signal of the detection agent. Sometimes, the profile or the detection profile may comprise about 100 frames, 500 frames, 1000 frames, 2000 frames, 5000 frames, 10,000 frames, 20,000 frames, 30,000 frames, 40,000 frames, 50,000 frames or more images. Analysis of the profile or the detection profile may determine the activity of the regulatory element. In some cases, the degree of activation may also be determined from the analysis of the profile or detection profile. In additional cases, analysis of the profile or the detection profile may further determine the optical isolation and localization of the detection agents, which may correlate to the localization of the regulatory element.

A. Detection of DNA and/or RNA Regulatory Elements

A regulatory element may be DNA. Described herein is a method of detecting a DNA regulatory element, which may include contacting a cell sample with a detection agent, binding the detection agent to the DNA regulatory element, and analyzing a profile from the detection agent to determine the presence, absence, or activity of the DNA regulatory element.

A regulatory element may be RNA. Described herein is a method of detecting a RNA regulatory element, which may include contacting a cell sample with a detection agent, binding the detection agent to the RNA regulatory element, and analyzing a profile from the detection agent to determine the presence, absence, or activity of the RNA regulatory element.

A regulatory element may be an enhancer RNA (eRNA). The presence of an eRNA may correlate to an activated regulatory element. For example, the production of an eRNA may correlate to the transcription of a target gene. As such, the detection of an eRNA element may indicate that a target gene downstream of the eRNA element may be activated.

Provided herein is a method of detecting an eRNA regulatory element, which may include contacting a cell sample with a detection agent, binding the detection agent to the eRNA regulatory element, and analyzing a profile from the detection agent to determine the presence, absence, or activity of the eRNA regulatory element. Described herein is an in situ method of detecting an activated regulatory DNA site, which may include incubating a sample with a set of detection agents (e.g., fluorescently-labeled probes), hybridizing the set of detection agents to at least one enhancer RNA (eRNA), and analyzing a profile (e.g., a fluorescent profile) from the set of detection agents to determine the presence of an eRNA, in which the presence of eRNA correlates to an activated regulatory DNA site.

B. Detection of a DNaseI Hypersensitive Site, Generation of a DNaseI Hypersensitive Site Map, and Determination of a Cell Type Based on a DNaseI Hypersensitive Site Profile A regulatory element may be a DNaseI hypersensitive site (DHS). A DNaseI hypersensitive site may be an inactivated DNaseI hypersensitive site. A DNaseI hypersensitive site may be an activated DNaseI hypersensitive site. Described herein is a method of detecting a DHS, which may include contacting a cell sample with a detection agent, binding the detection agent to the DHS, and analyzing a profile from the detection agent to determine the presence, absence, or activity of the DHS.

The DHS may be an active DHS and may further contain a single stranded DNA region. The single stranded DNA region may be detected by S1 nuclease. A method of detecting a DHS may further be extended to detect the presence of a single stranded DNA region within a DHS. Such a method, for example, may comprise contacting a cell sample with a detection agent, binding the detection agent to a single stranded region of a DHS, and analyzing a profile from the detection agent to determine the presence or absence of the single stranded region within a DHS.

Also described herein is a method of determining the activity level of a regulatory element, which may include incubating a cell sample with a set of detection agents (e.g., fluorescently labeled probes), in which each detection agent hybridizes to a DHS, measuring a signature (e.g., a fluorescent signature) from the set of detection agents, and based on the signature, determining a DHS profile, and comparing the DHS profile with a control, in which a correlation with the control indicates the activity level of the regulatory element in the cell sample. The signature (e.g., the fluorescent signature) may further correlate to a signal intensity (or a peak height). A set of signal intensities may be compiled into a DHS profile and compared with a control to generate a second DHS profile which comprises a set of relative signal intensities (or relative peak heights). The set of relative signal intensities may correlate to the activity level of a regulatory element.

Also described herein is a method of generating a DHS map, which may provide information on cell-to-cell variation in gene expression, memory of early developmental fate decisions which establish lineage hierarchies, quantitation of embryonic stem cell DHS sites which decreases with cell passage, and presence of oncogenic elements.

The location of a set of DHS sites may be correlated to a cell type. For example, the location of about 1, about 5, about 10, about 15, about 20, about 25, about 30, about 35, about 40, about 45, about 50, about 55, about 60, or more DHS sites may be correlated to a cell type. The location of about 1, about 5, about 10, about 15, about 20, about 25, about 30, about 35, about 40, about 45, about 50, about 55, about 60, or more DHS may be used to determine a cell type. The cell may be a normal cell or a cancerous cell. DHS variation may be used to determine the presence of cancerous cells in a sample. A method of determining a cell type (e.g., a cancerous cell) may include incubating a cell sample with a set of detection agents (e.g., fluorescently labeled probes), in which each detection agent hybridizes to a DHS, measuring a signature (e.g., a fluorescent signature) from the set of detection agents, and based on the signature, determining a DHS profile, and comparing the DHS profile with a control, in which a correlation with the control indicates the cell type of the sample.

A DHS site may be visualized through a terminal deoxynucleotidyl transferase (TdT) dUTP Nick-End labeling (TUNEL) assay. A TUNEL assay may utilize a terminal deoxynucleotidyl transferase (TdT) which may catalyze the addition of a dUTP at the site of a nick or strand break. A fluorescent moiety may further be conjugated to dUTP. A TUNEL assay may be utilized for visualization of a plurality of DHSs present in a cell. A TUNEL assay may be an assay as described in EXAMPLE 2.

The sequence of a DHS site may be detected in situ, by utilizing an in situ sequencing methodology. For example, the two ends of a padlock probe may be hybridized to a target, regulatory element sequence and the two ends may be further ligated together by a ligase (e.g., T4 ligase) when bound to the target sequence. An amplification (e.g., a rolling circle amplification or RCA) may be performed utilizing a polymerase (e.g., Φ29 polymerase), which may result in a single stranded DNA comprising at least about 1, at least about 2, at least about 3, at least about 4, at least about 5, at least about 6, at least about 7, at least about 8, at least about 9, at least about 10, or more tandem copies of the target sequence. The amplified product at least about be sequenced by ligation in situ using partition sequencing compatible primers and labeled probes (e.g., fluorescently labeled probes). For example, each target sequence within the amplified product may bind to a primer and probe set resulting in a bright spot detectable by, e.g., an immunofluorescence microscopy. The labeled probe (e.g., the fluorescent label on the probe) may identify the nucleotide at the ligation site, thereby allowing the color detected to define the nucleotide at the respective ligation position. Sometimes, at least 1, at least 2, at least 3, at least 4, at least 5, at least 6, at least 7, at least 8, at least 9, at least 10, at least 15, at least 20, or more rounds of ligation and detection may occur for detection of a DHS site.

A control as used herein may refer to a DHS profile generated from a regulatory element those activity level is known. A control may also refer to a DHS profile generated from an inactivated regulatory element. A control may further refer to a DHS profile generated from an activated or inactivated regulatory element from a specific cell type. For example, the cell type may be an epithelial cell, connective tissue cell, muscle cell, or nerve cell type. The cell may be a cell derived from heart, lung, kidney, stomach, intestines, liver, pancreas, brain, esophagus, and the like. The cell type may be a hormone-secreting cell, such as a pituitary cell, a gut and respiratory tract cell, thyroid gland cell, adrenal gland cell, Leydig cell of testes, Theca interna cell of ovarian follicle, Juxtaglomerular cell, Macula densa cell, Peripolar cell, or Mesangial cell type. The cell may be a blood cell or a blood progenitor cell. The cell may be an immune system cell, e.g., monocytes, dendritic cell, neutrophile granulocyte, eosinophil granulocyte, basophil granulocyte, hybridoma cell, mast cell, helper T cell, suppressor T cell, cytotoxic T cell, Natural Killer T cell, B cell, or natural killer cell.

C. Detection and Mapping of a Chromatin

A regulatory element may also be a chromatin. Provided herein is a method of detecting a chromatin, which may include contacting a cell sample with a detection agent, binding the detection agent to the chromatin, and analyzing a profile from the detection agent to determine the activity state of the chromatin. The activity level of a chromatin may be determined based on the presence or activity level of a nucleic acid of interest or the presence or absence of a chromatin associated protein. The activity level of a chromatin may be determined based on DHS locations. The one or more DHS locations on a chromatin may be used to map chromatin activity state. For example, one or more DHSs may be localized in a region and the surrounding chromatin may be decompacted and readily visualized relative to an inactive chromatin state when a DHS is not present. The one or more DHSs within a localized region may further form a localized DHS set and a plurality of localized DHS sets may further provide a global map or pattern of chromatin activity (e.g., an activity pattern).

Also included herein is a method of generating a chromatin map based on the pattern of DNaseI hypersensitive sites, RNA regulatory elements (e.g., eRNA), chromatin associated proteins or gene products, or a combination thereof. The method of generating a chromatin map may be based on the pattern of DNaseI hypersensitive sites. The method may comprise generating a β-dimensional map from a detection profile (or a 2-dimensional detection profile). A chromatin map may provide information on the compaction of chromatin, the spatial structure, spacing of regulatory elements, and localization of the regulatory elements to globally map chromatin structure and accessibility.

A chromatin map for a cell type may also be generated, in which each cell type comprises a different chromatin pattern. Each cell type may be associated with at least one unique marker. The at least one unique marker (or fiduciary marker) may be a genomic sequence. The at least one unique marker (or fiduciary marker) may be DHS. A cell type may comprise about 5, about 10, about 15, about 20, about 25, about 30, about 35, about 40, about 45, about 50, about 60, or more unique markers (or fiduciary markers). The cell type may be an epithelia cell, a connective tissue cell, a muscle cell, a nerve cell, a hormone-secreting cell, a blood cell, an immune system cell, or a stem cell type. The cell type may be a cancerous cell type.

A chromatin profile (e.g., based on DHSs) in the presence of an exogenous agent or condition may also be generated. The method may comprise incubating a cell sample with a set of fluorescently labeled probes specific to target sites (e.g., target DHSs) on a chromatin in the presence of an exogenous agent or condition; measuring a fluorescent signature of the set of fluorescently labeled probes; based on the fluorescent signature, generating a fluorescent profile of the chromatin; and comparing the fluorescent profile with a second fluorescent profile of a chromatin obtained from an equivalent sample incubated with an equivalent set of fluorescently labeled probes in the absence of the exogenous agent or condition, wherein a difference between the two sets of fluorescent profiles indicates a change in the chromatin density (e.g., changes in the presences or activation of DHSs) induced by the exogenous agent or condition. The exogenous agent or condition may comprise a small molecule or a drug. The exogenous agent may be a small molecule, such as a steroid. The exogenous agent or condition may comprise an environmental factor, such as a change in pH, temperature, nutrient, or a combination thereof.

Methods of Determining the Localization of a Regulatory Element

Also described herein is a method for determining the localization of a regulatory element. The localization of a regulatory element may provide an activity state of the regulatory element. The localization of a regulatory element may also provide an interaction state with at least one additional regulatory element. For example, the localization of a first regulatory element with respect to a second regulatory element may provide spatial coordinate and distance information between the two regulatory elements, and may further provide information regarding whether the two regulatory elements may interact with each other. The activity state of a regulatory element may include, for example, a transcription or translation initiation event, a translocation event, or an interaction event with one or more additional regulatory elements. The regulatory element may comprise DNA, RNA, polypeptides, or a combination thereof. The regulatory element may be DNA. The regulatory element may be RNA. The regulatory element may be an enhancer RNA (eRNA). The regulatory element may be a DNaseI hypersensitive site (DHS). The DHS may be an inactive DHS or an active DHS. The regulatory element may be a polypeptide. The regulatory element may be chromatin.

The localization of a regulatory element may include contacting a regulatory element with a first set of detection agents, photobleaching the first set of detection agents for a first time point at a first wavelength to generate a second set of detection agents capable of generating a light at a second wavelength, detecting at least one burst generated by the second set of detection agents to generate a detection profile of the second set of detection agents, and analyzing the detection profile to determine the localization of the regulatory element.

A detection agent may comprise a detectable moiety that is capable of generating a light, and a probe portion that is capable of hybridizing to a target site on a regulatory element. Each detection agent within the first set of detection agents may have the same or a different detectable moiety. Each detection agent within the first set of detection agents may have the same detectable moiety. A detectable moiety may comprise a small molecule (e.g., a fluorescent dye). A detectable moiety may comprise a fluorescently labeled polypeptide, a fluorescently labeled nucleic acid probe, and/or a fluorescently labeled polypeptide complex.

Upon photobleaching, a second set of detection agents may be generated from the first set of detection agents, in which the second set may include detection agents that are capable of generating a burst of light detectable at a second wavelength. For example, bleaching of the set of detection agents may lead to about 50%, about 60%, about 70%, about 80%, about 90%, or more detection agents within the set to enter into an "OFF-state." An "OFF-state" may be a dark state in which the detectable moiety crosses from the singlet excited or "ON state" to the triplet state or "OFF-state" in which detection of light (e.g., fluorescence) may be low (e.g., less than 10%, less than 5%, less than 1%, or less than 0.5% of the light may be detected). The remainder of the detection agents that have not entered into the "OFF-state" may generate bursts of lights, or to cycle between a singlet excited state (or "ON-state") and a singlet ground state. As such, bleaching of the set of detection agents may generate about 40%, about 30%, about 20%, about 10%, about 5%, or less detection agents within the set that may generate bursts of lights. The bursts of lights may be detected stochastically, at a single burst level in which each burst of light correlates to a single detection agent.

A single wavelength may be used for photobleaching a set of detection agents. At least two wavelengths may be used for photobleaching a set of detection agents. A wavelength at 491 nm may be used. A wavelength at 405 nm may be used in combination with the wavelength at 491 nm. The two wavelengths may be applied simultaneously to photobleach a set of detection agents. Alternatively, the two wavelengths may be applied sequentially to photobleach a set of detection agents.

The time for photobleaching a set of detection agents may be from about 10 seconds to about 4 hours. The time may be from about 30 seconds to about 3.5 hours, from about one minute to about 3 hours, from about 5 minutes to about 2 hours, from about 10 minutes to about 1 hours, from about one minutes to about 1 hour, from about 5 minutes to about 1 hour, or from about 30 minutes to about 2 hours. The time may be at least 10 seconds, at least 20 seconds, at least 30 seconds, at least 40 seconds, at least 50 seconds, at least 1 minute, at least 2 minutes, at least 3 minutes, at least 4 minutes, at least 5 minutes, at least 10 minutes, at least 15 minutes, at least 20 minutes, at least 30 minutes, at least 45 minutes, at least 1 hour, at least 1.5 hours, at least 2 hours, at least 2.5 hours, at least 3 hours, at least 3.5 hours, at least 4 hours, or more.

The concentration of the detection agents may be from about 5 nM to about 1 µM. The concentration of the detection agent may be from about 5 nM to about 900 nM, from about 10 nM to about 800 nM, from about 15 nM to about 700 nM, from about 20 nM to about 500 nM, from about 10 nM to about 500 nM, from about 10 nM to about 400 nM, from about 10 nM to about 300 nM, from about 10 nM to about 200 nM, from about 10 nM to about 100 nM, from about 50 nM to about 500 nM, from about 50 nM to about 400 nM, from about 50 nM to about 300 nM, from about 50 nM to about 200 nM, from about 100 nM to about 500 nM, from about 100 nM to about 300 nM, or from about 100 nM to about 200 nM. The concentration of the detection agents may be about 10 nM, about 15 nM, about 20 nM, about 30 nM, about 40 nM, about 50 nM, about 60 nM, about 70 nM, about 80 nM, about 90 nM, about 100 nM, about 150 nM, about 200 nM, about 250 nM, about 300 nM, about 400 nM, about 500 nM, about 600 nM, about 700 nM, about 800 nM, about 900 nM, or more.

The burst of lights from the set of detection agents may generate a detection profile. The detection profile may comprise about 100 image frames, about 500 frames, about 1000 frames, about 2000 frames, about 5000 frames, about 10,000 frames, about 20,000 frames, about 30,000 frames, about 40,000 frames, about 50,000 frames, or more. The detection profile may also include the signal intensity, signal location, or size of the signal. Analysis of the detection profile may determine the optical isolation and localization of the detection agents, which may correlate to the localization of the regulatory element.

The detection profile may comprise a chromatic aberration correction. The detection profile may comprise less than 5%, less than 4%, less than 3%, less than 2%, less than 1%, less than 0.5%, less than 0.1%, or 0% chromatic aberration. The detection profile may comprise less than 5% chromatic aberration. The detection profile may comprise less than 4% chromatic aberration. The detection profile may comprise less than 3% chromatic aberration. The detection profile may comprise less than 2% chromatic aberration. The detection profile may comprise less than 1% chromatic aberration. The detection profile may comprise less than 0.5% chromatic aberration. The detection profile may comprise less than 0.1% chromatic aberration. The detection profile may comprise 0% chromatic aberration.

More than one regulatory element may be detected at the same time. At least 2, at least 3, at least 4, at least 5, at least 6, at least 7, at least 8, at least 9, at least 10, at least 15, at least 20, or more regulatory elements may be detected at the same time. Each of the regulatory elements may be detected by a set of detection agents. The detectable moiety between the different set of detection agents may be the same. For example, two different sets of detection agents may be used to detect two different regulatory elements and the detectable moieties from the two sets of detection agents may be the same. As such, at least 2, at least 3, at least 4, at least 5, at least 6, at least 7, at least 8, at least 9, at least 10, at least 15, at least 20, or more regulatory elements may be detected at the same time at the same wavelength. Sometimes, the detectable moiety between the different set of detection agents may also be different. For example, two different sets of detection agents may be used to detect two different regulatory elements and the detectable moiety from one set of detection agents may be detected at a different wavelength from the detectable moiety of the second set of detection agents. As such, at least 2, at least 3, at least 4, at least 5, at least 6, at least 7, at least 8, at least 9, at least 10, at least 15, at least 20, or more regulatory elements may be detected at the same time in which each of the regulatory elements may be detected at a different wavelength. The regulatory element may comprise DNA, RNA, polypeptides, or a combination thereof.

Methods of Measuring the Activity of a Regulatory Element

Also described herein is a method of measuring the activity of a target regulatory element. The method may include detection of a regulatory element and one or more products of the regulatory element. One or more products of the regulatory element may also include intermediate products or elements. The method may comprise contacting a cell sample with a first set and a second set of detection agents, in which the first set of detection agents interact with a target regulatory element within the cell and the second set of detection agents interact with at least one product of the target regulatory element, and analyzing a detection profile from the first set and the second set of detection agents, in which the presence or the absence of the at least one product indicates the activity of the target regulatory element.

As discussed herein, a detection agent may comprise a detectable moiety that is capable of generating a light, and a probe portion that is capable of hybridizing to a target site on a regulatory element. Each detection agent within the first set of detection agents may have the same or a different detectable moiety. Each detection agent within the first set of detection agents may have the same detectable moiety. A detectable moiety may comprise a small molecule (e.g., a fluorescent dye). A detectable moiety may comprise a fluorescently labeled polypeptide, a fluorescently labeled nucleic acid probe, and/or a fluorescently labeled polypeptide complex.

The method may also allow photobleaching of the first set and the second set of detection agents, thereby generating a subset of detection agents capable of generating a burst of light. A detection profile may be generated from the detection of a set of light bursts, in which the presence or the absence of the at least one product may indicate the activity of the target regulatory element.

The regulatory element may comprise DNA, RNA, polypeptides, or a combination thereof. The regulatory element may be DNA. The regulatory element may be RNA. The regulatory element may be an enhancer RNA (eRNA). The presence of an eRNA may correlate with target gene transcription that is downstream of eRNA. The regulatory element may be a DNaseI hypersensitive site (DHS). The DHS may be an activated DHS. The pattern of the DHS on a chromatin may correlate to the activity of the chromatin. The regulatory element may be a polypeptide, e.g., a transcription factor, a DNA or RNA-binding protein or binding fragment thereof, or a polypeptide that is involved in chemical modification. The regulatory element may be chromatin.

Target Nucleic Acid Sequence

A target nucleic acid sequence may be a nucleic acid sequence of interest or may encode a DNA, RNA, or protein of interest or a portion thereof. A DNA, RNA, or protein of interest may be a DNA, RNA, or protein produced by a cell or contained within a cell. A target nucleic acid sequence may be incorporated into a structure of a cell. A target nucleic acid sequence may also be associated with a cell. For example, a target nucleic acid sequence may be in contact with the exterior of a cell. A target nucleic acid sequence may be unassociated with a structure of a cell. For example, a target nucleic acid sequence may be a circulating nucleic acid sequence. A target nucleic acid sequence or a portion thereof may be artificially constructed or modified. A target nucleic acid sequence may be a natural biological product. A target nucleic acid sequence may be a short nucleic acid sequence. A target nucleic acid sequence may be a nucleic acid sequence that is from a source that is exogenous to a cell. A target nucleic acid sequence may be an endogenous nucleic acid sequence. A target nucleic acid sequence may be a nucleic acid sequence that comprises a combination of an endogenous nucleic acid sequence and a nucleic acid sequence from a source that is exogenous to a cell. A target nucleic acid sequence may be a chromosomal nucleic acid sequence or fragment thereof. A target nucleic acid sequence may be an episomal nucleic sequence or fragment thereof. A target nucleic acid sequence may be a sequence resulting from somatic rearrangement or somatic hypermutation, such as a nucleic acid sequence from a T cell receptor, B cell receptor, or fragment thereof.

A nucleic acid of a cell or sample, which may comprise the target nucleic acid sequence, may comprise a deoxyribonucleic acid (DNA) or a ribonucleic acid (RNA), or a combination thereof. A nucleic acid may be a chromosome, an oligonucleotide, a plasmid, an artificial chromosome, or a fragment or portion thereof. A nucleic acid may comprise genomic DNA, episomal DNA, complementary DNA, mitochondrial DNA, recombinant DNA, cell-free DNA (cfDNA), messenger RNA (mRNA), pre-mRNA, microRNA (miRNA), transfer RNA (tRNA), transfer messenger RNA (tmRNA), ribosomal RNA (rRNA), heterogeneous nuclear RNA (hnRNA), short interfering RNA (siRNA), anti-sense RNA, or short hairpin RNA (shRNA). A nucleic acid may be single-stranded, double-stranded, or a combination thereof.

A target nucleic acid sequence may comprise a naturally occurring nucleic acid sequence, an artificially constructed nucleic acid sequence (such as an artificially synthesized nucleic acid sequence), or a modified nucleic acid sequence (such as a naturally occurring nucleic acid sequence that has been altered or modified through a natural or artificial process).

A naturally occurring nucleic acid sequence may comprise a nucleic acid sequence present in a cellular sample. A naturally occurring nucleic acid sequence may comprise a nucleic acid sequence present in an unfixed cell. A naturally occurring nucleic acid sequence may comprise a nucleic acid sequence derived from a cellular sample. A nucleic acid sequence may also be derived from a virus (such as a viral nucleic acid sequence from a lentivirus or adenovirus).

A naturally occurring nucleic acid sequence may comprise a nucleic acid sequence present in an acellular sample. A naturally occurring nucleic acid sequence may comprise a nucleic acid sequence derived from an acellular sample. For example, a nucleic acid sequence may be a cell-free DNA sequence present in a bodily fluid (such as a sample of cerebrospinal fluid).

A nucleic acid may comprise a target nucleic acid sequence that is not endogenous to the source (exogenous) from which it was taken or in which it is analyzed.

A nucleic acid may be an artificially synthesized oligonucleotide.

A nucleic acid sequence may comprise one or more modifications. A modification may be a post-translational modification of a nucleic acid sequence or an epigenetic modification of nucleic acid sequence (e.g., modification to the methylation of a nucleic acid sequence). A modification may be a genetic modification. A genetic modification to a nucleic acid sequence may be an insertion, a deletion, or a substitution of a nucleic acid sequence. A nucleic acid sequence modification may comprise an insertion may comprise transformation, transduction, or transfection of a sample. For example, a nucleic acid sequence modification comprising an insertion may result from infection or transduction of a cell with a virus and subsequent incorporation of a viral nucleic acid sequence into a nucleic acid sequence of the cells, such as the cell's genomic DNA. The integrated viral nucleic acid sequence (viral integrant) or fragment thereof may be the target nucleic acid sequence. Modification of a nucleic acid sequence may be an artificial modification, resulting from, for instance, genetic engineering or intentional nucleic acid sequence modification during nucleic acid fabrication. A nucleic acid sequence may be the result of somatic rearrangement.

A modification to a nucleic acid sequence comprising an insertion, deletion or substitution may comprise a difference between the nucleic acid sequence and a reference sequence. A reference sequence may be a nucleic acid sequence in a database, an artificial nucleic acid, a viral nucleic acid sequence, a nucleic acid sequence of the same cell, a nucleic acid sequence of a cell from the tissue, a nucleic acid sequence from a different tissue of the same subject, or a nucleic acid sequence from a subject of a different species.

A modification to a nucleic acid sequence may comprise a difference in 1 nucleotide (a single nucleotide polymorphism, SNP), at least 2 nucleotides, at least 3 nucleotides, at least 4 nucleotides, at least 5 nucleotides, at least 6 nucleotides, at least 7 nucleotides, at least 8 nucleotides, at least 9 nucleotides, at least 10 nucleotides, at least 25 nucleotides, at least 50 nucleotides, at least 100 nucleotides, at least 250 nucleotides, at least 500 nucleotides, at least 1,000 nucleotides, from 1 to 1,000 nucleotides, from 1 to 500 nucleotides, from 1 to 250 nucleotides, from 1 to 100 nucleotides, from 1 to 50 nucleotides, from 1 to 25 nucleotides, from 1 to 10 nucleotides, from 1 to 9 nucleotides, from 1 to 8 nucleotides, from 1 to 7 nucleotides, from 1 to 6 nucleotides, from 1 to 5 nucleotides, from 1 to 4 nucleotides, from 1 to 3 nucleotides, or from 1 to 2 nucleotides. Modification to a nucleic acid sequence comprising a difference in a plurality of nucleotides may comprise differences in two or more adjacent nucleotides or nucleotide sequences relative to a reference nucleic acid sequence. Modifications to a nucleic acid sequence comprising a difference in a plurality of nucleotides may also comprise differences in two or more non-adjacent nucleotides or nucleotide sequences (such as two or more modifications to the nucleic acid sequence that are separated by at least one nucleotide) relative to a reference nucleic acid sequence.

A target sequence may be assayed in situ or it may be isolated and/or purified from a cellular or acellular sample. For example, a target sequence comprising a nucleic acid may comprise a portion (a region) of genomic DNA located in situ in the nucleus of a fixed (intact) cell. A target sequence may comprise a nucleic acid sequence that is isolated from a sample (such as an aliquot of cerebrospinal fluid).

A. Target Viral Nucleic Acid Sequence

A target nucleic acid sequence may comprise a viral nucleic acid sequence or a portion thereof. In some embodiments, "portion" can also be referred to herein as a "fragment." A portion of a viral nucleic acid sequence can be a segment of the full viral nucleic acid sequence. A portion of a viral nucleic acid sequence can be multiple segments from the full viral nucleic acid sequence, which have been stitched together. A viral nucleic acid sequence may comprise a nucleic acid sequence that is a naturally occurring viral nucleic acid sequence. For example, a viral nucleic acid sequence may comprise an unaltered viral nucleic acid sequence from a virus in nature.

A viral nucleic acid sequence may comprise a viral nucleic acid sequence that is not native to a viral nucleic acid found in nature. A viral nucleic acid sequence may be an artificial nucleic acid sequence. In some cases, a viral nucleic acid sequence may comprise a naturally occurring viral nucleic acid sequence that has been modified artificially. For example, a viral nucleic acid sequence may comprise a naturally occurring viral nucleic acid sequence to which at least one nucleotide has been added, removed, substituted or modified.

A viral nucleic acid sequence may comprise a DNA sequence or an RNA sequence.

A viral nucleic acid sequence may be a part of another nucleic acid sequence (such as an integrated viral nucleic acid sequence) or it may be unintegrated (such as a viral nucleic acid sequence of in a virally infected cell prior to integration of the viral nucleic acid sequence into a nucleic acid of the cell). An unintegrated viral nucleic acid sequence may comprise a naturally occurring or artificial viral nucleic acid sequence.

A viral nucleic acid sequence may comprise one or more nucleotide that is not native to viral nucleic acid. For example, a viral nucleic acid sequence may be modified using genetic engineering techniques.

A viral nucleic acid sequence may be greater than about 1 kilobase (kb) in length, greater than about 1.5 kb in length, greater than about 2 kb in length, greater than about 2.5 kb in length, greater than about 3 kb in length, greater than about 3.5 kb in length, greater than about 4 kb in length, greater than about 4.5 kb in length, greater than about 5 kb in length, greater than about 6 kb in length, greater than about 7 kb in length, greater than about 8 kb in length, greater than about 9 kb in length, greater than about 10 kb in length, greater than about 30 kb in length, greater than about 50 kb in length, greater than about 100 kb in length, greater than about 1000 kb in length, or greater than about 2000 kb in length.

A viral nucleic acid sequence may be from about 1 kb in length to about 2 kb in length, from about 1.5 kb in length to about 2.5 kb in length, from about 2 kb in length to about 3 kb in length, from about 2.5 kb in length to about 3.5 kb in length, from about 3 kb in length to about 4 kb in length, from about 3.5 kb in length to about 4.5 kb in length, from about 4 kb in length to about 5 kb in length, from about 5 kb in length to about 6 kb in length, from about 6 kb in length to about 7 kb in length, from about 7 kb in length to about 8 kb in length, from about 8 kb in length to about 9 kb in length, from about 9 kb in length to about 10 kb in length, from about 10 kb in length to about 30 kb in length, from about 30 kb in length to about 50 kb in length, from about 50 kb in length to about 100 kb in length, from about 100 kb in length to about 1000 kb in length, or from about 1000 kb in length to about 2000 kb in length in length.

A viral nucleic acid sequence may be a portion of a larger nucleic acid sequence. For example, a viral nucleic acid sequence may be inserted into a genomic DNA sequence (such as by viral infection or artificial genome editing).

A viral nucleic acid may comprise a gene or a non-coding region of a nucleic acid. A target sequence may comprise a cis-regulatory element, such as an enhancer, a promoter, a portion of a promoter (such as a minimal promoter), a silencer, an insulator, or a locus control region. A target sequence may also comprise a cis-regulatory element that is not endogenous to the cell or sample. For example, a target sequence may comprise a viral minimal promoter sequence, a viral gene, or a combination thereof.

A viral sequence may be assayed in situ or it may be isolated and/or purified from a cellular or acellular sample. For example, a target sequence comprising a nucleic acid may comprise a portion (a region) of genomic DNA located in situ in the nucleus of a fixed cell. A target sequence may comprise a nucleic acid sequence that is isolated from a sample (such as an aliquot of cerebrospinal fluid).

A viral sequence may be assayed in situ or it may be isolated and/or purified from a cellular or acellular sample. For example, a target sequence comprising a nucleic acid may comprise a portion (a region) of genomic DNA located in situ in the nucleus of a fixed cell. A target sequence may comprise a nucleic acid sequence that is isolated from a sample (such as an aliquot of cerebrospinal fluid).

A viral nucleic acid sequence may be from a virus. A viral nucleic acid sequence may be from a lentivirus, an adenovirus, an adeno-associated virus, or a retrovirus. A viral nucleic acid sequence may be from a lentivirus vector, an adenovirus vector, an adeno-associated virus vector, or a retrovirus vector. A lentivirus may comprise a nucleic acid sequence with at least 80%, 85%, 90%, 95%, 98%, 99%, or 100% homology to SEQ ID NO: 1282, or a fragment thereof. A viral nucleic acid sequence may be from HIV. A viral nucleic acid sequence may be from an HIV vector. HIV may comprise a nucleic acid sequence with at least 80%, 85%, 90%, 95%, 98%, 99%, or 100% homology to SEQ ID NO: 1283, or a fragment thereof. A viral nucleic acid sequence may be from a p virus.

TABLE 1

Lentivirus and HIV Nucleic Acid Sequences

| SEQ ID NO | Sequence |
|---|---|
| SEQ ID NO: 1282 | GTCGACGGATCGGGAGATCTCCCGATCCCCTATGGTGCACTCTCAGTACAATCTG CTCTGATGCCGCATAGTTAAGCCAGTATCTGCTCCCTGCTTGTGTGTTGGAGGTCG CTGAGTAGTGCGCGAGCAAAATTTAAGCTACAACAAGGCAAGGCTTGACCGACA ATTGCATGAAGAATCTGCTTAGGGTTAGGCGTTTTGCGCTGCTTCGCGATGTACG |

TABLE 1-continued

Lentivirus and HIV Nucleic Acid Sequences

| SEQ ID NO | Sequence |
|---|---|
| | GGCCAGATATACGCGTTGACATTGATTATTGACTAGTTATTAATAGTAATCAATTA<br>CGGGGTCATTAGTTCATAGCCCATATATGGAGTTCCGCGTTACATAACTTACGGT<br>AAATGGCCCGCCTGGCTGACCGCCCAACGACCCCCGCCCATTGACGTCAATAATG<br>ACGTATGTTCCCATAGTAACGCCAATAGGGACTTTCCATTGACGTCAATGGGTGG<br>AGTATTTACGGTAAACTGCCCACTTGGCAGTACATCAAGTGTATCATATGCCAAG<br>TACGCCCCCTATTGACGTCAATGACGGTAAATGGCCCGCCTGGCATTATGCCCAG<br>TACATGACCTTATGGGACTTTCCTACTTGGCAGTACATCTACGTATTAGTCATCGC<br>TATTACCATGGTGATGCGGTTTTGGCAGTACATCAATGGGCGTGGATAGCGGTTT<br>GACTCACGGGGATTTCCAAGTCTCCACCCCATTGACGTCAATGGGAGTTTGTTTTG<br>GCACCAAAATCAACGGGACTTTCCAAAATGTCGTAACAACTCCGCCCCATTGACG<br>CAAATGGGCGGTAGGCGTGTACGGTGGGAGGTCTATATAAGCAGCGCGTTTTGCC<br>TGTACTGGGTCTCTCTGGTTAGACCAGATCTGAGCCTGGGAGCTCTCTGGCTAACT<br>AGGGAACCCACTGCTTAAGCCTCAATAAAGCTTGCCTTGAGTGCTTCAAGTAGTG<br>TGTGCCCGTCTGTTGTGTGACTCTGGTAACTAGAGATCCCTCAGACCCTTTTAGTC<br>AGTGTGTGAAAATCTCTAGCAGTGGCGCCCGAACAGGGACTTGAAAGCGAAAGGG<br>AAACCAGAGGAGCTCTCTCGACGCAGGACTCGGCTTGCTGAAGCGCGCACGGCA<br>AGAGGCGAGGGGCGGCGACTGGTGAGTACGCCAAAAATTTTGACTAGCGGAGGC<br>TAGAAGGAGAGAGATGGGTGCGAGAGCGTCAGTATTAAGCGGGGGAGAATTAGA<br>TCGCGATGGGAAAAATTCGGTTAAGGCCAGGGGGAAAGAAAAAATATAAATTA<br>AAACATATAGTATGGGCAAGCAGGGAGCTAGAACGATTCGCAGTTAATCCTGGC<br>CTGTTAGAAACATCAGAAGGCTGTAGACAAATACTGGGACAGCTACAACCATCCC<br>TTCAGACAGGATCAGAAGAACTTAGATCATTATATAATACAGTAGCAACCCTCTA<br>TTGTGTGCATCAAAGGATAGAGATAAAAGACACCAAGGAAGCTTTAGACAAGAT<br>AGAGGAAGAGCAAAACAAAAGTAAGACCACCGCACAGCAAGCGGCCGCTGATCT<br>TCAGACCTGGAGGAGGAGATATGAGGGACAATTGGAGAAGTGAATTATATAAAT<br>ATAAAGTAGTAAAAATTGAACCATTAGGAGTAGCACCCACCAAGGCAAAGAGAA<br>GAGTGGTGCAGAGAGAAAAAAGAGCAGTGGGAATAGGAGCTTTGTTCCTTGGGT<br>TCTTGGGAGCAGCAGGAAGCACTATGGGCGCAGCGTCAATGACGCTGACGGTAC<br>AGGCCAGACAATTATTGTCTGGTATAGTGCAGCAGCAGAACAATTTGCTGAGGGC<br>TATTGAGGCGCAACAGCATCTGTTGCAACTCACAGTCTGGGGCATCAAGCAGCTC<br>CAGGCAAGAATCCTGGCTGTGGAAAGATACCTAAAGGATCAACAGCTCCTGGGG<br>ATTTGGGGTTGCTCTGGAAAACTCATTTGCACCACTGCTGTGCCTTGGAATGCTAG<br>TTGGAGTAATAAATCTCTGGAACAGATTTGGAATCACACGACCTGGATGGAGTGG<br>GACAGAGAAATTAACAATTACACAAGCTTAATACACTCCTTAATTGAAGAATCGC<br>AAAACCAGCAAGAAAAGAATGAACAAGAATTATTGGAATTAGATAAATGGGCAA<br>GTTTGTGGAATTGGTTTAACATAACAAATTGGCTGTGGTATATAAAATTATTCATA<br>ATGATAGTAGGAGGCTTGGTAGGTTTAAGAATAGTTTTTGCTGTACTTTCTATAGT<br>GAATAGAGTTAGGCAGGGATATTCACCATTATCGTTTCAGACCCACCTCCCAACC<br>CCGAGGGGACCCGACAGGCCCGAAGGAATAGAAGAAGAAGGTGGAGAGAGAGA<br>CAGAGACAGATCCATTCGATTAGTGAACGGATCGGCACTGCGTGCGCCAATTCTG<br>CAGACAAATGGCAGTATTCATCCACAATTTTAAAAGAAAAGGGGGGATTGGGGG<br>GTACAGTGCAGGGGAAAGAATAGTAGACATAATAGCAACAGACATACAAACTAA<br>AGAATTACAAAAACAAATTACAAAAATTCAAAATTTTCGGGTTTATTACAGGGAC<br>AGCAGAGATCCAGTTTGGTTAATTAGCTAGCTAGGTCTTGAAAGGAGTGGGAATT<br>GGCTCCGGTGCCCGTCAGTGGGCAGAGCGCACATCGCCCACAGTCCCCGAGAAGT<br>TGGGGGGAGGGGTCGGCAATTGATCCGGTGCCTAGAGAAGGTGGCGCGGGGTAA<br>ACTGGGAAAGTGATGTCGTGTACTGGCTCCGCCTTTTTCCCGAGGGTGGGGGAGA<br>ACCGTATATAAGTGCAGTAGTCGCCGTGAACGTTCTTTTTCGCAACGGGTTTGCCG<br>CCAGAACACAGGACCGGTTCTAGAGCGCTGCCACCAAGCGACCTGCCGCCACAA<br>AGAAGGCTGGACAGGCTAAGAAGAAGAAAGATTACAAAGACGATGACGATAAG<br>GGATCCGGCGCAACAAACTTCTCTCTGCTGAAACAAGCCGGAGATGTCGAAGAG<br>AATCCTGGACCGATGGCCAAGCCTTTGTCTCAAGAAGAATCCACCCTCATTGAAA<br>GAGCAACGGCTACAATCAACAGCATCCCCATCTCTGAAGACTACAGCGTCGCCAG<br>CGCAGCTCTCTCTAGCGACGGCCGCATCTTCACTGGTGTCAATGTATATCATTTTA<br>CTGGGGGACCTTGTGCAGAACTCGTGGTGCTGGGCACTGCTGCTGCTGCGGCAGC<br>TGGCAACCTGACTTGTATCGTCGCGATCGGAAATGAGAACAGGGGCATCTTGAGC<br>CCCTGCGGACGGTGCCGACAGGTGCTTCTCGATCTGCATCCTGGGATCAAAGCCA<br>TAGTGAAGGACAGTGATGGACAGCCGACGGCAGTTGGGATTCGTGAATTGCTGCC<br>CTCTGGTTATGTGTGGGAGGGCTAAGAATTCGATATCAAGCTTATCGGTAATCAA<br>CCTCTGGATTACAAAATTTGTGAAAGATTGACTGGTATTCTTAACTATGTTGCTCC<br>TTTTACGCTATGTGGATACGCTGCTTTAATGCCTTTGTATCATGCTATTGCTTCCCG<br>TATGCTTTCATTTTCTCCTCCTTGTATAAATCCTGGTTGCTGTCTCTTTATGAGGA<br>GTTGTGGCCCGTTGTCAGGCAACGTGGCGTGGTGTGCACTGTGTTTGCTGACGCA<br>ACCCCCACTGGTTGGGGCATTGCCACCACCTGTCAGCTCCTTTCCGGGACTTTCGC<br>TTTCCCCCTCCCTATTGCCACGGCGGAACTCATCGCCGCCTGCCTTGCCCGCTGCT<br>GGACAGGGGCTCGGCTGTTGGGCACTGACAATTCCGTGGTGTTGTCGGGGAAATC<br>ATCGTCCTTTCCTTGGCTGCTCGCCTGTGTTGCCACCTGGATTCTGCGCGGGACGT<br>CCTTCTGCTACGTCCCTTCGGCCCTCAATCCAGCGGACCTTCCTTCCCGCGGCCTG<br>CTGCCGGCTCTGCGGCCTCTTCCGCGTCTTCGCCTTCGCCCTCAGACGAGTCGGAT<br>CTCCCTTTGGGCCGCCTCCCCGCATCGATACCGTCGACCTCGAGACCTAGAAAAA<br>CATGGAGCAATCACAAGTAGCAATACAGCAGCTACCAATGCTGATTGTGCCTGGC<br>TAGAAGCACAAGAGGAGGAGGAGGTGGGTTTTCCAGTCACACCTCAGGTACCTTT<br>AAGACCAATGACTTACAAGGCAGCTGTAGATCTTAGCCACTTTTTAAAAGAAAAG<br>GGGGGACTGGAAGGGCTAATTCACTCCCAACGAAGACAAGATATCCTTGATCTGT |

TABLE 1-continued

Lentivirus and HIV Nucleic Acid Sequences

| SEQ ID NO | Sequence |
|---|---|
| | GGATCTACCACACACAAGGCTACTTCCCTGATTGGCAGAACTACACACCAGGGCC
AGGGATCAGATATCCACTGACCTTTGGATGGTGCTACAAGCTAGTACCAGTTGAG
CAAGAGAAGGTAGAAGAAGCCAATGAAGGAGAGAACACCCGCTTGTTACACCCT
GTGAGCCTGCATGGGATGGATGACCCGGAGAGAGAAGTATTAGAGTGGAGGTTT
GACAGCCGCCTAGCATTTCATCACATGGCCCGAGAGCTGCATCCGGACTGTACTG
GGTCTCTCTGGTTAGACCAGATCTGAGCCTGGGAGCTCTCTGGCTAACTAGGGAA
CCCACTGCTTAAGCCTCAATAAAGCTTGCCTTGAGTGCTTCAAGTAGTGTGTGCCC
GTCTGTTGTGTGACTCTGGTAACTAGAGATCCCTCAGACCCTTTTAGTCAGTGTGG
AAAATCTCTAGCAGGGCCCGTTTAAACCCGCTGATCAGCCTCGACTGTGCCTTCT
AGTTGCCAGCCATCTGTTGTTTGCCCCTCCCCCGTGCCTTCCTTGACCCTGGAAGG
TGCCACTCCCACTGTCCTTTCCTAATAAAATGAGGAAATTGCATCGCATTGTCTGA
GTAGGTGTCATTCTATTCTGGGGGGTGGGGTGGGGCAGGACAGCAAGGGGGAGG
ATTGGGAAGACAATAGCAGGCATGCTGGGGATGCGGTGGGCTCTATGGCTTCTGA
GGCGGAAAGAACCAGCTGGGGCTCTAGGGGGTATCCCCACGCGCCCTGTAGCGG
CGCATTAAGCGCGGCGGGTGTGGTGGTTACGCGCAGCGTGACCGCTACACTTGCC
AGCGCCCTAGCGCCCGCTCCTTTCGCTTTCTTCCCTTCCTTTCTCGCCACGTTCGCC
GGCTTTCCCCGTCAAGCTCTAAATCGGGGGCTCCCTTTAGGGTTCCGATTTAGTGC
TTTACGGCACCTCGACCCCAAAAAACTTGATTAGGGTGATGGTTCACGTAGTGGG
CCATCGCCCTGATAGACGGTTTTTCGCCCTTTGACGTTGGAGTCCACGTTCTTTAA
TAGTGGACTCTTGTTCCAAACTGGAACAACACTCAACCCTATCTCGGTCTATTCTT
TTGATTTATAAGGGATTTTGCCGATTTCGGCCTATTGGTTAAAAAATGAGCTGATT
TAACAAAAATTTAACGCGAATTAATTCTGTGGAATGTGTGTCAGTTAGGGTGTGG
AAAGTCCCCAGGCTCCCCAGCAGGCAGAAGTATGCAAAGCATGCATCTCAATTAG
TCAGCAACCAGGTGTGGAAAGTCCCCAGGCTCCCCAGCAGGCAGAAGTATGCAA
AGCATGCATCTCAATTAGTCAGCAACCATAGTCCCGCCCCTAACTCCGCCCATCC
CGCCCCTAACTCCGCCCAGTTCCGCCCATTCTCCGCCCCATGGCTGACTAATTTTT
TTTATTTATGCAGAGGCCGAGGCCGCCTCTGCCTCTGAGCTATTCCAGAAGTAGT
GAGGAGGCTTTTTTGGAGGCCTAGGCTTTTGCAAAAAGCTCCCGGGAGCTTGTAT
ATCCATTTTCGGATCTGATCAGCACGTGTTGACAATTAATCATCGGCATAGTATAT
CGGCATAGTATAATACGACAAGGTGAGGAACTAAACCATGGCCAAGTTGACCAG
TGCCGTTCCGGTGCTCACCGCGCGCGACGTCGCCGGAGCGGTCGAGTTCTGGACC
GACCGGCTCGGGTTCTCCCGGGACTTCGTGGAGGACGACTTCGCCGGTGTGGTCC
GGGACGACGTGACCCTGTTCATCAGCGCGGTCCAGGACCAGGTGGTGCCGGACA
ACACCCTGGCCTGGGTGTGGGTGCGCGGCCTGGACGAGCTGTACGCCGAGTGGTC
GGAGGTCGTGTCCACGAACTTCCGGGACGCCTCCGGGCCGGCCATGACCGAGATC
GGCGAGCAGCCGTGGGGGCGGGAGTTCGCCCTGCGCGACCCGGCCGGCAACTGC
GTGCACTTCGTGGCCGAGGAGCAGGACTGACACGTGCTACGAGATTTCGATTCCA
CCGCCGCCTTCTATGAAAGGTTGGGCTTCGGAATCGTTTTCCGGGACGCCGGCTG
GATGATCCTCCAGCGCGGGGATCTCATGCTGGAGTTCTTCGCCCACCCCAACTTGT
TTATTGCAGCTTATAATGGTTACAAATAAAGCAATAGCATCCAAATTTCACAAA
TAAAGCATTTTTTTCACTGCATTCTAGTTGTGGTTTGTCCAAACTCATCAATGTAT
CTTATCATGTCTGTATACCGTCGACCTCTAGCTAGAGCTTGGCGTAATCATGGTCA
TAGCTGTTTCCTGTGTGAAATTGTTATCCGCTCACAATTCCACACAACATACGAGC
CGGAAGCATAAAGTGTAAAGCCTGGGGTGCCTAATGAGTGAGCTAACTCACATTA
ATTGCGTTGCGCTCACTGCCCGCTTTCCAGTCGGGAAACCTGTCGTGCCAGCTGCA
TTAATGAATCGGCCAACGCGCGGGGAGAGGCGGTTTGCGTATTGGGCGCTCTTCC
GCTTCCTCGCTCACTGACTCGCTGCGCTCGGTCGTTCGGCTGCGGCGAGCGGTATC
AGCTCACTCAAAGGCGGTAATACGGTTATCCACAGAATCAGGGGATAACGCAGG
AAAGAACATGTGAGCAAAAGGCCAGCAAAAGGCCAGGAACCGTAAAAAGGCCG
CGTTGCTGGCGTTTTTCCATAGGCTCCGCCCCCCTGACGAGCATCACAAAAATCG
ACGCTCAAGTCAGAGGTGGCGAAACCCGACAGGACTATAAAGATACCAGGCGTT
TCCCCCTGGAAGCTCCCTCGTGCGCTCTCCTGTTCCGACCCTGCCGCTTACCGGAT
ACCTGTCCGCCTTTCTCCCTTCGGGAAGCGTGGCGCTTTCTCATAGCTCACGCTGT
AGGTATCTCAGTTCGGTGTAGGTCGTTCGCTCCAAGCTGGGCTGTGTGCACGAAC
CCCCCGTTCAGCCCGACCGCTGCGCCTTATCCGGTAACTATCGTCTTGAGTCCAAC
CCGGTAAGACACGACTTATCGCCACTGGCAGCAGCCACTGGTAACAGGATTAGCA
GAGCGAGGTATGTAGGCGGTGCTACAGAGTTCTTGAAGTGGTGGCCTAACTACGG
CTACACTAGAAGAACAGTATTTGGTATCTGCGCTCTGCTGAAGCCAGTTACCTTC
GGAAAAAGAGTTGGTAGCTCTTGATCCGGCAAACAAACCACCGCTGGTAGCGGT
GGTTTTTTTGTTTGCAAGCAGCAGATTACGCGCAGAAAAAAAGGATCTCAAGAAG
ATCCTTTGATCTTTTCTACGGGGTCTGACGCTCAGTGGAACGAAAACTCACGTTAA
GGGATTTTGGTCATGAGATTATCAAAAAGGATCTTCACCTAGATCCTTTTAAATTA
AAAATGAAGTTTTAAATCAATCTAAAGTATATATGAGTAAACTTGGTCTGACAGT
TACCAATGCTTAATCAGTGAGGCACCTATCTCAGCGATCTGTCTATTTCGTTCATC
CATAGTTGCCTGACTCCCCGTCGTGTAGATAACTACGATACGGGAGGGCTTACCA
TCTGGCCCCAGTGCTGCAATGATACCGCGAGACCCACGCTCACCGGCTCCAGATT
TATCAGCAATAAACCAGCCAGCCGGAAGGGCCGAGCGCAGAAGTGGTCCTGCAA
CTTTATCCGCCTCCATCCAGTCTATTAATTGTTGCCGGGAAGCTAGAGTAAGTAGT
TCGCCAGTTAATAGTTTGCGCAACGTTGTTGCCATTGCTACAGGCATCGTGGTGTC
ACGCTCGTCGTTTGGTATGGCTTCATTCAGCTCCGGTTCCCAACGATCAAGGCGA
GTTACATGATCCCCCATGTTGTGCAAAAAAGCGGTTAGCTCCTTCGGTCCTCCGAT
CGTTGTCAGAAGTAAGTTGGCCGCAGTGTTATCACTCATGGTTATGGCAGCACTG
CATAATTCTCTTACTGTCATGCCATCCGTAAGATGCTTTTCTGTGACTGGTGAGTA
CTCAACCAAGTCATTCTGAGAATAGTGTATGCGGCGACCGAGTTGCTCTTGCCCG |

TABLE 1-continued

Lentivirus and HIV Nucleic Acid Sequences

| SEQ ID NO | Sequence |
|---|---|
| | GCGTCAATACGGGATAATACCGCGCCACATAGCAGAACTTTAAAAGTGCTCATCA<br>TTGGAAAACGTTCTTCGGGGCGAAAACTCTCAAGGATCTTACCGCTGTTGAGATC<br>CAGTTCGATGTAACCCACTCGTGCACCCAACTGATCTTCAGCATCTTTTACTTTCA<br>CCAGCGTTTCTGGGTGAGCAAAAACAGGAAGGCAAAATGCCGCAAAAAAGGGAA<br>TAAGGGCGACACGGAAATGTTGAATACTCATACTCTTCCTTTTTCAATATTATTGA<br>AGCATTTATCAGGGTTATTGTCTCATGAGCGGATACATATTTGAATGTATTTAGAA<br>AAATAAACAAATAGGGGTTCCGCGCACATTTCCCCGAAAAGTGCCACCTGAC |
| SEQ ID NO: 1283 | GGTCTCTCTGGTTAGACCAGATCTGAGCCTGGGAGCTCTCTGGCTAACTAGGGAA<br>CCCACTGCTTAAGCCTCAATAAAGCTTGCCTTGAGTGCTTCAAGTAGTGTGTGCCC<br>GTCTGTTGTGTGACTCTGGTAACTAGAGATCCCTCAGACCCTTTTAGTCAGTGTGG<br>AAAATCTCTAGCAGTGGCGCCCGAACAGGGACCTGAAAGCGAAAGGGAAACCAG<br>AGGAGCTCTCTCGACGCAGGACTCGGCTTGCTGAAGCGCGCACGGCAAGAGGCG<br>AGGGGCGGCGACTGGTGAGTACGCCAAAAATTTTGACTAGCGGAGGCTAGAAGG<br>AGAGAGATGGGTGCGAGAGCGTCAGTATTAAGCGGGGGAGAATTAGATCGATGG<br>GAAAAAATTCGGTTAAGGCCAGGGGGAAAGAAAAAATATAAATTAAAACATATA<br>GTATGGGCAAGCAGGGAGCTAGAACGATTCGCAGTTAATCCTGGCCTGTTAGAAA<br>CATCAGAAGGCTGTAGACAAATACTGGGACAGCTACAACCATCCCTTCAGACAG<br>GATCAGAAGAACTTAGATCATTATATAATACAGTAGCAACCCTCTATTGTGTGCA<br>TCAAAGGATAGAGATAAAAGACACCAAGGAAGCTTTAGACAAGATAGAGGAAG<br>AGCAAAACAAAAGTAAGAAAAAAGCACAGCAAGCAGCAGCTGACACAGGACAC<br>AGCAATCAGGTCAGCCAAAATTACCCTATAGTGCAGAACATCCAGGGGCAAATG<br>GTACATCAGGCCATATCACCTAGAACTTTAAATGCATGGGTAAAAGTAGTAGAAG<br>AGAAGGCTTTCAGCCCAGAAGTGATACCCATGTTTTCAGCATTATCAGAAGGAGC<br>CACCCCACAAGATTTAAACACCATGCTAAACACAGTGGGGGGACATCAAGCAGC<br>CATGCAAATGTTAAAAGAGACCATCAATGAGGAAGCTGCAGAATGGGATAGAGT<br>GCATCCAGTGCATGCAGGGCCTATTGCACCAGGCCAGATGAGAGAACCAAGGGG<br>AAGTGACATAGCAGGAACTACTAGTACCCTTCAGGAACAAATAGGATGGATGAC<br>AAATAATCCACCTATCCCAGTAGGAGAAATTTATAAAAGATGGATAATCCTGGGA<br>TTAAATAAAATAGTAAGAATGTATAGCCCTACCAGCATTCTGGACATAAGACAAG<br>GACCAAAGGAACCCTTTAGAGACTATGTAGACCGGTTCTATAAAACTCTAAGAGC<br>CGAGCAAGCTTCACAGGAGGTAAAAAATTGGATGACAGAAACCTTGTTGGTCCA<br>AAATGCGAACCCAGATTGTAAGACTATTTTAAAAGCATTGGGACCAGCGGCTACA<br>CTAGAAGAAATGATGACAGCATGTCAGGGAGTAGGAGGACCCGGCCATAAGGCA<br>AGAGTTTTGGCTGAAGCAATGAGCCAAGTAACAAATTCAGCTACCATAATGATGC<br>AGAGAGGCAATTTTAGGAACCAAAGAAAGATTGTTAAGTGTTTCAATTGTGGCAA<br>AGAAGGGCACACAGCCAGAAATTGCAGGGCCCCTAGGAAAAAGGGCTGTTGGAA<br>ATGTGGAAGGAAGGACACCAAATGAAAGATTGTACTGAGAGACAGGCTAATTT<br>TTTAGGGAAGATCTGGCCTTCCTACAAGGGAAGGCCAGGGAATTTTCTTCAGAGC<br>AGACCAGAGCCAACAGCCCCACCAGAAGAGAGCTTCAGGTCTGGGGTAGAGACA<br>ACAACTCCCCCTCAGAAGCAGGAGCCGATAGACAAGGAACTGTATCCTTTAACTT<br>CCCTCAGGTCACTCTTTGGCAACGACCCCTCGTCACAATAAAGATAGGGGGGCAA<br>CTAAAGGAAGCTCTATTAGATACAGGAGCAGATGATACAGTATTAGAAGAAATG<br>AGTTTGCCAGGAAGATGGAAACCAAAAATGATAGGGGGAATTGGAGGTTTTATC<br>AAAGTAAGACAGTATGATCAGATACTCATAGAAATCTGTGGACATAAAGCTATA<br>GGTACAGTATTAGTAGGACCTACACCTGTCAACATAATTGGAAGAAATCTGTTGA<br>CTCAGATTGGTTGCACTTTAAATTTTCCCATTAGCCCTATTGAGACTGTACCAGTA<br>AAATTAAAGCCAGGAATGGATGGCCCAAAAGTTAAACAATGGCCATTGACAGAA<br>GAAAAAATAAAAGCATTAGTAGAAATTTGTACAGAGATGGAAAAGGAAGGGAA<br>AATTTCAAAAATTGGGCCTGAAAATCCATACAATACTCCAGTATTTGCCATAAAG<br>AAAAAAGACAGTACTAAATGGAGAAAATTAGTAGATTTCAGAGAACTTAATAAG<br>AGAACTCAAGACTTCTGGGAAGTTCAATTAGGAATACCACATCCCGCAGGGTTAA<br>AAAAGAAAAAATCAGTAACAGTACTGGATGTGGGTGATGCATATTTTTCAGTTCC<br>CTTAGATGAAGACTTCAGGAAGTATACTGCATTTACCATACCTAGTATAAACAAT<br>GAGACACCAGGGATTAGATATCAGTACAATGTGCTTCCACAGGGATGGAAAGGA<br>TCACCAGCAATATTCCAAAGTAGCATGACAAAAATCTTAGAGCCTTTTAGAAAAC<br>AAAATCCAGACATAGTTATCTATCAATACATGGATGATTTGTATGTAGGATCTGA<br>CTTAGAAATAGGGCAGCATAGAACAAAAATAGAGGAGCTGAGACAACATCTGTT<br>GAGGTGGGGACTTACCACACCAGACAAAAAACATCAGAAAGAACCTCCATTCCT<br>TTGGATGGGTTATGAACTCCATCCTGATAAATGGACAGTACAGCCTATAGTGCTG<br>CCAGAAAAAGACAGCTGGACTGTCAATGACATACAGAAGTTAGTGGGAAATTG<br>AATTGGGCAAGTCAGATTTACCCAGGGATTAAAGTAAGGCAATTATGTAAACTCC<br>TTAGAGGAACCAAAGCACTAACAGAAGTAATACCACTAACAGAAGAAGCAGAGC<br>TAGAACTGGCAGAAAACAGAGAGATTCTAAAAGAACCAGTACATGGAGTGTATT<br>ATGACCCATCAAAAGACTTAATAGCAGAAATACAGAAGCAGGGGCAAGGCCAAT<br>GGACATATCAAATTTATCAAGAGCCATTTAAAAATCTGAAAACAGGAAAATATGC<br>AAGAATGAGGGGTGCCCACACTAATGATGTAAAACAATTAACAGAGGCAGTGCA<br>AAAAATAACCACAGAAAGCATAGTAATATGGGAAAGACTCCTAAATTTAAACT<br>GCCCATACAAAAGGAAACATGGGAAACATGGTGGACAGAGTATTGGCAAGCCAC<br>CTGGATTCCTGAGTGGGAGTTTGTTAATACCCCTCCCTTAGTGAAATTATGGTACC<br>AGTTAGAGAAAGAACCCATAGTAGGAGCAGAAACCTTCTATGTAGATGGGGCAG<br>CTAACAGGGAGACTAAATTAGGAAAAGCAGGATATGTTACTAATAGAGGAAGAC<br>AAAAAGTTGTCACCCTAACTGACACAACAAATCAGAAGACTGAGTTACAAGCAA<br>TTTATCTAGCTTTGCAGGATTCGGGATTAGAAGTAAACATAGTAACAGACTCACA |

TABLE 1-continued

Lentivirus and HIV Nucleic Acid Sequences

SEQ
ID
NO  Sequence

ATATGCATTAGGAATCATTCAAGCACAACCAGATCAAAGTGAATCAGAGTTAGTC
AATCAAATAATAGAGCAGTTAATAAAAAAGGAAAAGGTCTATCTGGCATGGGTA
CCAGCACACAAAGGAATTGGAGGAAATGAACAAGTAGATAAATTAGTCAGTGCT
GGAATCAGGAAAGTACTATTTTTAGATGGAATAGATAAGGCCCAAGATGAACAT
GAGAAATATCACAGTAATTGGAGAGCAATGGCTAGTGATTTTAACCTGCCACCTG
TAGTAGCAAAAGAAATAGTAGCCAGCTGTGATAAATGTCAGCTAAAAGGAGAAG
CCATGCATGGACAAGTAGACTGTAGTCCAGGAATATGGCAACTAGATTGTACACA
TTTAGAAGGAAAAGTTATCCTGGTAGCAGTTCATGTAGCCAGTGGATATATAGAA
GCAGAAGTTATTCCAGCAGAAACAGGGCAGGAAACAGCATATTTTCTTTTAAAT
TAGCAGGAAGATGGCCAGTAAAAACAATACATACTGACAATGGCAGCAATTTCA
CCGGTGCTACGGTTAGGGCCGCCTGTTGGTGGGCGGGAATCAAGCAGGAATTTGG
AATTCCCTACAATCCCCAAAGTCAAGGAGTAGTAGAATCTATGAATAAAGAATTA
AAGAAAATTATAGGACAGGTAAGAGATCAGGCTGAACATCTTAAGCAGCAGTA
CAAATGGCAGTATTCATCCACAATTTTAAAAGAAAAGGGGGGATTGGGGGGTAC
AGTGCAGGGGAAAGAATAGTAGACATAATAGCAACAGACATACAAACTAAAGAA
TTACAAAAACAAATTACAAAAATTCAAAATTTTCGGGTTTATTACAGGGACAGCA
GAAATCCACTTTGGAAAGGACCAGCAAAGCTCCTCTGGAAAGGTGAAGGGGCAG
TAGTAATACAAGATAATAGTGACATAAAAGTAGTGCCAAGAAGAAAAGCAAAGA
TCATTAGGGATTATGGAAAACAGATGGCAGGTGATGATTGTGTGGCAAGTAGAC
AGGATGAGGATTAGAACATGGAAAAGTTTAGTAAAACACCATATGTATGTTTCAG
GGAAAGCTAGGGGATGGTTTTATAGACATCACTATGAAAGCCCTCATCCAAGAAT
AAGTTCAGAAGTACACATCCCACTAGGGGATGCTAGATTGGTAATAACAACATAT
TGGGGTCTGCATACAGGAGAAAGAGACTGGCATTTGGGTCAGGGAGTCTCCATA
GAATGGAGGAAAAAGAGATATAGCACACAAGTAGACCCTGAACTAGCAGACCAA
CTAATTCATCTGTATTACTTTGACTGTTTTTCAGACTCTGCTATAAGAAAGGCCTT
ATTAGGACACATAGTTAGCCCTAGGTGTGAATATCAAGCAGGACATAACAAGGT
AGGATCTCTACAATACTTGGCACTAGCAGCATTAATAACACCAAAAAAGATAAA
GCCACCTTTGCCTAGTGTTACGAAACTGACAGAGGATAGATGGAACAAGCCCCAG
AAGACCAAGGGCCACAGAGGGAGCCACACAATGAATGGACACTAGAGCTTTTAG
AGGAGCTTAAGAATGAAGCTGTTAGACATTTTCCTAGGATTTGGCTCCATGGCTT
AGGGCAACATATCTATGAAACTTATGGGGATACTTGGGCAGGAGTGGAAGCCAT
AATAAGAATTCTGCAACAACTGCTGTTTATCCATTTTCAGAATTGGGTGTCGACAT
AGCAGAATAGGCGTTACTCGACAGAGGAGAGCAAGAAATGGAGCCAGTAGATCC
TAGACTAGAGCCCTGGAAGCATCCAGGAAGTCAGCCTAAAACTGCTTGTACCAAT
TGCTATTGTAAAAAGTGTTGCTTTCATTGCCAAGTTTGTTTCATAACAAAAGCCTT
AGGCATCTCCTATGGCAGGAAGAAGCGGAGACAGCGACGAAGAGCTCATCAGAA
CAGTCAGACTCATCAAGCTTCTCTATCAAAGCAGTAAGTAGTACATGTAATGCAA
CCTATACCAATAGTAGCAATAGTAGCATTAGTAGTAGCAATAATAATAGCAATAG
TTGTGTGGTCCATAGTAATCATAGAATATAGGAAAATATTAAGACAAAGAAAAT
AGACAGGTTAATTGATAGACTAATAGAAAGAGCAGAAGACAGTGGCAATGAGAG
TGAAGGAGAAATATCAGCACTTGTGGAGATGGGGGTGGAGATGGGGCACCATGC
TCCTTGGGATGTTGATGATCTGTAGTGCTACAGAAAAATTGTGGGTCACAGTCTA
TTATGGGGTACCTGTGTGGAAGGAAGCAACCACCACTCTATTTTGTGCATCAGAT
GCTAAAGCATATGATACAGAGGTACATAATGTTTGGGCCACACATGCCTGTGTAC
CCACAGACCCCAACCCACAAGAAGTAGTATTGGTAAATGTGACAGAAAATTTTAA
CATGTGGAAAAATGACATGGTAGAACAGATGCATGAGGATATAATCAGTTTATG
GGATCAAAGCCTAAAGCCATGTGTAAAATTAACCCCACTCTGTGTTAGTTTAAAG
TGCACTGATTTGAAGAATGATACTAATACCAATAGTAGTGCGGGAGAATAGTAA
TGGAGAAAGGAGAGATAAAAAACTGCTCTTTCAATATCAGCACAAGCATAAGAG
GTAAGGTGCAGAAAGAATATGCATTTTTTTATAAACTTGATATAATACCAATAGA
TAATGATACTACCAGCTATAAGTTGACAAGTTGTAACACCTCAGTCATTACACAG
GCCTGTCCAAAGGTATCCTTTGAGCCAATTCCCATACATTATTGTGCCCCGGCTGG
TTTTGCGATTCTAAAATGTAATAATAAGACGTTCAATGGAACAGGACCATGTACA
AATGTCAGCACAGTACAATGTACACATGGAATTAGGCCAGTAGTATCAACTCAAC
TGCTGTTAAATGGCAGTCTAGCAGAAGAAGAGGTAGTAATTAGATCTGTCAATTT
CACGGACAATGCTAAAACCATAATAGTACAGCTGAACACATCTGTAGAAATTAAT
TGTACAAGACCCAACAACAATACAAGAAAAGAATCCGTATCCAGAGAGGACCA
GGGAGAGCATTTGTTACAATAGGAAAAATAGGAAATATGAGACAAGCACATTGT
AACATTAGTAGAGCAAAATGGAATAACACTTTAAAACAGATAGCTAGCAAATTA
AGAGAACAATTTGGAAATAATAAAACAATAATCTTTAAGCAATCCTCAGGAGGG
GACCCAGAAATTGTAACGCACAGTTTTAATTGTGGAGGGGAATTTTTCTACTGTA
ATTCAACACAACTGTTTAATAGTACTTGGTTTAATAGTACTTGGAGTACTGAAGG
GTCAAATAACACTGAAGGAAGTGACACAATCACCCTCCCATGCAGAATAAAACA
AATTATAAACATGTGGCAGAAAGTAGGAAAAGCAATGTATGCCCCTCCCATCAGT
GGACAAATTAGATGTTCATCAAATATTACAGGGCTGCTATTAACAAGAGATGGTG
GTAATAGCAACAATGAGTCCGAGATCTTCAGACCTGGAGGAGGAGATATGAGGG
ACAATTGGAGAAGTGAATTATATAAATATAAAGTAGTAAAAATTGAACCATTAG
GAGTAGCACCCACCAAGGCAAAGAGAAGAGTGGTGCAGAGAGAAAAAAGAGCA
GTGGGAATAGGAGCTTTGTTCCTTGGGTTCTTGGGAGCAGCAGGAAGCACTATGG
GCGCAGCCTCAATGACGCTGACGGTACAGGCCAGACAATTATTGTCTGGTATAGT
GCAGCAGCAGAACAATTTGCTGAGGGCTATTGAGGCGCAACAGCATCTGTTGCAA
CTCACAGTCTGGGGCATCAAGCAGCTCCAGGCAAGAATCCTGGCTGTGGAAAGAT
ACCTAAAGGATCAACAGCTCCTGGGGATTTGGGGTTGCTCTGGAAAACTCATTTG
CACCACTGCTGTGCCTTGGAATGCTAGTTGGAGTAATAAATCTCTGGAACAGATT

TABLE 1-continued

Lentivirus and HIV Nucleic Acid Sequences

SEQ
ID
NO  Sequence

```
TGGAATCACACGACCTGGATGGAGTGGGACAGAGAAATTAACAATTACACAAGC
TTAATACACTCCTTAATTGAAGAATCGCAAAACCAGCAAGAAAAGAATGAACAA
GAATTATTGGAATTAGATAAATGGGCAAGTTTGTGGAATTGGTTTAACATAACAA
ATTGGCTGTGGTATATAAAATTATTCATAATGATAGTAGGAGGCTTGGTAGGTTT
AAGAATAGTTTTTGCTGTACTTTCTATAGTGAATAGAGTTAGGCAGGGATATTCA
CCATTATCGTTTCAGACCCACCTCCCAACCCCGAGGGGACCCGACAGGCCCGAAG
GAATAGAAGAAGAAGGTGGAGAGAGAGACAGAGACAGATCCATTCGATTAGTGA
ACGGATCCTTGGCACTTATCTGGGACGATCTGCGGAGCCTGTGCCTCTTCAGCTAC
CACCGCTTGAGAGACTTACTCTTGATTGTAACGAGGATTGTGGAACTTCTGGGAC
GCAGGGGGTGGGAAGCCCTCAAATATTGGTGGAATCTCCTACAGTATTGGAGTCA
GGAACTAAAGAATAGTGCTGTTAGCTTGCTCAATGCCACAGCCATAGCAGTAGCT
GAGGGGACAGATAGGGTTATAGAAGTAGTACAAGGAGCTTGTAGAGCTATTCGC
CACATACCTAGAAGAATAAGACAGGGCTTGGAAAGGATTTTGCTATAAGATGGG
TGGCAAGTGGTCAAAAAGTAGTGTGATTGGATGGCCTACTGTAAGGGAAAGAAT
GAGACGAGCTGAGCCAGCAGCAGATAGGGTGGGAGCAGCATCTCGAGACCTGGA
AAAACATGGAGCAATCACAAGTAGCAATACAGCAGCTACCAATGCTGCTTGTGCC
TGGCTAGAAGCACAAGAGGAGGAGGAGGTGGGTTTTCCAGTCACACCTCAGGTA
CCTTTAAGACCAATGACTTACAAGGCAGCTGTAGATCTTAGCCACTTTTTAAAAG
AAAAGGGGGACTGGAAGGGCTAATTCACTCCCAAAGAAGACAAGATATCCTTG
ATCTGTGGATCTACCACACACAAGGCTACTTCCCTGATTAGCAGAACTACACACC
AGGGCCAGGGGTCAGATATCCACTGACCTTTGGATGGTGCTACAAGCTAGTACCA
GTTGAGCCAGATAAGATAGAAGAGGCCAATAAAGGAGAGAACACCAGCTTGTTA
CACCCTGTGAGCCTGCATGGGATGGATGACCCGGAGAGAGAAGTGTTAGAGTGG
AGGTTTGACAGCCGCCTAGCATTTCATCACGTGGCCCGAGAGCTGCATCCGGAGT
ACTTCAAGAACTGCTGACATCGAGCTTGCTACAAGGGACTTTCCGCTGGGGACTT
TCCAGGGAGGCGTGGCCTGGGCGGGACTGGGGAGTGGCGAGCCCTCAGATCCTG
CATATAAGCAGCTGCTTTTTGCCTGTACTGGGTCTCTCTGGTTAGACCAGATCTGA
GCCTGGGAGCTCTCTGGCTAACTAGGGAACCCACTGCTTAAGCCTCAATAAAGCT
TGCCTTGAGTGCTTC
```

Detection Agents

Detection agents may be utilized to detect nucleic acid sequence of interest. A detection agent may comprise a probe portion. The probe portion may include a probe, or a combination of probes. The probe portion may comprise a nucleic acid molecule, a polypeptide, or a combination thereof. The detection agents may further comprise a detectable moiety. The detectable moiety may comprise a fluorophore. A fluorophore may be a molecule that may absorb light at a first wavelength and transmit or emit light at a second wavelength. The fluorophore may be a small molecule (such as a dye) or a fluorescent polypeptide. The detectable moiety may be a fluorescent small molecule (such as a dye). The detectable moiety may not contain a fluorescent polypeptide. The detection agent may further comprise a conjugating moiety. The conjugating moiety may allow attachment of the detection agent to a nucleic acid sequence of interest. The detection agent may comprise a probe that is synthesized with direct dye incorporation at the 3' end.

FIG. 25 shows a schematic of a detection agent 100 for use with a Nano-FISH procedure. The detection agent may comprise a probe portion 110, as described herein. The detection agent may comprise a detectable moiety 120, as described herein.

A. Probes

A detection agent may comprise a probe portion. A probe portion may comprise a probe or a combination of probes. A probe may be a nucleic acid probe, a polypeptide probe, or a combination thereof. A probe portion may be an unconjugated probe that does not contain a detectable moiety. A probe portion may be a conjugated probe which comprises a single probe with a detectable moiety, or two or more probes in which at least one probe may be an unconjugated probe bound to at least a second probe which comprises a detectable moiety.

A probe may be a nucleic acid probe. The nucleic acid probe may be a DNA probe, a RNA probe, or a combination thereof. The nucleic acid probe may be a DNA probe. The nucleic acid probe may be a RNA probe. The nucleic acid probe may be a double stranded nucleic acid probe, a single stranded nucleic acid probe, or may contain single-stranded and/or double stranded portions. The nucleic acid probe may further comprise overhangs on one or both termini, may further comprises blunt ends on one or both termini, or may further form a hairpin.

The nucleic acid probe may be at least 10, at least 15, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 45, at least 50, at least 55, at least 60, at least 65, at least 70, at least 80, at least 90, at least 100, or more nucleotides in length. The nucleic acid probe may be about 10, about 15, about 20, about 21, about 22, about 23, about 24, about 25, about 26, about 27, about 28, about 29, about 30, about 31, about 32, about 33, about 34, about 35, about 36, about 37, about 38, about 39, about 40, about 45, about 50, about 55, about 60, about 65, about 70, about 80, about 90, or about 100 nucleotides in length. The nucleic acid probe may be about 20 nucleotides in length. The nucleic acid probe may be about 21 nucleotides in length. The nucleic acid probe may be about 22 nucleotides in length. The nucleic acid probe may be about 23 nucleotides in length. The nucleic acid probe may be about 24 nucleotides in length. The nucleic acid probe may be about 25 nucleotides in length. The nucleic acid probe may be about 26 nucleotides in length. The nucleic acid probe may be about 27 nucleotides in length. The nucleic acid probe may be about 28 nucleotides in length. The nucleic acid probe may be about 29 nucleotides in length. The nucleic acid probe may be about 30 nucleotides in length. The nucleic acid probe may be about 31 nucleotides in length. The nucleic acid probe may be about 32 nucleotides in length. The nucleic acid probe may be about 33 nucleotides in length. The nucleic acid probe may be about 34 nucleotides in length. The nucleic acid probe may be about 35 nucleotides in length. The nucleic acid probe may be about 36 nucleotides in length. The nucleic acid probe may be about 37 nucleotides in length. The nucleic acid probe may be about 38 nucleotides in length. The nucleic acid probe may be about 39 nucleotides in length. The nucleic acid probe may be about 40 nucleotides in length. The nucleic acid probe may be about 45 nucleotides in length. The nucleic acid probe may be about 50 nucleotides in length. The nucleic acid probe may be about 55 nucleotides in length. The nucleic acid probe may be about 60 nucleotides in length.

TABLE 2 lists exemplary nucleotide sequences according to the present disclosure.

TABLE 2

Exemplary Probe Nucleotide Sequences

| SEQ ID NO | Nucleotide Sequence | % GC Content |
|---|---|---|
| SEQ ID NO: 1 | TTTCCCTTGCTCTTCATGATTTTAACAACATGATGGATTT | 33 |
| SEQ ID NO: 2 | CCCTGCCCCCATTAACTCACATCCTGAATTTTATGTTTA | 43 |
| SEQ ID NO: 3 | GCACTTCATCATCGTCTTTGAAGTCCCCTTCTTGTCCTCC | 50 |
| SEQ ID NO: 4 | TATGATGAACACCATGCACCACATGCAGGTTCTGGTGAAG | 48 |
| SEQ ID NO: 5 | GATACAAAAGAATATTGGTATGTATGTTGCACAGACTCAT | 33 |
| SEQ ID NO: 6 | CCTATTTCCCCCACACAGCCTTCCCACATTGGCCAACCCT | 58 |
| SEQ ID NO: 7 | TACAAAGGGCTTCTCTGGCCAGAGAGAGCCGGTGTCTGCT | 58 |
| SEQ ID NO: 8 | TGGGGGGGTTAATGGAGTTATGGACTGGGATGGGCAGCCT | 58 |
| SEQ ID NO: 9 | ACCTACCTAGGGAACTCTTTCTCCCTGGCACTAGGCTAGT | 53 |
| SEQ ID NO: 10 | ACTGACTGAGCTGACCTCCAGTACAGGGCCTGAGGCCACT | 60 |
| SEQ ID NO: 11 | CTGGGAGCTAAATAGAAGCAAATATCCCCAGGCCTGGGTG | 53 |
| SEQ ID NO: 12 | ATGCGTCAAGCAACTACACTCCCACAGTAAACTGGGAACC | 50 |
| SEQ ID NO: 13 | CAGCTCCTTGGCAGCCTAGGCTCTAGCTCAACATCTGCTT | 55 |
| SEQ ID NO: 14 | TGCTGGAGTCGCACCAACCTGGCTCTGCCTATCTCCAGCA | 60 |
| SEQ ID NO: 15 | CTCTGTAGGCTGCACAACGTGGAACAGATGAAAGGAACCA | 50 |
| SEQ ID NO: 16 | TGGGGTAAATTATAATCATGAAATTCCGTCAAGCTTGAAT | 33 |
| SEQ ID NO: 17 | AACATATTTAATATGGCATATTCAAATGACAGAAAGTACG | 28 |
| SEQ ID NO: 18 | CTTTATTCTTGCTAATGTTGACTCCTTAGCAAAGATAATT | 30 |
| SEQ ID NO: 19 | TGATCTTTGCTAAACTCTTCAGGAATAAATGAACATTTCC | 33 |
| SEQ ID NO: 20 | TTTTCAAGCAGTTAAGAAGCAAGAATTAATGACTCGAATA | 30 |
| SEQ ID NO: 21 | ATGAGAGTGTTGACTGATGAAGGGCTCCTATACGCGGGTT | 50 |
| SEQ ID NO: 22 | TCTTTCCCATCTGTTTCCCGGCCCCTACCAGAAATAAGTG | 50 |
| SEQ ID NO: 23 | ATGAACCTCCCTCGCTCCAAGACCAGAGCTCCTAGGAAGT | 55 |
| SEQ ID NO: 24 | TCTTTATTTTATTGGCCACAATTGAACATAGGTATAATTT | 25 |
| SEQ ID NO: 25 | CAGAAGCAAGCCCTGATCAAGGAAACCATTCACACTTGAT | 45 |
| SEQ ID NO: 26 | GTGGCTTTTGCTCAAAGTGAGGACGTTATCAGCTCTGCCC | 53 |
| SEQ ID NO: 27 | CTTTAAACAAAAACTAAAGGCGTAAGGAAAGATAACTACT | 30 |
| SEQ ID NO: 28 | CAGTTGCCACACTTTTTTTCACTGCTAAAGTTCGTAATGA | 38 |
| SEQ ID NO: 29 | GGCAATCAGAAGTATTTTGGTTGCTTCTAGGTCAGAATGA | 40 |
| SEQ ID NO: 30 | GGCAGCAAACTTGTTTAGGTATGATTCATCATTGTCTGCT | 40 |
| SEQ ID NO: 31 | CTACAAAACAATGAGTCTGATTACGACCCACAGAAATGAA | 38 |

TABLE 2-continued

Exemplary Probe Nucleotide Sequences

| SEQ ID NO | Nucleotide Sequence | % GC Content |
|---|---|---|
| SEQ ID NO: 32 | CCTCCCACAGACCCAAACATGCTGCTGCAAATGTCTCACT | 53 |
| SEQ ID NO: 33 | GGACAAGCACACACATCGCTGGGAAGATCTGCAAGCCTCC | 58 |
| SEQ ID NO: 34 | TAAACCTGGATAACAAGAACACTGTTTCCACTGCGCTAGT | 43 |
| SEQ ID NO: 35 | TCATCACGATGACAATGGACAAGCCATATCCCTAACAGGG | 48 |
| SEQ ID NO: 36 | TTTCCATGACACCAGGACCGTAAAGCACCTTTTACACCGT | 48 |
| SEQ ID NO: 37 | AATTGGGATGTGCAAAACCTCTTAACTTGTAGCACCAAGT | 40 |
| SEQ ID NO: 38 | TCTTGTGTTATTCGCCTGCATTGAAATCCCATCCCAATCC | 45 |
| SEQ ID NO: 39 | TGAGTGATCTCTTTGCTGATCATAAACATATTCCTCCATC | 38 |
| SEQ ID NO: 40 | TGCATTCATTACTAAATACACAGGGCATAGCACATAGTAA | 35 |
| SEQ ID NO: 41 | CTTCAATGTTGCCAGGAAAATCCTTGCAGGAATCACACCC | 48 |
| SEQ ID NO: 42 | ATTTTTTTCTAAAGCTTTAGGAAATACACACGTTTCCCCT | 33 |
| SEQ ID NO: 43 | AGAGTAATCTTCAACAATCCTTGGTCTAAACACACACAAG | 38 |
| SEQ ID NO: 44 | CCCAGGGACCCACGCCAAGCTCACCGCACCTTCCACCAAA | 65 |
| SEQ ID NO: 45 | AGCTCCTGTACTAGCTGGTGGGTGTGGAGCACACAGCCC | 63 |
| SEQ ID NO: 46 | TCACACAGGGAAAGTGAGGCTTGGTGGTTGATTTGAGCAA | 48 |
| SEQ ID NO: 47 | CCTTCCAACAGCCGTGTGAGACAAGAGGTCTTATCCTCTT | 50 |
| SEQ ID NO: 48 | ACAAGGGTCACTGAGCACATGCCATGTGTTGGGCACAGTG | 55 |
| SEQ ID NO: 49 | GTCTCCTAAGTCTCATTCTTTTCTTAGGATTCTTCAGATC | 38 |
| SEQ ID NO: 50 | TCCGCCTAAGTAAAACATAAAATTACTTAAGCTGCGTAAA | 33 |
| SEQ ID NO: 51 | CATTTTGACCTGATTATCTTTGTCTATAAGTCTTAAGCCA | 33 |
| SEQ ID NO: 52 | CCGGTTCCTCCACCCTCACTGCCCCAACAACTGAAAGAAG | 58 |
| SEQ ID NO: 53 | ACAGTGTGTTGAAAGAATCCATAACTCTTTCTTTCCAGCC | 40 |
| SEQ ID NO: 54 | GAAGTTTCATCTTTATCAAAATCTCCATTCCCAGGCGGAC | 43 |
| SEQ ID NO: 55 | AAGTCCATTTTTTTAAGCTTTGCGCTTCAGCTCCAGAACA | 40 |
| SEQ ID NO: 56 | TCTTCGTTATGAATACAAATAGGAAAACAATCAGACCCAA | 33 |
| SEQ ID NO: 57 | TCCTCGGGGCATTCTAGAACCGTAGCAGACCTGCTTACAT | 53 |
| SEQ ID NO: 58 | TCCTTATGTGGGAAAATAAAGAGGATAGACAGATTTGATT | 33 |
| SEQ ID NO: 59 | AGCTGCGAGTCCCTAACAGACTTCCAGGACAGCTGAAAAA | 50 |
| SEQ ID NO: 60 | AGGACAAGGGAGAGACGCCCACCCGCCTCTGTCAGGGATA | 63 |
| SEQ ID NO: 61 | AATCCATGAGGGTGACATACACATCCTTACTGTTCCCACA | 45 |
| SEQ ID NO: 62 | ACTTCCTTCCCTGAGATGCCCATCCTTTGATTCTGGGATT | 48 |
| SEQ ID NO: 63 | GCTCCCGGATAAATTAATTACCGTGACCCTGAGCTGCTTC | 50 |
| SEQ ID NO: 64 | TAGACTAAGAGAATCTAATTTGTGGCAAAGATCTTGAGTG | 35 |
| SEQ ID NO: 65 | TGAAGGATGACTAAGAGCTTCCCTATAAACCCCATACTGG | 45 |
| SEQ ID NO: 66 | AGCCAGGACTATAGAGTTTCAGAAAAGGGAGAAAATTCTA | 38 |
| SEQ ID NO: 67 | TGCTGCTAATTTAAGTTTCTGGCAAGTCAAAATAAATCTC | 33 |
| SEQ ID NO: 68 | CGAAAACCATCAATTAACTAGAATGATCAGGAAATTGCGT | 35 |
| SEQ ID NO: 69 | TTTATTTAGTCCCCAGGGTGTATGAAGTGCTCTTCCAGGC | 48 |

TABLE 2-continued

Exemplary Probe Nucleotide Sequences

| SEQ ID NO | Nucleotide Sequence | % GC Content |
|---|---|---|
| SEQ ID NO: 70 | GGTCCTTCTTGGTACCGATATTGCCATATTGGCTGGACAT | 48 |
| SEQ ID NO: 71 | TGGCTTGGTAGGATGCACTCACATGGGCTGTAGTAATACT | 48 |
| SEQ ID NO: 72 | TATCACCAGCATAACTTGTGGTTCTTCAGCCAGTAATTTC | 40 |
| SEQ ID NO: 73 | GAACAACTGGGTATCTACAGGCAAAGAAATGAACCTTGAC | 43 |
| SEQ ID NO: 74 | TAGGTACTGTTGTGTCCCTATATATTTGACTTGGTAATAA | 33 |
| SEQ ID NO: 75 | TATGTGAACATCGGTGAATATCATAATTTATTATGCAAAC | 28 |
| SEQ ID NO: 76 | AGCTGAACACTCTTTGTGGTCCTCTTGAAGCCTAGAATTA | 43 |
| SEQ ID NO: 77 | CCCCACCTCACTGCCCCCCAGTTCTGACTCACGGTGTCCC | 68 |
| SEQ ID NO: 78 | ACTCCCATCACCTGGCCAGCTTGGCTGTCCCCTGACCCAC | 65 |
| SEQ ID NO: 79 | GGCTGCCCAGCTGCCCAGCAGCAAAACTGCATAGGAACTC | 60 |
| SEQ ID NO: 80 | GCCCAGGACGCCAAGTGTCACCACCCTCTCCCCAGGCAGG | 70 |
| SEQ ID NO: 81 | CACAAGGTCAGCTCCACCCGTGGGTCAGTGTGCCCCAGAT | 63 |
| SEQ ID NO: 82 | GGAGACAAAACGGGCACCCAGCCCAGTCATGCCCGTGCCT | 65 |
| SEQ ID NO: 83 | CTGAAATCAGTCAGCAGTTTCGGTGAGTCTGCAGCTGACA | 50 |
| SEQ ID NO: 84 | CGCCACATTTGGGGCTGGGAGAGATGTCACAGGGGCTGAC | 63 |
| SEQ ID NO: 85 | CACATGTTCTCTGCATAGGTTTTTAAGCAGCCAGCAGCTG | 48 |
| SEQ ID NO: 86 | TTTAAAATGAAAACCCACACTTCCAAAATAGCACTTGAGT | 33 |
| SEQ ID NO: 87 | AACATGTTTGTGTAATTAAGCATTTTAAAATCATAACCAT | 23 |
| SEQ ID NO: 88 | TGCTTATCTGTGCTTTTTATGTTCCACCCCCCCACCACCA | 50 |
| SEQ ID NO: 89 | ATTAATAATAATTCTGTGTTTATGGGGATTGCAGATACAT | 28 |
| SEQ ID NO: 90 | CCAGCTTTGTGTCTTCATGACCCAACTGGAGTAAGAATGG | 48 |
| SEQ ID NO: 91 | AAAGACCTCATTTGCAGCATGGTTAGCAGTGTCAAACATT | 40 |
| SEQ ID NO: 92 | TCTCGTAGCACTGGCTGCAGCCGGCCTGTGTGTGCCCACC | 68 |
| SEQ ID NO: 93 | GCCTTCATCCTGAACGGCTGACCAGCGGAAACAAAAGATC | 53 |
| SEQ ID NO: 94 | ATGGCCAGATAACAGTGTTTAGACATGTCTTTGATGTTTT | 35 |
| SEQ ID NO: 95 | CCCTGACTGTGTAAGGGGTCTCTCTCCATGGGGAATAGAG | 55 |
| SEQ ID NO: 96 | CTGAGCTTAGCTTCTACTGTGCTGTTAATTTCAGGCAAGA | 43 |
| SEQ ID NO: 97 | AGATCAATAATATTTGCATTAGCTACTTACATCAGTCTCT | 30 |
| SEQ ID NO: 98 | TAATTGCAGAAAACTTATAAAGCATGGAAGAATACAAAAC | 28 |
| SEQ ID NO: 99 | AAACAAATTCCTCTACCTGGACATGACTGTTGTTAGCATT | 38 |
| SEQ ID NO: 100 | GGGAGATTCTTCATATCCTTTTAATGTAGATATGCACATT | 33 |
| SEQ ID NO: 101 | ACAAAAAAGGCTATCATATTGTACATATAACTTTGCTGTA | 28 |
| SEQ ID NO: 102 | TCTGCTAGGAACCTGTACCCATGTCATTACTGTAAGCATT | 43 |
| SEQ ID NO: 103 | ACTACTCAAATTTTAGTATCTGCAGATATCAGATATCCTT | 30 |
| SEQ ID NO: 104 | TGAAATGGTATTGTTGCCCTTTCTGATTAGTAAAGTATAC | 33 |
| SEQ ID NO: 105 | TTATAATCTAGCAAGGTTAGAGATCATGGATCACTTTCAG | 35 |
| SEQ ID NO: 106 | ACAGCTTGCCTCCGATAAGCCAGAATTCCAGAGCTTCTGG | 53 |

TABLE 2-continued

Exemplary Probe Nucleotide Sequences

| SEQ ID NO | Nucleotide Sequence | % GC Content |
| --- | --- | --- |
| SEQ ID NO: 107 | TCAATCAACCTGATAGCTTAGGGGATAAACTAATTTGAAG | 35 |
| SEQ ID NO: 108 | GATCATGAAGGATGAAAGAATTTCACCAATATTATAATAA | 25 |
| SEQ ID NO: 109 | TTTAGCCATCTGTATCAATGAGCAGATATAAGCTTTACAC | 35 |
| SEQ ID NO: 110 | AGGGGTAGATTATTTATGCTGCCCATTTTTAGACCATAAA | 35 |
| SEQ ID NO: 111 | CACTACCATTTCACAATTCGCACTTTCTTTCTTTGTCCTT | 38 |
| SEQ ID NO: 112 | GCTCCATCAAATCATAAAGGACCCACTTCAAATGCCATCA | 43 |
| SEQ ID NO: 113 | TCCTACTTTCAGGAACTTCTTTCTCCAAACGTCTTCTGCC | 45 |
| SEQ ID NO: 114 | AATTCTATTTTTCTTCAACGTACTTTAGGCTTGTAATGT | 28 |
| SEQ ID NO: 115 | TAAGATGCAAATAGTAAGCCTGAGCCCTTCTGTCTAACTT | 40 |
| SEQ ID NO: 116 | CTGTGTTTCAGAATAAAATACCAACTCTACTACTCTCATC | 35 |
| SEQ ID NO: 117 | GAAACCATGTTTATCTCAGGTTTACAAATCTCCACTTGTC | 38 |
| SEQ ID NO: 118 | CTTTGGAAAAGTAATCAGGTTTAGAGGAGCTCATGAGAGC | 43 |
| SEQ ID NO: 119 | GCTGAATCCCCAACTCCCAATTGGCTCCATTTGTGGGGA | 55 |
| SEQ ID NO: 120 | GGTGTTATGAACTTAACGCTTGTGTCTCCAGAAAATTCAC | 40 |
| SEQ ID NO: 121 | AGTTAATGCACGTTAATAAGCAAGAGTTTAGTTTAATGTG | 30 |
| SEQ ID NO: 122 | TAATTGAGAAGGCAGATTCACTGGAGTTCTTATATAATTG | 33 |
| SEQ ID NO: 123 | CACGGTCAGATGAAAATATAGTGTGAAGAATTTGTATAAC | 33 |
| SEQ ID NO: 124 | CACAAGTCAGCATCAGCGTGTCATGTCTCAGCAGCAGAAC | 53 |
| SEQ ID NO: 125 | GGAGGTGGGACTTAGGTGAAGGAAATGAGCCAGCAGAAG | 55 |
| SEQ ID NO: 126 | GTCACAGCATTTCAAGGAGGAGACCTCATTGTAAGCTTCT | 45 |
| SEQ ID NO: 127 | AAAGAGGTGAAATTAATCCCATACCCTTAAGTCTACAGAC | 38 |
| SEQ ID NO: 128 | CTTTACTAAGGAACTTTTCATTTTAAGTGTTGACGCATGC | 35 |
| SEQ ID NO: 129 | CAGGTTTTTCTTTCCACGGTAACTACAATGAAGTGATCCT | 40 |
| SEQ ID NO: 130 | GCTCTACAGGGAGGTTGAGGTGTTAGAGATCAGAGCAGGA | 53 |
| SEQ ID NO: 131 | TACTATTTCCAACGGCATCTGGCTTTTCTCAGCCCTTGTG | 48 |
| SEQ ID NO: 132 | AAGGTTTAGGCAGGGATAGCCATTCTATTTTATTAGGGGC | 43 |
| SEQ ID NO: 133 | AGGGGCTCAACGAAGAAAAAGTGTTCCAAGCTTTAGGAAG | 45 |
| SEQ ID NO: 134 | GGGCTGAACCCCCTTCCCTGGATTGCAGCACAGCAGCGAG | 65 |
| SEQ ID NO: 135 | CTGACGTCATAATCTACCAAGGTCATGGATCGAGTTCAGA | 45 |
| SEQ ID NO: 136 | GAAGGTAGAGCTCTCCTCCAATAAGCCAGATTTCCAGAGT | 48 |
| SEQ ID NO: 137 | CACCAATATTATTATAATTCCTATCAACCTGATAGGTTAG | 30 |
| SEQ ID NO: 138 | AGATATAAGCCTTACACAGGATTATGAAGTCTGAAAGGAT | 35 |
| SEQ ID NO: 139 | ACATGTATCTTTCTGGTCTTTTAGCCGCCTAACACTTTGA | 40 |
| SEQ ID NO: 140 | CAAAGAACAAGTGCAATATGTGCAGCTTTGTTGCGCAGGT | 45 |
| SEQ ID NO: 141 | TATTATTATGTGAGTAACTGGAAGATACTGATAAGTTGAC | 30 |
| SEQ ID NO: 142 | TAAAAATCTTTCTCACCCATCCTTAGATTGAGAGAAGTCA | 35 |
| SEQ ID NO: 143 | TTGGGTTCACCTCAGTCTCTATAATCTGTACCAGCATACC | 45 |
| SEQ ID NO: 144 | CACACCCATCTCACAGATCCCCTATCTTAAAGAGACCCTA | 48 |

TABLE 2-continued

Exemplary Probe Nucleotide Sequences

| SEQ ID NO | Nucleotide Sequence | % GC Content |
|---|---|---|
| SEQ ID NO: 145 | ATGGAACCCAACCAGACTCTCAGATATGGCCAAAGATCTA | 45 |
| SEQ ID NO: 146 | GACACCAGTCTCTGACACATTCTTAAAGGTCAGGCTCTAC | 48 |
| SEQ ID NO: 147 | AGAGATTCAAAAGATTCACTTGTTTAGGCCTTAGCGGGCT | 43 |
| SEQ ID NO: 148 | TCCTTAGTCTGAGGAGGAGCAATTAAGATTCACTTGTTTA | 38 |
| SEQ ID NO: 149 | TAAATGGGGAAGTTGTTTGAAAACAGGAGGGATCCTAGAT | 40 |
| SEQ ID NO: 150 | GGGTTTATACATGACTTTTAGAACACTGCCTTGGTTTTTG | 38 |
| SEQ ID NO: 151 | AACTCTTAAAAGATATTGCCTCAAAAGCATAAGAGGAAAT | 30 |
| SEQ ID NO: 152 | AAATCGAGGAATAAGACAGTTATGGATAAGGAGAAATCAA | 33 |
| SEQ ID NO: 153 | TCAGTTAGGATTTAATCAATGTCAGAAGCAATGATATAGG | 33 |
| SEQ ID NO: 154 | CTTGAAAACACTTGAAATTGCTTGTGTAAAGAAACAGTTT | 30 |
| SEQ ID NO: 155 | ATAATCTTCAGAGGAAAGTTTTATTCTCTGACTTATTTAA | 25 |
| SEQ ID NO: 156 | AGATTCCTTCTGTCATTTTGCCTCTGTTCGAATACTTTCT | 38 |
| SEQ ID NO: 157 | ATTTCAGCTTCTAAACTTTATTTGGCAATGCCTTCCCATG | 38 |
| SEQ ID NO: 158 | GCAGGAGTTTGTTTCTTCTGCTTCAGAGCTTTGAATTTA | 38 |
| SEQ ID NO: 159 | ACATATCAACGGCACTGGTTCTTTATCTAACTCTCTGGCA | 43 |
| SEQ ID NO: 160 | TTATGCTTCCCTGAAACAATACCACCTGCTATTCTCCACT | 43 |
| SEQ ID NO: 161 | TTCTCACTCCCTACCACTGAGGACAAGTTTATGTCCTTAG | 45 |
| SEQ ID NO: 162 | TTAGAGATTATGTCATTACCAGAGTTAAAATTCTATAATG | 25 |
| SEQ ID NO: 163 | GGTCATTCTTAGAATAGTAATCCAGCCAATAGTACAGGTT | 38 |
| SEQ ID NO: 164 | CAGGCAATAAGGGCTTTTTAAGCAAAACAGTTGTGATAAA | 35 |
| SEQ ID NO: 165 | ATGATGGGCACTGAAGGTTAAAACTTGAGTCTGTCAACTT | 40 |
| SEQ ID NO: 166 | AACTCATAAATATCCCATTTTCCGCTGAAATATAGCTTTA | 30 |
| SEQ ID NO: 167 | CCTGGTTTCTTTGACCTTTTGGGACCTTGAGTAAGTAAAG | 43 |
| SEQ ID NO: 168 | CTTCATTTATTTTCATGATTAAAATTCTAAGAAATTCTTG | 20 |
| SEQ ID NO: 169 | TTTTTAATTAAATTGCATTGCCTAATGTATTTATGAACTA | 20 |
| SEQ ID NO: 170 | CATAGAAATAAAACAATACTCTGAAGTAGTTCAGAATGTG | 30 |
| SEQ ID NO: 171 | CAATTTATATAAAGAGTTAATTCAAATGAGACTATTTTAA | 18 |
| SEQ ID NO: 172 | AGGGCTTTGAATCTTATGTCTAGAAATTTTGAAAAACCTC | 33 |
| SEQ ID NO: 173 | TATATGCTAAGATTCCACCTCTAGTGCTAGAACTGAGAAG | 40 |
| SEQ ID NO: 174 | TGACTTGGTGATCTTTTTTAAATTCTGAAACAACAGCAAC | 33 |
| SEQ ID NO: 175 | AGCTAAGGACTTTTTCTTGCCTATGCATGCTATCTTCAGT | 40 |
| SEQ ID NO: 176 | TGATTATTTAGTATTGAAACTATAACATAGTATGTTTCCT | 23 |
| SEQ ID NO: 177 | AAAAAATGTGTATTTCTCTGGAGAAGGTTAAAACTGAGGA | 33 |
| SEQ ID NO: 178 | CAAGTGAGCAAGGCTTAAATGGAAGAAGCAATGATCTCGT | 43 |
| SEQ ID NO: 179 | CCACCTTCATTAACGAGATCATCCATCATGAGGAAATATG | 40 |
| SEQ ID NO: 180 | ACCAGGCCCCTCTGTTTTGTGTCACTAAGGGTGAGGATG | 55 |
| SEQ ID NO: 181 | ATGATTTTTCCCTCCCCCGGGCTTCTTTTAGCCATCAATA | 45 |

TABLE 2-continued

Exemplary Probe Nucleotide Sequences

| SEQ ID NO | Nucleotide Sequence | % GC Content |
|---|---|---|
| SEQ ID NO: 182 | TAGCCCCACAGGAGTTTGTTCTGAAAGTAAACTTCCACAA | 43 |
| SEQ ID NO: 183 | AAGCTTATTGAGGCTAAGGCATCTGTGAAGGAAAGAAACA | 40 |
| SEQ ID NO: 184 | CTCTAAACCACTATGCTGCTAGAGCCTCTTTTCTGTACTC | 45 |
| SEQ ID NO: 185 | CTCATTCAGACACTAGTGTCACCAGTCTCCTCATATACCT | 45 |
| SEQ ID NO: 186 | TATTTTCTTCTTCTTGCTGGTTTAGTCATGTTTTCTGGGA | 35 |
| SEQ ID NO: 187 | GGCAAACCCATTATTTTTTCTTTAGACTTGGGATGGTGA | 38 |
| SEQ ID NO: 188 | TGGGCAGCGTCAGAAACTGTGTGTGGATATAGATAAGAGC | 48 |
| SEQ ID NO: 189 | GACTATGCTGAGCTGTGATGAGGGAGGGGCCTAGCTAAAG | 55 |
| SEQ ID NO: 190 | TGAGAGTCAGAATGCTCCTGCTATTGCCTTCTCAGTCCCC | 53 |
| SEQ ID NO: 191 | TTGGTTTCTACACAAGTAGATACATAGAAAAGGCTATAGG | 35 |
| SEQ ID NO: 192 | TGTTTGAGAGTCCTGCATGATTAGTTGCTCAGAAATGCCC | 45 |
| SEQ ID NO: 193 | TTACAAATATGTGATTATCATCAAAACGTGAGGGCTAAAG | 33 |
| SEQ ID NO: 194 | CAGATAACTTGCAAGTCCTAGGATACCAGGAAAATAAATT | 35 |
| SEQ ID NO: 195 | AGCATTATGTCTGTCTGTCATTGTTTTTCATCCTCTTGTA | 35 |
| SEQ ID NO: 196 | TTCACAGTTACCCACACAGGTGAACCCTTTTAGCTCTCCT | 48 |
| SEQ ID NO: 197 | GAATGTTTCTTTCCTCTCAGGATCAGAGTTGCCTACATCT | 43 |
| SEQ ID NO: 198 | AATGCACCAAGACTGGCCTGAGATGTATCCTTAAGATGAG | 45 |
| SEQ ID NO: 199 | TCCCAGTAGCACCCCAAGTCAGATCTGACCCCGTATGTGA | 55 |
| SEQ ID NO: 200 | GTGTCCTCTAACAGCACAGGCCTTTTGCCACCTAGCTGTC | 55 |
| SEQ ID NO: 201 | GGCAAACAAGGTTTGTTTTCTTTTCCTGTTTTCATGCCTT | 38 |
| SEQ ID NO: 202 | TTCCATATCCTTGTTTCATATTAATACATGTGTATAGATC | 28 |
| SEQ ID NO: 203 | AAATCTATACACATGTATTAATAAAGCCTGATTCTGCCGC | 35 |
| SEQ ID NO: 204 | AGGTATAGAGGCCACCTGCAAGATAAATATTTGATTCACA | 38 |
| SEQ ID NO: 205 | CTAATCATTCTATGGCAATTGATAACAACAAATATATATA | 23 |
| SEQ ID NO: 206 | ATAATATATTCTAGAATATGTCACATTCTGTCTCAGGCAT | 30 |
| SEQ ID NO: 207 | TTTCTTTATGATGCCGTTTGAGGTGGAGTTTTAGTCAGGT | 40 |
| SEQ ID NO: 208 | AGCTTCTCCTTTTTTTGCCATCTGCCCTGTAAGCATCCT | 45 |
| SEQ ID NO: 209 | GGGACCCAGATAGGAGTCATCACTCTAGGCTGAGAACATC | 53 |
| SEQ ID NO: 210 | CACACACCCTAAGCCTCAGCATGACTCATCATGACTCAGC | 53 |
| SEQ ID NO: 211 | CTGTGCTTGAGCCAGAAGGTTTGCTTAGAAGGTTACACAG | 48 |
| SEQ ID NO: 212 | AACTGCTCATGCTTGGACTATGGGAGGTCACTAATGGAGA | 48 |
| SEQ ID NO: 213 | CAGAAATGTAACAGGAACTAAGGAAAAACTGAAGCTTATT | 33 |
| SEQ ID NO: 214 | CAGAGATGAGGATGCTGGAAGGGATAGAGGGAGCTGAGCT | 55 |
| SEQ ID NO: 215 | AAAAGTATAGTAATCATTCAGCAAATGGTTTTGAAGCACC | 33 |
| SEQ ID NO: 216 | GTATCTTATTCCCCACAAGAGTCCAAGTAAAAAATAACAG | 35 |
| SEQ ID NO: 217 | GAAAAGAATGTTTCTCTCACTGTGGATTATTTTAGAGAGT | 33 |
| SEQ ID NO: 218 | AATGGTCAAGATTTTTTAAAAATTAAGAAAACATAAGTT | 18 |
| SEQ ID NO: 219 | CTTGAGAAATGAAAATTTATTTTTTTGTTGGAGGATACCC | 30 |

TABLE 2-continued

Exemplary Probe Nucleotide Sequences

| SEQ ID NO | Nucleotide Sequence | % GC Content |
|---|---|---|
| SEQ ID NO: 220 | TCTATCTCCCATCAGGGCAAGCTGTAAGGAACTGGCTAAG | 50 |
| SEQ ID NO: 221 | AGTGAGACAGAGTGACTTAGTCTTAGAGGCCCCACTGGTA | 50 |
| SEQ ID NO: 222 | GATGAGAAGGCACCTTCATCACTCATCACAGTCAGCTCTG | 50 |
| SEQ ID NO: 223 | TCTCCTCTCTCCTTTCTCATCAGAAATTTCATAAGTCTAC | 38 |
| SEQ ID NO: 224 | GTCAGGCAGATCACATAAGAAAAGAGGATGCCAGTTAAGG | 45 |
| SEQ ID NO: 225 | GTTGCTGTTAGACAATTTCATCTGTGCCCTGCTTAGGAGC | 48 |
| SEQ ID NO: 226 | TCTTTAATGAAAGCTAAGCTTTCATTAAAAAAAGTCTAAC | 25 |
| SEQ ID NO: 227 | TGCATTCGACTTTGACTGCAGCAGCTGGTTAGAAGGTTCT | 48 |
| SEQ ID NO: 228 | GAGGAGGGTCCCAGCCCATTGCTAAATTAACATCAGGCTC | 53 |
| SEQ ID NO: 229 | ACTGGCAGTATATCTCTAACAGTGGTTGATGCTATCTTCT | 40 |
| SEQ ID NO: 230 | CTTGCCTGCTACATTGAGACCACTGACCCATACATAGGAA | 48 |
| SEQ ID NO: 231 | ATAGCTCTGTCCTGAACTGTTAGGCCACTGGTCCAGAGAG | 53 |
| SEQ ID NO: 232 | CATCTCCTTTGATCCTCATAATAACCCTATGAGATAGACA | 38 |
| SEQ ID NO: 233 | TATTACTCTTACTTTATAGATGATGATCCTGAAAACATAG | 28 |
| SEQ ID NO: 234 | CAAGGCACTTGCCCCTAGCTGGGGGTATAGGGGAGCAGTC | 63 |
| SEQ ID NO: 235 | GTAGTAGTAGAATGAAAATGCTGCTATGCTGTGCCTCCC | 45 |
| SEQ ID NO: 236 | CTTTCCCATGTCTGCCCTCTACTCATGGTCTATCTCTCCT | 50 |
| SEQ ID NO: 237 | CCTGGGAGTCATGGACTCCACCCAGCACCACCAACCTGAC | 63 |
| SEQ ID NO: 238 | CCACCTATCTGAGCCTGCCAGCCTATAACCCATCTGGGCC | 60 |
| SEQ ID NO: 239 | TAGCTGGTGGCCAGCCCTGACCCCACCCCACCCTCCCTGG | 73 |
| SEQ ID NO: 240 | TCTGATAGACACATCTGGCACACCAGCTCGCAAAGTCACC | 53 |
| SEQ ID NO: 241 | GGGTCTTGTGTTTGCTGAGTCAAAATTCCTTGAAATCCAA | 40 |
| SEQ ID NO: 242 | TTAGAGACTCCTGCTCCCAAATTTACAGTCATAGACTTCT | 40 |
| SEQ ID NO: 243 | GGCTGTCTCCTTTATCCACAGAATGATTCCTTTGCTTCAT | 43 |
| SEQ ID NO: 244 | CCATCCATCTGATCCTCCTCATCAGTGCAGCACAGGGCCC | 60 |
| SEQ ID NO: 245 | GCAGTAGCTGCAGAGTCTCACATAGGTCTGGCACTGCCTC | 58 |
| SEQ ID NO: 246 | ATGTCCGACCTTAGGCAAATGCTTGACTCTTCTGAGCTCA | 48 |
| SEQ ID NO: 247 | TGTCATGGCAAAATAAAGATAATAATAGTGTTTTTTTATG | 23 |
| SEQ ID NO: 248 | TAGCGTGAGGATGGAAAACAATAGCAAAATTGATTAGACT | 35 |
| SEQ ID NO: 249 | AAGGTCTCAACAAATAGTAGTAGATTTATCGTCCATTAA | 30 |
| SEQ ID NO: 250 | TCCCTCTCCTCTCTTACTCATCCCATCACGTATGCCTCTT | 50 |
| SEQ ID NO: 251 | TTCCCTTACCTATAATAAGAGTTATTCCTCTTATTATATT | 25 |
| SEQ ID NO: 252 | TTATAGTGATTCTGGATATTAAAGTGGGAATGAGGGGCAG | 40 |
| SEQ ID NO: 253 | CTAACGAAGAAGATGTTTCTCAAAGAAGCCATTCTCCCCA | 43 |
| SEQ ID NO: 254 | GATCATCTCAGCAGGGTTCAGGAAGATAAAGGAGGATCAA | 45 |
| SEQ ID NO: 255 | TGTTGAGGTGGGAGGACCGCTTGAGCCTGGGAAGTGCAAG | 60 |
| SEQ ID NO: 256 | AGTGAGCCGAGATTTTGCCACTACACTCCCATTTGGGTGA | 50 |

TABLE 2-continued

Exemplary Probe Nucleotide Sequences

| SEQ ID NO | Nucleotide Sequence | % GC Content |
|---|---|---|
| SEQ ID NO: 257 | GTGAGACCCTTTCTCAAAAACAAACTAATTAAAAAACCCT | 33 |
| SEQ ID NO: 258 | TTTACAGATGAAGAAACTGAGTCATACAACTACTAAGAGA | 33 |
| SEQ ID NO: 259 | GAGTCACTAATCACTCAGGTGGTCTGGCTCCAGCATCTGT | 53 |
| SEQ ID NO: 260 | TTAATCTCTGCTCTATACTGCCCAAGACTTTTATAAAGTC | 35 |
| SEQ ID NO: 261 | GTTGAGTCACTGAAATGAGTTATTGGGATGGCTGTGTGGG | 48 |
| SEQ ID NO: 262 | GTGCTAAGTTCTTTCCTAAAGGTATGTGAGAATACAAAGG | 38 |
| SEQ ID NO: 263 | AAGCATCCTCCTTTTTACACACGTGAACTAGTGCATGCAA | 43 |
| SEQ ID NO: 264 | GACACTCAGTGGGCCTGGGTGAAGGTGAGAATTTTATTGC | 50 |
| SEQ ID NO: 265 | TGAGAGCCTCTGGGGACATCTTGCCAGTCAATGAGTCTCA | 53 |
| SEQ ID NO: 266 | CAATTTCCTTCTCAGTCTTGGAGTAACAGAAGCTCATGCA | 43 |
| SEQ ID NO: 267 | ATAAACGGAAATTTTGTATTGAAATGAGAGCCATTGGAAA | 30 |
| SEQ ID NO: 268 | TTACTCCAGACTCCTACTTATAAAAAGAGAAACTGAGGCT | 38 |
| SEQ ID NO: 269 | GAAGGGTGGGGACTTTCTCAGTATGACATGGAAATGATCA | 45 |
| SEQ ID NO: 270 | TGGATTCAAAGCTCCTGACTTTCTGTCTAGTGTATGTGCA | 43 |
| SEQ ID NO: 271 | GCCCCTTTTCCTCTAACTGAAAGAAGGAAAAAAAAATGGA | 38 |
| SEQ ID NO: 272 | AAAATATTCTACATAGTTTCCATGTCACAGCCAGGGCTGG | 43 |
| SEQ ID NO: 273 | TCTCCTGTTATTTCTTTTAAAATAAATATATCATTTAAAT | 15 |
| SEQ ID NO: 274 | AAATAAGCAAACCCTGCTCGGGAATGGGAGGGAGAGTCTC | 53 |
| SEQ ID NO: 275 | GTCCACCCCTTCTCGGCCCTGGCTCTGCAGATAGTGCTAT | 60 |
| SEQ ID NO: 276 | GCCCTGACAGAGCCCTGCCCATTGCTGGGCCTTGGAGTGA | 65 |
| SEQ ID NO: 277 | GCCTAGTAGAGAGGCAGGGCAAGCCATCTCATAGCTGCTG | 58 |
| SEQ ID NO: 278 | GGAGAGAGAAAAGGGCTCATTGTCTATAAACTCAGGTCAT | 43 |
| SEQ ID NO: 279 | ATTCTTATTCTCACACTAAGAAAAAGAATGAGATGTCTAC | 30 |
| SEQ ID NO: 280 | ACCCTGCGTCCCCTCTTGTGTACTGGGGTCCCCAAGAGCT | 63 |
| SEQ ID NO: 281 | AAAAGTGATGGCAAAGTCATTGCGCTAGATGCCATCCCAT | 45 |
| SEQ ID NO: 282 | TATAAACCTGCATTTGTCTCCACACACCAGTCATGGACAA | 43 |
| SEQ ID NO: 283 | CCTCCTCCCAGGTCCACGTGCTTGTCTTTGTATAATACTC | 50 |
| SEQ ID NO: 284 | AATTTCGGAAAATGTATTCTTTCAATCTTGTTCTGTTATT | 25 |
| SEQ ID NO: 285 | TTTCAATGGCTTAGTAGAAAAAGTACATACTTGTTTTCCC | 33 |
| SEQ ID NO: 286 | ATTGACAATAGACAATTTCACATCAATGTCTATATGGGTC | 33 |
| SEQ ID NO: 287 | TGTTTGCTGTGTTTGCAAAAACTCACAATAACTTTATATT | 28 |
| SEQ ID NO: 288 | CTACTCTAAGAAAGTTACAACATGGTGAATACAAGAGAAA | 33 |
| SEQ ID NO: 289 | TTACAAGTCCAGAAAATAAAAGTTATCATCTTGAGGCCTC | 35 |
| SEQ ID NO: 290 | TTCTAGGAATAATATCAATATTACAAAATTAATCTAACAA | 18 |
| SEQ ID NO: 291 | GAACAGCAATGAGATAATGTGTACAAAGTACCCAGACCTA | 40 |
| SEQ ID NO: 292 | GTAGAGCATCAAGGAAGCGCATTGCGGAGCAGTTTTTGT | 48 |
| SEQ ID NO: 293 | TTGTTTTGTATTCTGTTTCGTGAGGCAAGGTTTCACTCT | 38 |
| SEQ ID NO: 294 | TCCAGGCTGGAGTGCAGTGGCAAGATCATGTCTCACTGCA | 55 |

TABLE 2-continued

Exemplary Probe Nucleotide Sequences

| SEQ ID NO | Nucleotide Sequence | % GC Content |
| --- | --- | --- |
| SEQ ID NO: 295 | TGACCTCCTGAGCTCAAGGGATCCTCCCATTTCGGCCTCC | 60 |
| SEQ ID NO: 296 | TAGCTGGGACTACAGGTGTACATCACATGCCTGGCTAATT | 48 |
| SEQ ID NO: 297 | TTTTTTTTTTAAGTAGAGACGAGGTCTTGCTATGTTGTCC | 35 |
| SEQ ID NO: 298 | TAATATCAAACTCTTGAGCTCAAGCAGTCCTCCCACTTCT | 43 |
| SEQ ID NO: 299 | TGGAGGTATCCAGTATGAAATTTAGATAATACCTGCCTTC | 38 |
| SEQ ID NO: 300 | GTTGAAATTAGAACTTAATGATATAATGCATCAATGAACT | 25 |
| SEQ ID NO: 301 | ATAGTTCCTAGCACAAAGTAAGAATCCTTTCAATGTGTGT | 35 |
| SEQ ID NO: 302 | GTGTATGTATTTATCTGTTATTAATAGGAATCTTATGGGC | 30 |
| SEQ ID NO: 303 | TCTCACTTAATCCTTATTAATAACTATGAAGCAGGTATTT | 28 |
| SEQ ID NO: 304 | GAGTTTTCCAAGTGAGTTAAGTATAGCTTGTAATACTTAA | 30 |
| SEQ ID NO: 305 | ATATCCACAGGTTACATAGCTAGTATATAACTGAGAAATA | 30 |
| SEQ ID NO: 306 | TATTTATATTATAAAACATTCTAACAATACAGATGTATAT | 15 |
| SEQ ID NO: 307 | TAAAAAACTGAAAGGGCTCATGCAACCCTACCTTCTCAAT | 40 |
| SEQ ID NO: 308 | CTTCTTCACTTAGAAAAAACCAGCCTTAGCTGTCTGCTAT | 40 |
| SEQ ID NO: 309 | CCTTTCAAAATATACTTCTGAGAAATGAGAGAGAGAAATG | 33 |
| SEQ ID NO: 310 | GGGTAGAAGGAAGGAAGATAGGGTAAGAGACAGGGAAGGA | 50 |
| SEQ ID NO: 311 | TGGGGAAAGAAATTAAATTATTCTTTTCTCTGTCTCTTGA | 30 |
| SEQ ID NO: 312 | GCTCTTTCCATTACATTGAATCAAAGGTAATGTTGCCATT | 35 |
| SEQ ID NO: 313 | GACTCTTGAAATAAAGAAAGACCGATGTATGAAATAATTT | 28 |
| SEQ ID NO: 314 | AGTCTATGGCATTTTCAAAATGCAAGGTGATGTCTTACTA | 35 |
| SEQ ID NO: 315 | GCCTTTGCTTTATTATTAGAAATGGGGAAGTGAGTATAGA | 35 |
| SEQ ID NO: 316 | TTATCAGGAGATATATTAGGAAAAAGGGAAACTGGAGAAA | 33 |
| SEQ ID NO: 317 | GAGGAGTATCCAGATGTCCTGTCCCTGTAAGGTGGGGGCA | 58 |
| SEQ ID NO: 318 | CCTTCAATCAAAAGGGCTCCTTAACAACTTCCTTGCTTGG | 45 |
| SEQ ID NO: 319 | CCACCATCTTGGACCATTAGCTCCACAGGTATCTTCTTCC | 50 |
| SEQ ID NO: 320 | AGTGGTCATAACAGCAGCTTCAGCTACCTCTCTAAAGAGT | 45 |
| SEQ ID NO: 321 | CCAGATATAGGTCAGGAAATATAATCCACTAATAAAAAGA | 30 |
| SEQ ID NO: 322 | CATTTGACTGTAGTTGTTTGTTTTTTGTCATTGTGACTA | 30 |
| SEQ ID NO: 323 | TAACATTCTCACTCTTTCATCAGTAATCACTCAGGTTATT | 33 |
| SEQ ID NO: 324 | GACCAACAGACTGTGGAAAAATCAGAGAAGGAGGCATCC | 50 |
| SEQ ID NO: 325 | GCTTACTAGCCTAAACTGAAATTGCTATAGCAGAGTGAAC | 40 |
| SEQ ID NO: 326 | AGGTTTACAGATATTTTCCACAAAGAGTAAAAGGATTGAA | 30 |
| SEQ ID NO: 327 | TCTCCAGATCAATGCATAGGAAATAATAATGGACCATAAA | 33 |
| SEQ ID NO: 328 | ATATTATGACGAACAACATTAGGATAAGTCCATATCAATT | 28 |
| SEQ ID NO: 329 | ATCCAGTCATAAGCACAGACTACGTGAAGCACGTCCAAGT | 48 |
| SEQ ID NO: 330 | GCAGGAGAAATGAGAGGAGCAAGAAAGAGGAGCCATTTGA | 48 |
| SEQ ID NO: 331 | GAATAGCAGAAAAAGGAAAGGCAAGTCATATTAACAAATG | 33 |

TABLE 2-continued

Exemplary Probe Nucleotide Sequences

| SEQ ID NO | Nucleotide Sequence | % GC Content |
| --- | --- | --- |
| SEQ ID NO: 332 | TCATGCCAACAGTACAGATAACTCTGCTAATAAAGGTAGA | 38 |
| SEQ ID NO: 333 | TAATACAGGTAGTAGCAGATATCTACATAGTAGTTAAAGG | 33 |
| SEQ ID NO: 334 | GGCCATCAGTACAGAAGATTCCATAAAGGAGAACCTAAAG | 43 |
| SEQ ID NO: 335 | AGAATAATTTGTCAGAAGCTTAAAAGCTGAACTCTGAGGC | 38 |
| SEQ ID NO: 336 | AACTACAATATCCTTTTGACTGTGGAAAGGGTGGTGAAAG | 40 |
| SEQ ID NO: 337 | GTTCAAGGACATTTGAGCCAACATAGAGAGGAACATTGGC | 45 |
| SEQ ID NO: 338 | TGAGGGATATCTGTCCTGATGTTGTCCAGGATGGTGATGA | 48 |
| SEQ ID NO: 339 | CATATAAATAACGTAGAGAAAACAGGAGGGGATAGAGATC | 38 |
| SEQ ID NO: 340 | CAAAGAGGCATCAAAGATAGGGATGTTTGTAAGGATGAAA | 38 |
| SEQ ID NO: 341 | CTGTTCTTCTCTGAGTAGCCAAGCTCAGCTTGGTTCAAGC | 50 |
| SEQ ID NO: 342 | CATACTGTGGATCTGTAGCAAATTCCCCCTGAAAACCCAG | 48 |
| SEQ ID NO: 343 | TCTGACCCTCACATTCAAGTTCTGAGGAAGGGCCACTGCC | 55 |
| SEQ ID NO: 344 | GCCTTGAGATACCTGGTCCTTATTCCTTGGACTTTGGCAA | 48 |
| SEQ ID NO: 345 | ATAGGGCTTGTTTTAGGGAGAAACCTGTTCTCCAAACTCT | 43 |
| SEQ ID NO: 346 | CTGGTGTCCATACTCTGAATGGGAAGAATGATGGGATTAC | 45 |
| SEQ ID NO: 347 | AGCAGGAGAGGATCAACCCCATACTCTGAATCTAAGAGAA | 45 |
| SEQ ID NO: 348 | TCAGATCCCTGGATGCAAGCCAGGTCTGGAACCATAGGCA | 55 |
| SEQ ID NO: 349 | CTCCTCCCTACCACCTTTAGCCATAAGGAAACATGGAATG | 48 |
| SEQ ID NO: 350 | GACACAAACCTGGGCCTTTCAATGCTATAACCTTTCTTGA | 43 |
| SEQ ID NO: 351 | CTACCTGACTTCTGAGTCAGGATTTATAAGCCTTGTTACT | 40 |
| SEQ ID NO: 352 | TGAACCAACAAGCATCGAAGCAATAATGAGACTGCCCGCA | 48 |
| SEQ ID NO: 353 | GAAAAGCAATAATCCATTTTTCATGGTATCTCATATGATA | 28 |
| SEQ ID NO: 354 | TAACACTTATCTCTCTGAACTTTGGGCTTTTAATATAGGA | 33 |
| SEQ ID NO: 355 | TTTTCTGACTGTCTAATCTTTCTGATCTATCCTGGATGGC | 40 |
| SEQ ID NO: 356 | ATCTTCATCGAATTTGGGTGTTTCTTTCTAAAAGTCCTTT | 33 |
| SEQ ID NO: 357 | GAAATTACAAATGCTAAAGCAAACCCAAACAGGCAGGAAT | 38 |
| SEQ ID NO: 358 | ATTAGGCATCTTACAGTTTTTAGAATCCTGCATAGAACTT | 33 |
| SEQ ID NO: 359 | TACAATATTTGACTCTTCAGGTTAAACATATGTCATAAAT | 25 |
| SEQ ID NO: 360 | AACATTCAGTGAAGTGAAGGGCCTACTTTACTTAACAAGA | 38 |
| SEQ ID NO: 361 | TCTTTTCCTATCAGTGGTTTACAAGCCTTGTTTATATTTT | 30 |
| SEQ ID NO: 362 | TATTTTGTTCTGAGAATATAGATTTAGATACATAATGGA | 23 |
| SEQ ID NO: 363 | CAAAATCTAACACAAAATCTAGTAGAATCATTTGCTTACA | 28 |
| SEQ ID NO: 364 | AGAATTTATGACTTGTGATATCCAAGTCATTCCTGGATAA | 33 |
| SEQ ID NO: 365 | TTACACTAGAAAATAGCCACAGGCTTCCTGCAAGGCAGCC | 50 |
| SEQ ID NO: 366 | AGTTTGAACACTTGTTATGGTCTATTCTCTCATTCTTTAC | 33 |
| SEQ ID NO: 367 | ACTTCGTGAGAGATGAGGCAGAGGTACACTACGAAAGCAA | 48 |
| SEQ ID NO: 368 | TCTTGAGAATGAGCCTCAGCCCTGGCTCAAACTCACCTGC | 55 |
| SEQ ID NO: 369 | AATAGGATGTCTGTGCTCCAAGTTGCCAGAGAGAGAGATT | 45 |

TABLE 2-continued

Exemplary Probe Nucleotide Sequences

| SEQ ID NO | Nucleotide Sequence | % GC Content |
|---|---|---|
| SEQ ID NO: 370 | ATTAAAGATCCCTCCTGCTTAATTAACATTCACAAGTAAC | 33 |
| SEQ ID NO: 371 | ACTTAAAGTAGCGATACCCTTTCACCCTGTCCTAATCACA | 43 |
| SEQ ID NO: 372 | TCTCAGGTGTTAACTTTATAGTGAGGACTTTCCTGCCATA | 40 |
| SEQ ID NO: 373 | ATAGTTTCATATAAATGGGTTCCTCATCATCTATGGGTAC | 35 |
| SEQ ID NO: 374 | GGTATTTACATTTGCCATTCCCTATGCCCTAAATATTTAA | 33 |
| SEQ ID NO: 375 | TATTGATATTCCTTGAAAATTCTAAGCATCTTACATCTTT | 25 |
| SEQ ID NO: 376 | CTTTTATTCTCCCCTTCACCGAATCTCATCCTACATTGGC | 45 |
| SEQ ID NO: 377 | TAGTGTCCCAAATTTTATAATTTAGGACTTCTATGATCTC | 30 |
| SEQ ID NO: 378 | ATATGGTCACCTCTTTGTTCAAAGTCTTCTGATAGTTTCC | 38 |
| SEQ ID NO: 379 | ACAATCTTCCTGCTTCTACCACTGCCCCACTACAATTTCT | 45 |
| SEQ ID NO: 380 | AGTCACTGTCACCACCACCTAAATTATAGCTGTTGACTCA | 43 |
| SEQ ID NO: 381 | CTGACCCCTTGCCTTCACCTCCAATGCTACCACTCTGGTC | 58 |
| SEQ ID NO: 382 | AGAAAATCCTGTTGGTTTTTCGTGAAAGGATGTTTTCAGA | 35 |
| SEQ ID NO: 383 | ACATATACTCACAGCCAGAAATTAGCATGCACTAGAGTGT | 40 |
| SEQ ID NO: 384 | ACCCAAAGACTCACTTTGCCTAGCTTCAAAATCCTTACTC | 43 |
| SEQ ID NO: 385 | TGAGGTAGAGACTGTGATGAACAAACACCTTGACAAAATT | 38 |
| SEQ ID NO: 386 | TCCATATCCACCCACCCAGCTTTCCAATTTTAAAGCCAAT | 43 |
| SEQ ID NO: 387 | AAGGTATGATGTGTAGACAAGCTCCAGAGATGGTTTCTCA | 43 |
| SEQ ID NO: 388 | CTCTGGTCAGCATCCAAGAAATACTTGATGTCACTTTGGC | 45 |
| SEQ ID NO: 389 | AACTGTGAACTTCCTTCAGCTAGAGGGGCCTGGCTCAGAA | 53 |
| SEQ ID NO: 390 | TGATTGTTCTCTGACTTATCTACCATTTTCCCTCCTTAAA | 35 |
| SEQ ID NO: 391 | AAACAAAACCCATCAAATTCCCTGACCGAACAGAATTCTG | 40 |
| SEQ ID NO: 392 | CAGAGGTCACAGCCTAAACATCAAATTCCTTGAGGTGCGG | 50 |
| SEQ ID NO: 393 | GAAGGCAGGTGTGGCTCTGCAGTGTGATTGGGTACTTGCA | 55 |
| SEQ ID NO: 394 | CATGGAGGAAAAACTCATCAGGGATGGAGGCACGCCTCTA | 53 |
| SEQ ID NO: 395 | AGCTTGTTAAATTGAATTCTATCCTTCTTATTCAATTCTA | 25 |
| SEQ ID NO: 396 | CATAGTTGTCAGCACAATGCCTAGGCTATAGGAAGTACTC | 45 |
| SEQ ID NO: 397 | GCAGATATAGCTTGATGGCCCCATGCTTGGTTTAACATCC | 48 |
| SEQ ID NO: 398 | CTAAATAACTAGAATACTCTTTATTTTTTCGTATCATGAA | 23 |
| SEQ ID NO: 399 | AGTGTTTAAAGGGTGATATCAGACTAAACTTGAAATATGT | 30 |
| SEQ ID NO: 400 | GGATGGGTCTAGAAAGACTAGCATTGTTTTAGGTTGAGTG | 43 |
| SEQ ID NO: 401 | TGCTGCCAACATTAACAGTCAAGAAATACCTCCGAATAAC | 40 |
| SEQ ID NO: 402 | TATTGTGAGAGGTCTGAATAGTGTTGTAAAATAAGCTGAA | 33 |
| SEQ ID NO: 403 | TTACAACATGATGGCTTGTTGTCTAAATATCTCCTAGGGA | 38 |
| SEQ ID NO: 404 | CTAAGTAGAAGGGTACTTTCACAGGAACAGAGAGCAAAAG | 43 |
| SEQ ID NO: 405 | GTCTTGTATTGCCCAGTGACATGCACACTGGTCAAAAGTA | 45 |
| SEQ ID NO: 406 | CCCTATGTCTTCCCTGATGGGCTAGAGTTCCTCTTTCTCA | 50 |

TABLE 2-continued

Exemplary Probe Nucleotide Sequences

| SEQ ID NO | Nucleotide Sequence | % GC Content |
|---|---|---|
| SEQ ID NO: 407 | AAAGTTTCCCCAAATTTTACCAATGCAAGCCATTTCTCCA | 38 |
| SEQ ID NO: 408 | AACTGCAGATTCTCTGCATCTCCCTTTGCCGGGTCTGACA | 53 |
| SEQ ID NO: 409 | TAGTGCTGTGGTGCTGTGATAGGTACACAAGAAATGAGAA | 43 |
| SEQ ID NO: 410 | TAACTAGCGTCAAGAACTGAGGGCCCTAAACTATGCTAGG | 48 |
| SEQ ID NO: 411 | CATTGGCTCCGTCTTCATCCTGCAGTGACCTCAGTGCCTC | 58 |
| SEQ ID NO: 412 | TGTTTATGTGTTATAGTGTTCATTTACTCTTCTGGTCTAA | 30 |
| SEQ ID NO: 413 | CCTTTGACCCCTTGGTCAAGCTGCAACTTTGGTTAAAGGG | 50 |
| SEQ ID NO: 414 | TTCTCTTGGGTTACAGAGATTGTCATATGACAAATTATAA | 30 |
| SEQ ID NO: 415 | TGGAAGTTGTGGTCCAAGCCACAGTTGCAGACCATACTTC | 50 |
| SEQ ID NO: 416 | CTGCCCTGTGGCCCTTGCTTCTTACTTTTACTTCTTGTCG | 50 |
| SEQ ID NO: 417 | AACTCAGATATTGTGGATGCGAGAAATTAGAAGTAGATAT | 33 |
| SEQ ID NO: 418 | TACAGAACCACCAAGTAGTAAGGCTAGGATGTAGACCCAG | 48 |
| SEQ ID NO: 419 | TGAGCTCTCCTACTGTCTACATTACATGAGCTCTTATTAA | 38 |
| SEQ ID NO: 420 | AAGCTAATAAGTAGACAATTAGTAATTAGAAGTCAGATGG | 30 |
| SEQ ID NO: 421 | AGCCCAATGTACTTGTAGTGTAGATCAACTTATTGAAAGC | 38 |
| SEQ ID NO: 422 | CCAATACTCAGAAGTAGATTATTACCTCATTTATTGATGA | 30 |
| SEQ ID NO: 423 | GCTAGAATCAAATTTAAGTTTATCATATGAGGCCGGGCAC | 40 |
| SEQ ID NO: 424 | TAATACTAATGATAAGTAACACCTCTTGAGTACTTAGTAT | 28 |
| SEQ ID NO: 425 | ATGGTAATTCTGTGAGATATGTATTATTGAACATACTATA | 25 |
| SEQ ID NO: 426 | TGAAAGAAGTGGGAATTAATACTTACTGAAATCTTTCT | 30 |
| SEQ ID NO: 427 | GAGAGACACGAGGAAATAGTGTAGATTTAGGCTGGAGGTA | 45 |
| SEQ ID NO: 428 | GTTGAGAGGGAAACAAGATGGTGAAGGGACTAGAAACCAC | 48 |
| SEQ ID NO: 429 | CAAGGTTCTGAACATGAGAAATTTTAGGAATCTGCACAG | 38 |
| SEQ ID NO: 430 | TGCCATCTAAAAAAATCTGACTTCACTGGAAACATGGAAG | 38 |
| SEQ ID NO: 431 | GGGATCCTCTCTTAAGTGTTTCCTGCTGGAATCTCCTCAC | 50 |
| SEQ ID NO: 432 | GTTTCCTTCATGTGACAGGGAGCCTCCTGCCCCGAACTTC | 58 |
| SEQ ID NO: 433 | TTGGATAAGAGTAGGGAAGAACCTAGAGCCTACGCTGAGC | 50 |
| SEQ ID NO: 434 | ATCTGGGGCTTTGTGAAGACTGGCTTAAAATCAGAAGCCC | 48 |
| SEQ ID NO: 435 | ACCGCAATGCTTCCTGCCCATTCAGGGCTCCAGCATGTAG | 58 |
| SEQ ID NO: 436 | TATGGGAAGCAGGGTATGAAAGAGCTCTGAATGAAATGG | 45 |
| SEQ ID NO: 437 | GGTTGCATGAATCAGATTATCAACAGAAATGTTGAGACAA | 35 |
| SEQ ID NO: 438 | AATGCAGGCCTAGGCATGACTGAAGGCTCTCTCATAATTC | 48 |
| SEQ ID NO: 439 | TAACGTTTTCTTGTCTGCTACCCCATCATATGCACAACAA | 40 |
| SEQ ID NO: 440 | TTAATTCCCAAACTCATATAGCTCTGAGAAAGTCTATGCT | 35 |
| SEQ ID NO: 441 | CCCTATAGGGGATTTCTACCCTGAGCAAAGGCTGGTCTT | 50 |
| SEQ ID NO: 442 | TCCTCACCATATAGAAAGCTTTTAACCCATCATTGAATAA | 33 |
| SEQ ID NO: 443 | TAAGCTGTCTAGCAAAAGCAAGGGCTTGGAAAATCTGTGA | 43 |
| SEQ ID NO: 444 | AGGATTAGAAGATTCTTCTGTGTGTAAGAATTTCATAAAC | 30 |

TABLE 2-continued

Exemplary Probe Nucleotide Sequences

| SEQ ID NO | Nucleotide Sequence | % GC Content |
| --- | --- | --- |
| SEQ ID NO: 445 | ATTATCTTCTGGAATAGGGAATCAAGTTATATTATGTAAC | 28 |
| SEQ ID NO: 446 | CTCTCTGGTTGACTGTTAGAGTTCTGGCACTTGTCACTAT | 45 |
| SEQ ID NO: 447 | TCTTCAGTTAGATGGTTAACTTTGTGAAGTTGAAAACTGT | 33 |
| SEQ ID NO: 448 | CTACACCATGTGGAGAAGGGGTGGTGGTTTTGATTGCTGC | 53 |
| SEQ ID NO: 449 | ACTTTCCTAACCTGAGCCTAACATCCCTGACATCAGGAAA | 45 |
| SEQ ID NO: 450 | TACACTTTATTCGTCTGTGTCCTGCTCTGGGATGATAGTC | 45 |
| SEQ ID NO: 451 | TACTCTTTGCATTCCACTGTTTTTCCTAAGTGACTAAAAA | 33 |
| SEQ ID NO: 452 | AAAGGCCTCCCAGGCCAAGTTATCCATTCAGAAAGCATTT | 45 |
| SEQ ID NO: 453 | TATTGACATGTACTTCTTGGCAGTCTGTATGCTGGATGCT | 43 |
| SEQ ID NO: 454 | TTTGGTCCTAATTATGTCTTTGCTCACTATCCAATAAATA | 30 |
| SEQ ID NO: 455 | GTTAAAAAAACTACCTCTCAACTTGCTCAAGCATACACTC | 38 |
| SEQ ID NO: 456 | TAATTAGTGCTTTGCATAATTAATCATATTTAATACTCTT | 20 |
| SEQ ID NO: 457 | ACTAGTGTTCTGTACTTTATGCCCATTCATCTTTAACTGT | 35 |
| SEQ ID NO: 458 | GTATTTTTGTTTAACTGCAATCATTCTTGCTGCAGGTGA | 35 |
| SEQ ID NO: 459 | GCAGTGACTTATAAATGCTAACTACTCTAGAAATGTTTGC | 35 |
| SEQ ID NO: 460 | TTATAAGCATGATTACAGGAGTTTTAACAGGCTCATAAGA | 33 |
| SEQ ID NO: 461 | AGTATCCCTCAAGTAGTGTCAGGAATTAGTCATTTAAATA | 33 |
| SEQ ID NO: 462 | AGTCACCCATTTGGTATATTAAAGATGTGTTGTCTACTGT | 35 |
| SEQ ID NO: 463 | TGGTCATAAAACATTGAATTCTAATCTCCCTCTCAACCCT | 38 |
| SEQ ID NO: 464 | ACAGTTGAAAAGACCTAAGCTTGTGCCTGATTTAAGCCTT | 40 |
| SEQ ID NO: 465 | CAACTACAGGGCCTTGAACTGCACACTTTCAGTCCGGTCC | 55 |
| SEQ ID NO: 466 | GTGGTTCTTTGAAGAGACTTCCACCTGGGAACAGTTAAAC | 45 |
| SEQ ID NO: 467 | TGGAGGAAATATTTATCCCCAGGTAGTTCCCTTTTTGCAC | 43 |
| SEQ ID NO: 468 | GCCTGGTGCTTTTGGTAGGGAGCTTGCACTTTCCCCCTT | 58 |
| SEQ ID NO: 469 | TCTCATTTCTTTGAGAACTTCAGGGAAAATAGACAAGGAC | 38 |
| SEQ ID NO: 470 | CAAACTTTTCAAGCCTTCTCTAATCTTAAAGGTAAACAAG | 33 |
| SEQ ID NO: 471 | TCAACAAAGGAGAAAAGTTTGTTGGCCTCCAAAGGCACAG | 45 |
| SEQ ID NO: 472 | GATGCAACAGACCTTGGAAGCATACAGGAGAGCTGAACTT | 48 |
| SEQ ID NO: 473 | CATCTGAGATCCCAGCTTCTAAGACCTTCAATTCTCACTC | 45 |
| SEQ ID NO: 474 | TATCTTAACAGTGAGTGAACAGGAAATCTCCTCTTTTCCC | 40 |
| SEQ ID NO: 475 | AACTCATGCTTTGTAGATGACTAGATCAAAAAATTTCAGC | 33 |
| SEQ ID NO: 476 | TCAAAGGAAGTCAAAAGATGTGAAAAACAATTTCTGACCC | 35 |
| SEQ ID NO: 477 | TGCCTTCACTTAAGTAATCAATTCCTAGGTTATATTCTGA | 33 |
| SEQ ID NO: 478 | CCCTACCTTGTTCAAAATGTTCCTGTCCAGACCAAAGTAC | 45 |
| SEQ ID NO: 479 | GCACTTACAAATTATACTACGCTCTATACTTTTTGTTTAA | 28 |
| SEQ ID NO: 480 | CTTTAGTTTCATTTCAAACAATCCATACACACACAGCCCT | 38 |
| SEQ ID NO: 481 | TAGGGACCACAGGGTTAAGGGGGCAGTAGAATTATACTCC | 50 |

TABLE 2-continued

Exemplary Probe Nucleotide Sequences

| SEQ ID NO | Nucleotide Sequence | % GC Content |
| --- | --- | --- |
| SEQ ID NO: 482 | CTCACAATTAAGCTAAGCAGCTAAGAGTCTTGCAGGGTAG | 45 |
| SEQ ID NO: 483 | GTTGAAAGACAGAGAGGATGGGGTGCTATGCCCCAAATCA | 50 |
| SEQ ID NO: 484 | GCTTGTCTAATTTTATATATCACCCTACTGAACATGACCC | 38 |
| SEQ ID NO: 485 | AATATTGTACACGTACACCAAAGCATCATGTTGTACCCCA | 40 |
| SEQ ID NO: 486 | TGTGAAGTGGTGGATTTGTTAATTAGCCTTATTTAACCAT | 33 |
| SEQ ID NO: 487 | TGACACATATGACATTTTAACTATGTTCCAGATTTTTGAA | 28 |
| SEQ ID NO: 488 | GCAAGGAATCATTCAATGTTTTCTAAATCTATTACTGCAT | 30 |
| SEQ ID NO: 489 | CATTTTCATAGGTTTTCCTCGATTGATCATTATTCATGAT | 30 |
| SEQ ID NO: 490 | AAAGTGATCAAGATATTTTTAGTTCAGGCTCCAAAATTTT | 28 |
| SEQ ID NO: 491 | CTTTACAGGCCGAGAAAAATGAATCTGAATTCCTGACCTC | 43 |
| SEQ ID NO: 492 | TCCACTCAAGGCCTACATTCTGCTATAATGCAATTTCAAG | 40 |
| SEQ ID NO: 493 | AACTGCTTAAAATTAATGGCACAAGTCATGTTTTTGATGT | 30 |
| SEQ ID NO: 494 | CTGACTGTGACGTAGCAATAAAGAAACCCACGTTTCATAT | 40 |
| SEQ ID NO: 495 | CTGGCCCACTGCTTGGAGGAGAGCACTCAGGACCATGAAC | 60 |
| SEQ ID NO: 496 | TTCTGAAATGATAAAGTCAATCACAGGAAGGCACCTGGAC | 43 |
| SEQ ID NO: 497 | ATCATTCTCTTTCCCTTCCTCTATGTGGCAGAAAGTAAAA | 38 |
| SEQ ID NO: 498 | GGAGATAATAATGTGTTACTCCCTAAGGCAGAGTGCCCTT | 45 |
| SEQ ID NO: 499 | CAATTAACTTGGCCATGTGACTGGTTGTGACTAAAATAAT | 35 |
| SEQ ID NO: 500 | CACTAAATCAATATACTTCTCAACAATTTCCAACAGCCCT | 35 |
| SEQ ID NO: 501 | CTAGGCTCCTGAGTTTGCTGGGGATGCGAAGAACCCTTAT | 53 |
| SEQ ID NO: 502 | CCGAGGACCCCGCACTCGGAGCCGCCAGCCGGCCCCACCG | 83 |
| SEQ ID NO: 503 | TTGGAAGCACAGGGTGTGGGATAATGCTAATTACTAGTGA | 43 |
| SEQ ID NO: 504 | GTTCAGTATGCCTTTGATTTTACAATAATATTCCTGTTAT | 28 |
| SEQ ID NO: 505 | AGATTCCATGAAGTATTACAGCATTTGGTAGTCTTTTTGC | 35 |
| SEQ ID NO: 506 | TATTTGCTCTGAAATAAGACATAATTTGGGGTGAGAAAGC | 35 |
| SEQ ID NO: 507 | ACTCATGATATTTGGCTCTAGAATACATGCTCTGAATCAT | 35 |
| SEQ ID NO: 508 | TCCAAGATGAAGTGGCTACTAACTGACAGAGGGCATAATT | 43 |
| SEQ ID NO: 509 | TATTCACAGTAACTCTGTGCCTCAAGTACTATTGTAATAC | 35 |
| SEQ ID NO: 510 | ACATCCTCAATCTACACACTAGGATAGTATAAAAGTAATA | 30 |
| SEQ ID NO: 511 | GTCTACCCATATGTGACCTTCATGTCTTTGCTCTAAGCCC | 48 |
| SEQ ID NO: 512 | CGTGTAATCCTTGACAATGTCATCTCATCTATTTATTCCC | 38 |
| SEQ ID NO: 513 | TCTGAAAGAGACTAACCTTCCCTCGCTTTGCAGAGAAAGA | 45 |
| SEQ ID NO: 514 | ATGCATGGATTCTCTTGAAAAAATGTTTCTGCCATGATGT | 35 |
| SEQ ID NO: 515 | TAGTTGAAGACCTACTGTGTTCAGGGCCGTGAGCCAGGGC | 58 |
| SEQ ID NO: 516 | CAACGTGGAGAGCTGTCCTGGCACCATTTCTTCCTGCTGT | 55 |
| SEQ ID NO: 517 | ATCCTCAAAGGAGCCTGGCTTGGGCTAACAAGGAAGAACT | 50 |
| SEQ ID NO: 518 | TGCCTGGGACCCTGCCCCAAGCAAAGTAATAATCTGAATG | 50 |
| SEQ ID NO: 519 | CTGGTGTGTCCAGTGTGATCCCTGCACCCATGCCCGGAGC | 65 |

TABLE 2-continued

Exemplary Probe Nucleotide Sequences

| SEQ ID NO | Nucleotide Sequence | % GC Content |
|---|---|---|
| SEQ ID NO: 520 | CTGCCCCTGCAGCAGGGAAGGGGCTCTGGAAGGGTCTGA | 68 |
| SEQ ID NO: 521 | TAGCTGCTGCCCCACTATGCACCATCGCTTATCTGTTCTT | 50 |
| SEQ ID NO: 522 | GAAACCCGAAAAATGTCCTGGTCCTCTTCTTAAGTCTGGG | 48 |
| SEQ ID NO: 523 | GCTGAGAACATGACTCTGCTTGGCGTTCCATTTAATTGAC | 45 |
| SEQ ID NO: 524 | GAGAGGGTGTGCATTTGAAGTATAGATTTGTTAAACATAG | 35 |
| SEQ ID NO: 525 | CATCAGGCAAAAATACTTCGATGGGACTGTGTTCTTTCAG | 43 |
| SEQ ID NO: 526 | TCTAAAGTGATGTAATGTTGCCACGGAAATTCTAATCCCT | 38 |
| SEQ ID NO: 527 | CGTGCAGAACCAGCTCTGTCTTCCCAGACACTGTCGCTTT | 55 |
| SEQ ID NO: 528 | ACCCCTGAGCACCTCAGTGTCCGTGACTGTGGAGCGGAGG | 65 |
| SEQ ID NO: 529 | CTGCCTGGGACACGTACGGCTGCCCAGTGATCCTGAGCGC | 68 |
| SEQ ID NO: 530 | CACAGCCGGATGGTGTGGGAGCTGGCACTGCCGGGGCTCC | 73 |
| SEQ ID NO: 531 | CGTCTTGGCAGAGGCTCCCTGTCATCAAGGACCTGAGGTT | 58 |
| SEQ ID NO: 532 | GACCCCACAAAGATGAGCGGGTCCCCTTCCCAATTTTCGG | 58 |
| SEQ ID NO: 533 | TCAGGAAGCCGGTGCTCAGCAAACTTATCTGAAGCTCTTG | 50 |
| SEQ ID NO: 534 | GAGGCTGCAGAGGAACATCGTTTGGTCAAATGTGAAATGT | 45 |
| SEQ ID NO: 535 | CTAGCTTCTAGAAAGTGCTGCCAATTTGGGGACCAAGGGA | 50 |
| SEQ ID NO: 536 | GGAAACACTTCTTTTTCCCTTGACAAAGGACATCCTCTGC | 45 |
| SEQ ID NO: 537 | GCATGTGCATAAACACTCGTGTGTGTGTCCTTTTATCCCA | 45 |
| SEQ ID NO: 538 | CCAAATCTCTATACATGTCCATAGAGAGAGGCAGACGTAT | 43 |
| SEQ ID NO: 539 | GGGTTGAAGACAAGGGGCTCAGAGCTTGCTTTTTATACAC | 48 |
| SEQ ID NO: 540 | AGATTCATCTTCATGGCAGGACTTCAGGCAAGAGAGGCCC | 53 |
| SEQ ID NO: 541 | CTCACCCCTTAGCAGGACCCTGACGGAACTGGGTACAGGC | 63 |
| SEQ ID NO: 542 | GGTTGGGAGACAATGGGTGGCCCCTCGGTGTGGTGTCCTC | 65 |
| SEQ ID NO: 543 | AGAGTCTAGAGGGCCCGTGGGGACGGGAGTCCTGGGAACC | 68 |
| SEQ ID NO: 544 | GCGGCATGTCCGGCTTCACCCTGCCCAGAATCACAGCCTC | 65 |
| SEQ ID NO: 545 | ATGGTTAAAAAATTCTCCTACTTAAGACTCCCAGACCCCT | 40 |
| SEQ ID NO: 546 | TGAGATTCCAGGGCTGGTTCCACAACGGCCGGCATCGGCC | 65 |
| SEQ ID NO: 547 | CTGAGTCACTAACAAAGCTCAGGCCTGACCACAGGACATT | 50 |
| SEQ ID NO: 548 | GGCTGGCCTACCTGCCACGGGGCCAGGGCTGGGTGCTTTC | 73 |
| SEQ ID NO: 549 | GGGCTCTGGACGCTGGAGGCCTGAGGCTGCACCCCAGGTT | 70 |
| SEQ ID NO: 550 | ACAGTGGCCACTCACCCACTGGGCCCACATCCCCACAGGC | 68 |
| SEQ ID NO: 551 | ACTCTGCCAGCCTTTGATGCCTCGCTGAGACAGAGGGTCT | 58 |
| SEQ ID NO: 552 | AGCCGGGGCTCTGGCCCCATCCAGGGGCTCCCCCAGCAGC | 78 |
| SEQ ID NO: 553 | CCTTGGAAGTCAGTCAGCAGGTCAGGACACAGTTCAGCCC | 58 |
| SEQ ID NO: 554 | TTACATGCAGTTGGTCTTCTCCTGTGAATGGGAAACTGA | 45 |
| SEQ ID NO: 555 | CTGCATCACAGAACAGCTGCATTTCTAATGTCAGGCTTCT | 45 |
| SEQ ID NO: 556 | CAGCCTGGGAGGCTTGTCAACCTCCTTTGACAAGCACGCC | 60 |

TABLE 2-continued

Exemplary Probe Nucleotide Sequences

| SEQ ID NO | Nucleotide Sequence | % GC Content |
|---|---|---|
| SEQ ID NO: 557 | AGAAACTGGGGCTCCAGGGCATGGAGGCTGCCTGTGGCCA | 65 |
| SEQ ID NO: 558 | TCCCGGCCTGGAGGAAGTCTTATTAGCCTCATTTCATGGA | 50 |
| SEQ ID NO: 559 | TCCTGCCAGCCCCCTCACGCTCACGAATTCAGTCCCAGGG | 65 |
| SEQ ID NO: 560 | AATTCTAAAGGTGAAGGGACGTCTACACCCCCAACAAAAC | 45 |
| SEQ ID NO: 561 | GGAAATATTAGTCCCCTCTGCCTGGGACAAGACCACCGAA | 53 |
| SEQ ID NO: 562 | AAACACACCTCTGAATGGAAAGCTGAGAAACAGTGATCTC | 43 |
| SEQ ID NO: 563 | ACTGCACCCCTCCCTTCCCGTGCCGGCAATTTAACCGGG | 65 |
| SEQ ID NO: 564 | TGCCTTCCTACCTTGACCAGTCGGTCCTTGCGGGGGTCCC | 65 |
| SEQ ID NO: 565 | ATTTCCTTCATCTTGTCCTTCTAGCCTGGAGACTCTTCGG | 48 |
| SEQ ID NO: 566 | AATGCCCGAAAATTCCAGCAGCAGCCCAAGATGGTGGCCA | 55 |
| SEQ ID NO: 567 | CGTTGCAAATGCCCAAGGGGTAACCCTAAAAGTTAAAGG | 48 |
| SEQ ID NO: 568 | ACACAACCCCTGTGCAAGTTTCATTCCGGCGCACAGGGGC | 60 |
| SEQ ID NO: 569 | TGCAAGAACTAATTTAGCATGCAAGGACGGGGAGGACCGG | 53 |
| SEQ ID NO: 570 | GCCACGAGGGCACCCACGGGCGGACAGACGGCCAAAGAAT | 68 |
| SEQ ID NO: 571 | ACCCCATATCCAAGCCGGCAGAATGGGCGCATTTCCAAGA | 55 |
| SEQ ID NO: 572 | GCCTGGGGAGACCACGAGAAGGGGTGACTGGGGCGCGGCG | 75 |
| SEQ ID NO: 573 | CTGCAGTAGGGGACAACTAGGAAGGCCGGCAGGCCACACG | 65 |
| SEQ ID NO: 574 | GAGTGGGTCCCCCGGGATTTAGGGGGTGAGGTGGAGGTGG | 68 |
| SEQ ID NO: 575 | TCCCCGCCAGGGAAGAGGGGTGCAGGGGGCCCCGTCCGCC | 80 |
| SEQ ID NO: 576 | TGAGGCGCCGCGCCTGCCCTGCGGCGGAGTTGCCCCTGTA | 75 |
| SEQ ID NO: 577 | AAACGCCGGGAGCAGCGAGGGGCAGAGCCCAAAAGCCATC | 65 |
| SEQ ID NO: 578 | TTGTTAAGCAAAGATCAAAGCCCGGCAGAGAATGGGAGCG | 50 |
| SEQ ID NO: 579 | CAACTTCAACAAAACTCCCCTGTAGTCCGTGTGACGTTAC | 48 |
| SEQ ID NO: 580 | CTGCTACTGCGCCGACAGCCCTCTGGAGGCTCCAGGACTT | 65 |
| SEQ ID NO: 581 | GCTCTTCTGCCCCTCGCCGGAGCGTGCGGACTCTGCTGCT | 70 |
| SEQ ID NO: 582 | TCCGCGCTCGGCTCTCGCTTCTGCTGCCCCGCGCTCCCTC | 75 |
| SEQ ID NO: 583 | TTTCCACTTCGCAGCACAGGAGCTGGTGTTCCATGGCTGG | 58 |
| SEQ ID NO: 584 | GGTCGTTGAGGAGGTTGGCATCGGGGTACGCGCGGCGGAT | 68 |
| SEQ ID NO: 585 | TGTCCTACTTCAAATGTGTGCAGAAGGAGGTCCTGCCGTC | 53 |
| SEQ ID NO: 586 | TCGGGCGGCTCTCTTAAGACTTCCCTGCAACTTGTTGCCC | 58 |
| SEQ ID NO: 587 | ACCCACGTTTCTTTGCTACTCACCCCCCTCCCTTCTCTCC | 58 |
| SEQ ID NO: 588 | CTAGAACTTTGAAGTTTGCCGTGGTGTTTCTAGGGATCCG | 48 |
| SEQ ID NO: 589 | AGAAGGGGTCCGGGAGGGGTGCCTTCGGGAGAAGCCAGT | 68 |
| SEQ ID NO: 590 | CAGGGGCACCCCAATGGGCCCGAGGGTGCGGGCTGGCAGG | 78 |
| SEQ ID NO: 591 | GGGTGCGCTTTGTGTCCCCCGCCTGCGCCCCAGCCCGGCT | 78 |
| SEQ ID NO: 592 | GCCTCAGCGGCCGGGAGCCGCCAACTCCGGGGGAGGGGG | 83 |
| SEQ ID NO: 593 | AAAGTGCAGTAATACCCTTGATCAGAGTTGATGACTTGAA | 38 |
| SEQ ID NO: 594 | GAGAGAAATAAAGTAGTTGCTCTATTTGTAAATTGAAAAG | 28 |

TABLE 2-continued

Exemplary Probe Nucleotide Sequences

| SEQ ID NO | Nucleotide Sequence | % GC Content |
| --- | --- | --- |
| SEQ ID NO: 595 | GGTAGCAGTGATTGCTGTATATTTGTGAAAAGGAGGCAAG | 43 |
| SEQ ID NO: 596 | TGCTGATAATGGAAGTGCAGTGGGTTAGCTTTGTTTCCAT | 43 |
| SEQ ID NO: 597 | CCGTTCTACCGTGACTAGTATGGAATTGTGGGAACCAGAA | 48 |
| SEQ ID NO: 598 | TTAACATCAGTGTCAACTGCAGTGTTGTTTCTGAGTAATA | 35 |
| SEQ ID NO: 599 | CATAACTCCATGCTCTCAAACCAATCACTCCTTCATTCAT | 40 |
| SEQ ID NO: 600 | TTCTCCTATGCTGCACCAGAAAGGGTTTTGTGGGTTATCA | 45 |
| SEQ ID NO: 601 | ATCGTTCAGCATCTTTAGGAAATATCCAGAGACTGCATTG | 40 |
| SEQ ID NO: 602 | TTTATTAAGAGCAAAAAAGCCTGTTTCGTTAGCCAGTCA | 35 |
| SEQ ID NO: 603 | TTGTTCATATGCCTAACTTAATAAATTCTTCATACAGAAA | 25 |
| SEQ ID NO: 604 | ATAACTTTTAAACCCAAACACCTAGAGATTTCATTATGTA | 28 |
| SEQ ID NO: 605 | TTCTTACCATTAAGTCTTCCAAATGATAATTTATTATAAA | 20 |
| SEQ ID NO: 606 | TATGTAAGGACAACTTCATTATATGCTTGAAGAAATTGTT | 28 |
| SEQ ID NO: 607 | AATCTTAAAAGTGACACTAGTCACATTCCACACGGTTAAA | 35 |
| SEQ ID NO: 608 | ATTTTGAAAACTATTCCTTTATCTGGAATGAATGTAAACC | 28 |
| SEQ ID NO: 609 | TTGCATTAAGGGCACCAGAAACTTATAGAAAACCAAAAAG | 35 |
| SEQ ID NO: 610 | TAAAAGACAGTGAACTGAACAGTAATTAACATTACATCCA | 30 |
| SEQ ID NO: 611 | CAAAAAACTGTGTTTATCATATACCAAACATTTTCAAGTT | 25 |
| SEQ ID NO: 612 | TCTCAGGATATTTTGTTCTCTGACACAAATACACCAGTCA | 38 |
| SEQ ID NO: 613 | TAGCTTTACATCTCAGAATGAATCAATGTGGGGGCAGAAA | 40 |
| SEQ ID NO: 614 | AGACCTATATACCTATAGTGCCTAATAGACAATAAGCCAC | 38 |
| SEQ ID NO: 615 | TCTCTCCCCTGCCTAGACTAAGGTAAGTGGGTCTTACCTT | 50 |
| SEQ ID NO: 616 | CATCCTGCTTTTAAAACCCTTAGTGCTCAGCGGCTTGTCT | 48 |
| SEQ ID NO: 617 | AGCTTATAAACTTCAGAGTAATGTAGCACAAATGTCTGTC | 35 |
| SEQ ID NO: 618 | AACTTGAAATAAAACTTTAAACGTTGATTGATTCTTTCCC | 28 |
| SEQ ID NO: 619 | GACAGGCTTAGAGTCCATAACAAACAATCTTAGCTGGAAA | 40 |
| SEQ ID NO: 620 | TGCTCAACAACACTTGTGGAAGAGCAGGGCAAGCTATTTC | 48 |
| SEQ ID NO: 621 | TTACAACATCACTGTAGACATTACTTTTACCCACAGTGCC | 40 |
| SEQ ID NO: 622 | ATCCTAGTTGTATATACTTCTTGGATAAAGTATCTTCGTA | 30 |
| SEQ ID NO: 623 | ATTTTTGGGGAGTGCCATTCCTGCAGGTCTTGAAGACAGG | 50 |
| SEQ ID NO: 624 | CACACAGCCAATGAAACTGACAGAGCCAATGCAACCAAAA | 45 |
| SEQ ID NO: 625 | ACGACTTCAATCAAGAGAAACAGGCAGGTCAGAGTGTGAA | 45 |
| SEQ ID NO: 626 | CTGGTTATCAGGGTTCATAGCACATAGGTTTGACAACCAC | 45 |
| SEQ ID NO: 627 | TTTATTATTCAGCTGGGTAAGCCAAGTGACAGTCTTCCCC | 45 |
| SEQ ID NO: 628 | GTTTTATTCTAGGAATCAACTGCTTTCTAAAAATGTCTAA | 28 |
| SEQ ID NO: 629 | TTTACTGATGGTACTTATTCCCCCAATTATTGATTATTGA | 30 |
| SEQ ID NO: 630 | GCATTTAGGAATATTCAATATTGATACTAAGGTCATCTTT | 28 |
| SEQ ID NO: 631 | TACTCTGTAATGTAGTAATCTTTATGAAGAAATAAATTTG | 23 |

TABLE 2-continued

Exemplary Probe Nucleotide Sequences

| SEQ ID NO | Nucleotide Sequence | % GC Content |
|---|---|---|
| SEQ ID NO: 632 | ATTTTGAAAAAATGTTTCACTGCATTTTACTATACAAGCT | 25 |
| SEQ ID NO: 633 | ACCACACATTCATCAAAAAATACCTCAAAGAAAATTCTGC | 33 |
| SEQ ID NO: 634 | GTTGTCACAATAAACTCAGTACTGAGTAAAATATCACAAA | 30 |
| SEQ ID NO: 635 | GAGTATATATTGTATTACTTACCTGATGCGCAAAGACCCA | 38 |
| SEQ ID NO: 636 | AAAATGACAGCAACATAGGTGCCACCTGAGGTCCACATCT | 48 |
| SEQ ID NO: 637 | TGGAGAGAGTGGGGTTAATCTGTTACTACACTTTGCTACT | 43 |
| SEQ ID NO: 638 | ATTTCCATCATTTTGTCTTTCAGTAAGCATGTACGAAGTA | 33 |
| SEQ ID NO: 639 | GAGATGAAGATGGTACATCAGTAGGGAGCCCCTCTACTGG | 53 |
| SEQ ID NO: 640 | TCTAATTCATCAAAGTATTCTGGGTTGATTCCAGGTACGT | 38 |
| SEQ ID NO: 641 | ACAAACTCGTTTTGTACAGAGAGGAAAATATTAAAACACC | 33 |
| SEQ ID NO: 642 | ATGTTAATTATAAACACTGTTATAAGTTTTACAAATGTAA | 18 |
| SEQ ID NO: 643 | TCCACTGGCAGAGAGAATATATGTTTCCATTACGGTCCCA | 45 |
| SEQ ID NO: 644 | TCAAAGGTTTTCTATCACGTTTTCTATTATTTACTCACAT | 28 |
| SEQ ID NO: 645 | AAAAACAAGAGTCACACAACCTATGCTCCACAATATCTGC | 40 |
| SEQ ID NO: 646 | ATAGGTTATTCTACAATCGACACCAACTATCAGCGGCTTT | 40 |
| SEQ ID NO: 647 | ATTGAATTAAATGATGGCTTGATTATCCAGGAATCAGCCA | 35 |
| SEQ ID NO: 648 | CTTACCATAACAGAGTAATCTCTAGCTTATTCCAAGGATA | 35 |
| SEQ ID NO: 649 | ACCTAAAATTTAACTAGAATCACTTTTCAATGAAGCTGCT | 30 |
| SEQ ID NO: 650 | TAAACTAAGAGCCTTTGATCTTGCCTTATTCTGATAAAAT | 30 |
| SEQ ID NO: 651 | AAATAATAATTCACAAGGAAATCCTTATTGTTTATTTAAA | 18 |
| SEQ ID NO: 652 | GTAATATGTAGGTTAAACAGAAATGTTGGTTGAATCATGT | 30 |
| SEQ ID NO: 653 | TGCAGACACTAATCAAACCAAACAGGGCCAATTAAAATTG | 38 |
| SEQ ID NO: 654 | TAAAGTGCAATGGGACAGAGCAACTTCATTTTCACAAACA | 38 |
| SEQ ID NO: 655 | TAATCTAATTGCCAGAAATGCTTGCCCATTGCAATGGGAG | 43 |
| SEQ ID NO: 656 | AGTTGACAATGACTGCTTAGTTTAGGGTTTTGAAGTAAAC | 35 |
| SEQ ID NO: 657 | CAGATGGCAGGTATTCTGTGAATTAACACTGATGCTTCTG | 43 |
| SEQ ID NO: 658 | AGTCAAGTTCAGAAATGATCTGTTATGACCCCATGAAACG | 40 |
| SEQ ID NO: 659 | GGGATGCTCTGATACATCATTCAGTAAAATGATAGAAAAA | 33 |
| SEQ ID NO: 660 | TAGCTGTATTGCTTGATAGCTTCATAGCTTGATAACCATT | 35 |
| SEQ ID NO: 661 | TTTTAGCAGGGAATTAACACAGGTATATAAATGAAGAAAA | 28 |
| SEQ ID NO: 662 | TTGATTGTTTATGAAGCTGAGATTGTTTACTGGTTTCGAG | 35 |
| SEQ ID NO: 663 | TCTGTGTTTTTATGTTTGGGAACATGAGGGAATCAGTTCT | 38 |
| SEQ ID NO: 664 | TTCTTAAGCTTTCATTTTTCCAGTGGTGAATGTAGAGAGA | 35 |
| SEQ ID NO: 665 | ACGGTAACTGAATAAACTTAAGAACTGAGGTAAAGTTTTC | 33 |
| SEQ ID NO: 666 | TCAATATGTAAAATTGATCAATTCAGACACCTTTATATGG | 28 |
| SEQ ID NO: 667 | TGTCTCTTTCATGCTGTAAATAGAGCATTGCATGAAAGAT | 35 |
| SEQ ID NO: 668 | TTCATAGCACAGTTTATAAACCTAAGAAAGCAAAGATGAA | 30 |
| SEQ ID NO: 669 | AACCAAGCAGGATTCTATGACTAAAAAAGTGTATTTGTAT | 30 |

TABLE 2-continued

Exemplary Probe Nucleotide Sequences

| SEQ ID NO | Nucleotide Sequence | % GC Content |
|---|---|---|
| SEQ ID NO: 670 | AGATAGAGAATTTCAAAGAAACCATCTTTATCAGCTGCAC | 35 |
| SEQ ID NO: 671 | CCAAGAATGAAAAGATGCACTAATTCGACTGAAAGCCAAG | 40 |
| SEQ ID NO: 672 | TCATAGTTGAGACATATAACAACCATAAAGGTCCGCATAT | 35 |
| SEQ ID NO: 673 | AGGAAAGGGTGGAAAGGCAAGCAGCGGGGAGTGTTGGCTG | 60 |
| SEQ ID NO: 674 | CTATAAATTGACCTATCCTGTAAAAAGGATGTCACAGCA | 35 |
| SEQ ID NO: 675 | ACAATTGACCTAAGACTGTAAATTGTAAATTGACTATAAA | 25 |
| SEQ ID NO: 676 | GCAAGACTGGGTATACTATTAATAGGAAAAAATGAACTTC | 33 |
| SEQ ID NO: 677 | ATTGCTTTGATATTGATTGAATCACAGAGAAAATCCTAAG | 30 |
| SEQ ID NO: 678 | TAGATTATGCTGGCAAATCTCAGTGATCAGAGAATTATAT | 33 |
| SEQ ID NO: 679 | ATTCAGAAATGGAATAGGAAGATATTTATGTGCCATCCTG | 35 |
| SEQ ID NO: 680 | GTTTGAATTATTATTCAAACAGTGTATGTTTGTTTGTACT | 25 |
| SEQ ID NO: 681 | AATGCAACAGAGACAGGTATTTATAGCATCTGTTTTCCAT | 35 |
| SEQ ID NO: 682 | TTTAATATCCAAATATGTATGGACACATACAATTGTACAT | 25 |
| SEQ ID NO: 683 | ACGTCTACCGTCATTTTCGTAATTATTCGGTTTCCCTGTC | 43 |
| SEQ ID NO: 684 | GGAGCGCTCCTGCGCGCCTTGTTCGTTAGGATTTATTTTT | 50 |
| SEQ ID NO: 685 | GGTGGCTCCCTAATGCCTGCTCGTTTCAGGTCTCAGCTCT | 58 |
| SEQ ID NO: 686 | CCTTAGTGTGTTGAGGACGCTGCAGAAGGTACAGAGGAGA | 53 |
| SEQ ID NO: 687 | GACCAGATGGTAGGACAGTCATTCTCCTCTGCGTCTCCGC | 58 |
| SEQ ID NO: 688 | CGTGAGGCATGGAGTTTTTGTCCTGCCCCTGCCTGGTTAG | 58 |
| SEQ ID NO: 689 | TTTAAGTCTCTGGCACCGTGCATAGCAGAATTGGTTGGGA | 48 |
| SEQ ID NO: 690 | TCTTTCTCCAAGTGCCTCTATGTTGGCACATCTCTGAAAT | 43 |
| SEQ ID NO: 691 | TGCGTCCCGGCCAGGTAAGCAGCTTCCCTCTCAGCTGCCT | 65 |
| SEQ ID NO: 692 | GGGTGTATGTAGCTGGCAGAAGTGGGACTTGGTCGCAACC | 58 |
| SEQ ID NO: 693 | CGTGGCGAGTGGGCGGTAGCTGCTCGTAGAGCGTGTGAAA | 63 |
| SEQ ID NO: 694 | GTTGGCCCTAAAAGTTATCATTCATGCTAGTTTGACCAAT | 38 |
| SEQ ID NO: 695 | AAGTGGGAGGAGCTGGGCAAGAAAGTCCACCCCTTTTTCT | 53 |
| SEQ ID NO: 696 | GCCGAGCCGAAGTCATCTGCCAATCAAAACAGCCACAGGG | 58 |
| SEQ ID NO: 697 | CGCGTACCTAATGGGAGACAGACAGGTGCCTTTAAAGCGG | 55 |
| SEQ ID NO: 698 | TGGGGAAAGCGGAGGAAGGCATGGAGTGTGGGCGTTAGGG | 63 |
| SEQ ID NO: 699 | GCATATTCTGCCTTGAAGTCATTGGTTGGTCCTGGAAGTG | 48 |
| SEQ ID NO: 700 | AATTGGTCTGGGGAGGAGCTACGACAGTCCAGGGGCGGG | 65 |
| SEQ ID NO: 701 | GTGTCGTGCTGATTGGATGTATCCGCCCCCCTCTCTTAAA | 53 |
| SEQ ID NO: 702 | CAACACGCCAGCGCGAGGACCCGAACGTCAATCAAGAGAC | 60 |
| SEQ ID NO: 703 | GCGTTCGATTGGCCTCCCGCGCAGGCTGCTAGGATTGGCT | 65 |
| SEQ ID NO: 704 | CCCTGCCCCCTTTCGCGGATTGGGTGATCGCTCCAAGGCG | 68 |
| SEQ ID NO: 705 | CTGACCCTTGGAGGCTTTCTATTGGTTCCTGGCAGGGATG | 55 |
| SEQ ID NO: 706 | TCCCGAATATAGGCCAGTCATTGCTCCTGCTGAACGTCGC | 55 |

TABLE 2-continued

Exemplary Probe Nucleotide Sequences

| SEQ ID NO | Nucleotide Sequence | % GC Content |
|---|---|---|
| SEQ ID NO: 707 | CCCCTCCTCTCTTCTCGTCTCTGGCGCCGACCCGCCCCG | 75 |
| SEQ ID NO: 708 | GCTCAAGGGAGGCCGCGGCGTCTGCCGATGGCTCCGCGGA | 75 |
| SEQ ID NO: 709 | TGGGGGAGTGGGCCCGGGGTTGTTCTGACGACGGGGGTCG | 73 |
| SEQ ID NO: 710 | CCCGGGCGCTATCGCGATAGCGGCGCGAAGCGGAAGTGGG | 73 |
| SEQ ID NO: 711 | CGGGGGAGGCGAGCGCCCGCCGCCTTTTTCTCGCGCCCCG | 80 |
| SEQ ID NO: 712 | CACAGGAGCTGGCGCCGCCGCTGAGGAGCGTATCGCGACA | 70 |
| SEQ ID NO: 713 | GTTGCCGACTCGCGCTCTCGGCTTCTGCTCCGGGGCTTCT | 68 |
| SEQ ID NO: 714 | ACTCGGAGCTCGGATCCCAGTGTGGACCTGGACTCGAATC | 60 |
| SEQ ID NO: 715 | GGCTCCTCCTTGTTCCGAGCCCGAAGGCCCGCCCCTTCAC | 70 |
| SEQ ID NO: 716 | CTTTCCGGAGCCCGTCTGTTCCCCTTCGGGTCCAAAGCTT | 60 |
| SEQ ID NO: 717 | GACCCCGCCTCATTCCTCACGGCGAGCTCCAGACCCCGCC | 73 |
| SEQ ID NO: 718 | AGAACTCAAGCTCCCGATTGTGCCCGAAGGAACCCGAAGG | 58 |
| SEQ ID NO: 719 | ACTATTGCCGAAGTGAGCCGAAGTTTGTGGCCCCGCTTCC | 58 |
| SEQ ID NO: 720 | ACATGTGGCTCCGCCCACACTGGCCTCAGCTCTCCGTTCT | 63 |
| SEQ ID NO: 721 | ACAGTGACCCTAAGGACTCGACTACCTCCGAAGAAAGCCG | 55 |
| SEQ ID NO: 722 | CTTGTACCCAACTATCTACGAAGTAAACCGAAGCTTGTGG | 45 |
| SEQ ID NO: 723 | TATCTGGCGAACCTGTTGACTCCGCCTATCATCCTAGCGT | 53 |
| SEQ ID NO: 724 | GGCAAGTCGCTTTCGCCCCGCCCCCTTGTAAATACTCATG | 58 |
| SEQ ID NO: 725 | CTCCTCTACTTGGGAACTTGAGGATCGTCACCCTGGCCCG | 60 |
| SEQ ID NO: 726 | TTGGCTCCGCCCCACTGAGCGCACCTCCCTCTGCCGCTTC | 70 |
| SEQ ID NO: 727 | TCCTTGCTCCACCCCCTCATGCCGACACCCTCGTCAACTT | 60 |
| SEQ ID NO: 728 | TCCACCGATAGAACCAGCGAGTCACCTCATAAACAGTAAT | 45 |
| SEQ ID NO: 729 | CGCTCAGTCCGCCTCCTTGCCTCCCTTCAGAATGTCCCAC | 63 |
| SEQ ID NO: 730 | GCCGTCCACTCTCCGCTCGGGCGGGCTCACCCCAATTGGG | 73 |
| SEQ ID NO: 731 | CGACCGAACCCCACAGCCGAAAGCCCCGCCCCCTGGACAC | 73 |
| SEQ ID NO: 732 | CTCCGAGCGCCAGCGCACCCCAGTTGGGGAGTTCCCGCCC | 75 |
| SEQ ID NO: 733 | AGCCCCGCCTCCTCCCGGACGCAATAGGTTCGGCGTTCGG | 70 |
| SEQ ID NO: 734 | AGCAATTTGACGTTCGGGTGTTCTCGGCTCGGCCGAATCC | 58 |
| SEQ ID NO: 735 | TGCCCCCTCCCGAGCACAGGAAGTTCGGCGTTCGGGCGTC | 70 |
| SEQ ID NO: 736 | TTTCGGACCTCCTCGCTCTCAGACTCCCACAGTACAAAAC | 53 |
| SEQ ID NO: 737 | CGAGCCTTCGCTCCTCCTCTTTCCGAACGACTGTGATTCG | 58 |
| SEQ ID NO: 738 | GAGGCTAAGGCACCGCCGAGGCCACACCCTCTTCCGGACG | 70 |
| SEQ ID NO: 739 | GCGTCCCCCTTCGGGTGTTCCCGTCAGCGGTCAGAAGCTC | 68 |
| SEQ ID NO: 740 | CCTTACAAAGGTCCATTTTGGCACCACCCTCTTGCAAAGT | 48 |
| SEQ ID NO: 741 | GGAGCGTGAAAAACAAACCTCCGCAAGCGCGGCGACACGC | 63 |
| SEQ ID NO: 742 | ACCCGCTCTGTGCCCGCACTGCCGTACCTACCATTGCGCC | 68 |
| SEQ ID NO: 743 | GGTCCTCAGCATCTGCATATGTAGCCCCTCCCGCTGGTCA | 60 |
| SEQ ID NO: 744 | CCCAACCCCTACCCCCAATCCATCTTAGAGCTGATTCTCT | 53 |

TABLE 2-continued

Exemplary Probe Nucleotide Sequences

| SEQ ID NO | Nucleotide Sequence | % GC Content |
|---|---|---|
| SEQ ID NO: 745 | ACTCCAGTGATTCTTCCTTATGCTAGGGACTCGAGGACCC | 53 |
| SEQ ID NO: 746 | GAGAATTGAGAAGTCAGTGTGGGAGGGGATGTCCCAGTAC | 53 |
| SEQ ID NO: 747 | TTTCTGGTTCGCGTTGGCTGCATTGTGGAGCTGAGGGATG | 55 |
| SEQ ID NO: 748 | TAGCTTCTTAATCTCCTTCTTTAGGTCAGCCTCATACTTT | 38 |
| SEQ ID NO: 749 | TTCTCCCTGGGACCCAGCAGTCCACTCTCCCAGTTCCCTC | 63 |
| SEQ ID NO: 750 | AAAGTCAGACCTCAGGACCCAGGAACTGGGGCCCACAGCT | 60 |
| SEQ ID NO: 751 | TCTTGATTTGGTCCCTCAGCCGCTGCAGATGGGAAAAGCA | 53 |
| SEQ ID NO: 752 | TAAGCTGCCTCTTGTCCTTGATCTCGTTGGACGCTACCCA | 53 |
| SEQ ID NO: 753 | GGCTCTGGGCTCCTACCGTCTCAATGAGCTTGCGGTTGTC | 60 |
| SEQ ID NO: 754 | TGAGGACCTCTGGGGTCTGGCCGCTCTGCCTCCGCCCCTT | 70 |
| SEQ ID NO: 755 | CTGCCTCTTCACTTCCCTTAGGTGCAGAAACCTTACTTCT | 48 |
| SEQ ID NO: 756 | CGACCTGAGCCTCGTGACCCTACTTTCTGAGCTCTGAGTC | 58 |
| SEQ ID NO: 757 | TCAAAGGTGGGAAAGGAGCTGACTAAGGGCCAGCAGACAC | 55 |
| SEQ ID NO: 758 | CCGTTCCATTTGCTGTAGAGAGTGCAGTTGGCAGGGGGC | 60 |
| SEQ ID NO: 759 | GCTGTAAGCTTTGGTTTTGGTCTCTCGTTCCACAACTTTG | 45 |
| SEQ ID NO: 760 | CCAACTCACCGTGAGCCACTGGCCAACCTCTTCCTTCTCC | 60 |
| SEQ ID NO: 761 | CCAGGGCTCAGGATCCTCAGAGTTCACCTCCTCTTCTCTA | 55 |
| SEQ ID NO: 762 | GTCCACCTGCATGTTGAGCGTGTCGATGGTATTCTAGGGG | 55 |
| SEQ ID NO: 763 | GCGTGTCTGCACTGACAGTGACTCCACTTCACTCTCAAAC | 53 |
| SEQ ID NO: 764 | TGTCGGGTCTCCCTCACTCACATCCTTGTCGCCCTTCTTC | 58 |
| SEQ ID NO: 765 | CTGCTGGCCAGCCCATTCCCATGCCCATCCCCATCCCAAA | 63 |
| SEQ ID NO: 766 | GAATCCAGGCCCCAACTCCCAGGAGCATAAATGACTGGCC | 58 |
| SEQ ID NO: 767 | TCTCAAATCCCTAATCCCGGCTGTTGGCCCTGTCCGCCTG | 60 |
| SEQ ID NO: 768 | CCTGCCCCACGCGTGCAGCTGCTAAGCCCTCCCAATCCTG | 68 |
| SEQ ID NO: 769 | CCCAGACACCCAGGGGACCCTGAGATTCTGTCTGACCTCC | 63 |
| SEQ ID NO: 770 | CTTCCCCCAAGTCGCTCCTCTTCACAAAGGCCCCACGGTC | 63 |
| SEQ ID NO: 771 | CCTCTGGGTGCCAGGAGGCCTCTTGCCATGGGTGTCCTTC | 65 |
| SEQ ID NO: 772 | CTGCCTTGTCTCTACCCACTGTGCTCTCCCTAGGACCAGG | 60 |
| SEQ ID NO: 773 | GGCGAGGGGAGGTCCTGCAGCTGCTCGCGTGGGCTGCCC | 78 |
| SEQ ID NO: 774 | TGCGCTCGATCTCATCCTTCAGTTCGTAGCCCACCTGGGG | 60 |
| SEQ ID NO: 775 | TCACCTGCTTCACAGGCGGCGGCTCCTGCCACTTGTCGAA | 63 |
| SEQ ID NO: 776 | CTCGCTTCTTCCGCTGTCCATCCAGGGGCGCAGGCAGCGG | 70 |
| SEQ ID NO: 777 | CCCATGCCTACCGGACCCCAGGGCCCCTCACCTGCGGCC | 78 |
| SEQ ID NO: 778 | AGTCGGCTGGGAGGAGGACGCCGGCTTCTCCCCTCCATGA | 68 |
| SEQ ID NO: 779 | ATCTTGCGGTACCTGGGGACGGGTGGGTGGCGGCGCCAG | 73 |
| SEQ ID NO: 780 | TTGGCCTGCTTCCGGATCTCCGTCAGCCCCAGCCGCTCCT | 68 |
| SEQ ID NO: 781 | GGAGGGCGCTCTGGGAGTCTGACCTCTCCGAAGCTCATAC | 63 |

TABLE 2-continued

Exemplary Probe Nucleotide Sequences

| SEQ ID NO | Nucleotide Sequence | % GC Content |
|---|---|---|
| SEQ ID NO: 782 | AGGAGGCAGAGGGCGGTGGCGGCTGGCTGGCTGTGGGGTT | 73 |
| SEQ ID NO: 783 | AGACATGAGCCAGGGCCACAGGACGAGAGGAGGGCGGTG | 68 |
| SEQ ID NO: 784 | CCAAGGGCCGCGAGGGTCGCTTTGGGGCTGAATGGATGGA | 65 |
| SEQ ID NO: 785 | GATGGGAAGCCGCGGGGGCTCTAAGCAGCGGAGACACAGG | 68 |
| SEQ ID NO: 786 | GGAGCCTCTGGGCAGGGAGGAACCGGCCAAGGAGCCCGGG | 75 |
| SEQ ID NO: 787 | GGCGGGGCCCAGGGACGGGGCGGCCGTGCAGCAGGGCACT | 83 |
| SEQ ID NO: 788 | CTGCAGGACCAAGGGGATGACGCTGGGATAACAGAGGAGA | 58 |
| SEQ ID NO: 789 | CAGAACAGGTTTAATAGGATGAGGTGGCCTCTGAGTTCGG | 50 |
| SEQ ID NO: 790 | CCATTCCTTCCTTACTCGTGTGGGTCGGGGGATGTCAGGA | 58 |
| SEQ ID NO: 791 | GGCCCGGTCCCAGCACTGCTCTGTGAGCTCAGAGTTGGGA | 65 |
| SEQ ID NO: 792 | TGGGGGCCCACACACGCGGGGGATGCCGGGGAGCCTGAGA | 75 |
| SEQ ID NO: 793 | CACGGGCACCTGCTCCGGTACCCACTCGGCCCGGCTGAGG | 75 |
| SEQ ID NO: 794 | CTCCACCAGCCGGAAGCCCAGCGGTCACCAGCCGGCCGGT | 75 |
| SEQ ID NO: 795 | AGGCGTCCTCCTCGATCTAGGGGGAAGAGGAGGCGCCCTG | 68 |
| SEQ ID NO: 796 | ACTTGCCCAGGTGGCCCAGGCTGAATCCCAGGTCCTCCTG | 65 |
| SEQ ID NO: 797 | TGGCCTCGTTTACCTGTGTCTGCCGCACACGCCCACTGCC | 65 |
| SEQ ID NO: 798 | GTCTGGCCCATACCTGCAGCGTCTTGGAGATCCTGGCCTT | 60 |
| SEQ ID NO: 799 | GCTCCCCCCACCTTGTGTCCCTCGGTCCCCAGCCCCACCT | 73 |
| SEQ ID NO: 800 | TGCAGGGTCCGCTGTGGGAGGACAGGGAGGCTGCGATCT | 68 |
| SEQ ID NO: 801 | TCGCGGATGGTGGACTTCCCGCCATATACGACGCTCTGCT | 60 |
| SEQ ID NO: 802 | AGTGGGGTGAAGGCCACGCTGGAGGCCGTGCCCGAGGAGC | 73 |
| SEQ ID NO: 803 | CGGCTGCTGAGCCTAACCACCTCCTGGGCTTCTTTCCAGC | 63 |
| SEQ ID NO: 804 | GCTCATGGTATCCCTACCGCAGGCAATCTGTGGACAGCAC | 58 |
| SEQ ID NO: 805 | CTGAATGTCACCTGAAGGGTCACAGAAGCTACTCACAGGG | 53 |
| SEQ ID NO: 806 | TTAAGTGTTCTCAATATGAGATTAGCTGGAGCCGCCTAAT | 40 |
| SEQ ID NO: 807 | GAAGATCCATCTGTTGGAAGCCAGAGGACTAGTGGGAAAC | 50 |
| SEQ ID NO: 808 | CCCCCACAGGGATCTGACACACAACTTAGGTTGTCAGCCA | 55 |
| SEQ ID NO: 809 | GCCCAGCTTCCCAAGTCCTGCCTGGACACCGCCCCATGGA | 68 |
| SEQ ID NO: 810 | AATCACCTTCATGCTTAAAACACTCACACTGATTTCCAGC | 40 |
| SEQ ID NO: 811 | CCTCTTGGGGACCTGGGTGACCTTACTCACCCTCATGGCT | 60 |
| SEQ ID NO: 812 | GTTGCTGTGGACAGGCTTGGAGCCGTTTTTGGCTGGAGAC | 58 |
| SEQ ID NO: 813 | GGAGGGGTAGGTGGGCGGCACAGCTGGGGACTGAGGGTGC | 73 |
| SEQ ID NO: 814 | GCCAGGAGTGGTGCTCAAGGCAGAGGCAGCAGGCGGGGGG | 73 |
| SEQ ID NO: 815 | CAGGGCACTTGGGGGTGCTGCGGGGGCGGGGACCCCATTG | 75 |
| SEQ ID NO: 816 | GGTGCCCGAGTTGTGGCTGGGAGCTGGACTGGCCTTGGGG | 70 |
| SEQ ID NO: 817 | CTGCTTGCCAGCCCCTCCACCGGCACTGCTGTTACTACTG | 63 |
| SEQ ID NO: 818 | GCCCCCCACCCCGCTGCCTCCTCACTCACTGGTGGCGCCA | 75 |
| SEQ ID NO: 819 | CGGGCTGTCTGCCACAACTGAGCTGTAACCTGGGAACAAA | 55 |

TABLE 2-continued

Exemplary Probe Nucleotide Sequences

| SEQ ID NO | Nucleotide Sequence | % GC Content |
|---|---|---|
| SEQ ID NO: 820 | GCTGGCATTGTTGCCCCCACTGCTGCTCAAAGCCACCTCT | 60 |
| SEQ ID NO: 821 | AGGTGGGTTGTGGGGGCCGGAAGGGGGGCCCAAGGCCTGG | 75 |
| SEQ ID NO: 822 | TCCCAACCCTGCCGATGGCCGAGACACTCACGAGGTGCTG | 65 |
| SEQ ID NO: 823 | GGGGGTGAGGCGCCTGCGCCTCTCTGTTTCAAAAGGCTGC | 65 |
| SEQ ID NO: 824 | ATTCCCAGCAGCAAGGGCGGGGGGTTCAGAACCCACCGAT | 63 |
| SEQ ID NO: 825 | GGGGGTGTAACACCCGAGGGAGATGGAGGATAGCGCTTGG | 63 |
| SEQ ID NO: 826 | CAAAGCAGGGAGGCTGATGTAGTTTCCTTGCTGGAAAGAA | 48 |
| SEQ ID NO: 827 | CTTCCACTTAGATGAGAACGTATTTTAGAATGTTCTGAAG | 35 |
| SEQ ID NO: 828 | TAACAGAAATGGGGAGGAAAGGGTATGGGGCTCTTGAGAA | 48 |
| SEQ ID NO: 829 | AAACAGTGACCCTCCGGTGGCAGTCAATTGGCCTCAGGCA | 58 |
| SEQ ID NO: 830 | GCAGAGGAATAAGGACTTCGGGACAATTCACTTTGAAAAG | 43 |
| SEQ ID NO: 831 | GACCCAGTGGAATGGTCTGAGCTAAGATTTGAAGGAGTGG | 50 |
| SEQ ID NO: 832 | TGCACACTGATCTTTCTTAGGGCATTCTTCGGGAAACAGG | 48 |
| SEQ ID NO: 833 | GGCTCAGGATGAACAGCAACAGGGGTTGGGATGATCACTG | 55 |
| SEQ ID NO: 834 | GATCATGGAGATGTGATCTAGGGAACAAAGCCAGAGAAGG | 48 |
| SEQ ID NO: 835 | AGGCATTCCCACGGTGTGAGGTCAGATTGGGCAGGGCCTA | 60 |
| SEQ ID NO: 836 | AGAGCCAGCACTTGCTGTTCCACACATACTAGATCAGTCT | 48 |
| SEQ ID NO: 837 | TGGACAACCCCTCCCACACCCAGAGCTGTGGAAGGGGAG | 65 |
| SEQ ID NO: 838 | CACCTAGATGCTGACCAAGGCCCTCCCCATGCTGCTGGAG | 63 |
| SEQ ID NO: 839 | ATAAAGCCTTCATTCTCCAGGACCCCGCCCTTGCCCTGTT | 55 |
| SEQ ID NO: 840 | AGGTGGTGAGTTTGGGGCTGGGGGGCCTCCCTGAGGAGCC | 70 |
| SEQ ID NO: 841 | GAGAGAACCAGGTCCCACATGCTGACACAGGTGTCCACGG | 60 |
| SEQ ID NO: 842 | ATCCCCCAATCTCACCAGTGCACCCCACAGACAAGGCGA | 60 |
| SEQ ID NO: 843 | AAGGGCTTCAGCATAAGAGTCAGAACCCGCCCCCCTTCCT | 58 |
| SEQ ID NO: 844 | TGTGGGCTGAAGGGACGAGGCTGGGGCACTGGGTGGGAGG | 70 |
| SEQ ID NO: 845 | TTGCAATGTGGAAGAGTCAGGGGCACATTGTCTGGGCTGA | 53 |
| SEQ ID NO: 846 | TAAGTGGGAGGGAGCGGGGACCTAGTGTGGGCATGAGGAC | 63 |
| SEQ ID NO: 847 | GGAGCAGGGATTTGGCTGGGCAATGGAGAGAAAGGTCTGA | 55 |
| SEQ ID NO: 848 | ACACAGAGATGCCCAGGAACTTGCTCTTTAGTAAAGCAGC | 48 |
| SEQ ID NO: 849 | TGGAGAGAGGTCCTTGAAAGGTTTTGAACCCCATAAAGAG | 45 |
| SEQ ID NO: 850 | TCAGGAGGCAGCCCAGTGATAGGGTCCAAGGAACCAGTGG | 60 |
| SEQ ID NO: 851 | ACAGTCTACTGACTTTTCCTATTCAGCTGTGAGCATTCAA | 40 |
| SEQ ID NO: 852 | CTGTCCCTGGACCTTGACACCTGGCTCCCAACCCTGTC | 65 |
| SEQ ID NO: 853 | AGGAAACCCAGATTCCACCAGACACTTCCTTCTTCCCCCC | 55 |
| SEQ ID NO: 854 | GGCTATCTGGCCTGAGACAACAAATGCTGCCTCCCACCCT | 58 |
| SEQ ID NO: 855 | GTCTGGCACTGGACTTTCAGAACTCCTCCTTCCCTGACT | 55 |
| SEQ ID NO: 856 | TTGCCCCAGACCCGTCATTCAATGGCTAGCTTTTTCCATG | 50 |

TABLE 2-continued

Exemplary Probe Nucleotide Sequences

| SEQ ID NO | Nucleotide Sequence | % GC Content |
| --- | --- | --- |
| SEQ ID NO: 857 | AAAAACACGAGCACCCCCAACCACAACGGCCAGTTCTCTG | 55 |
| SEQ ID NO: 858 | TTAACCTTGGACATGGTAAACCATCCAAAACCTTCCTCTC | 43 |
| SEQ ID NO: 859 | AGCAACTAAACCTCTCCACTGGGCACTTATCCTTGGTTTC | 48 |
| SEQ ID NO: 860 | GAACCTCTTATTCTCTTAGAACCCACAGCTGCCACCACAG | 50 |
| SEQ ID NO: 861 | TCCCTTCTCCCAGTGTAAGACCCCAAATCACTCCAAATGA | 48 |
| SEQ ID NO: 862 | CAACCCCCAACCCGATGCCTGCTTCAGATGTTTCCCATGT | 55 |
| SEQ ID NO: 863 | CATAAACCTGGCTCCTAAAGGCTAAATATTTTGTTGGAGA | 38 |
| SEQ ID NO: 864 | CTGCTGACCTGCCCTCCCAGGTCAGAATCATCCTCATGCA | 58 |
| SEQ ID NO: 865 | TGTTCTCCAGACCTGTGCACTCTATCTGTGCAACAGAGAT | 48 |
| SEQ ID NO: 866 | CGTGCAGCAAACAATGTGGAATTCCAATAACCCCCCACTC | 50 |
| SEQ ID NO: 867 | AAATATGAGTCTCCCAAAGTTCCCTAGCATTTCAAAATCC | 38 |
| SEQ ID NO: 868 | CATCATAAAAAGATCTTGTGGTCCACAGATCCTCTAGCCC | 45 |
| SEQ ID NO: 869 | CTCCCAACCCAGAATCCAGCTCCACAGATACATTGCTACT | 50 |
| SEQ ID NO: 870 | CACTCTGAGACCAGAAACTAGAACTTTTATTCCTCATGCT | 40 |
| SEQ ID NO: 871 | CACCAGCACTCAGGAGATTGTGAGACTCCCTGATCCCTGC | 58 |
| SEQ ID NO: 872 | TGCCTAGATCCTTTGCACTCCAAGACCCAGTGTGCCCTAA | 53 |
| SEQ ID NO: 873 | GGGGGTGGGTACGATCCCCGATTCTTCATACAAAGCCTCA | 55 |
| SEQ ID NO: 874 | GGACAAAGGCAGAGGAGACACGCCCAGGATGAAACAGAAA | 53 |
| SEQ ID NO: 875 | TGGATGCACCAGGCCCTGTAGCTCATGGAGACTTCATCTA | 53 |
| SEQ ID NO: 876 | GGGAGAGCTAGCACTTGCTGTTCTGCAATTACTAGATCAC | 48 |
| SEQ ID NO: 877 | GGCTGGACAACCCCCTCCCACACCCAGAGCTGTGGAAGGG | 68 |
| SEQ ID NO: 878 | TGGCACCCAGAGGCTGACCAAGGCCCTCCCCATGCTGCTG | 68 |
| SEQ ID NO: 879 | CCTATAAAACCTTCATTCCCCAGGACTCCGCCCCTGCCCT | 58 |
| SEQ ID NO: 880 | TGCAGGTGGTAAGCTTGGGGCTGGGAGCCTCCCCCAGGA | 68 |
| SEQ ID NO: 881 | AGGAAGACAACCGGGACCCACATGGTGACACAGCTCTCCG | 60 |
| SEQ ID NO: 882 | CAACCATGGCCCCTCTCACCAATCCACGTCACGGACAGGG | 63 |
| SEQ ID NO: 883 | TCAGCTTGACAGTCAGGGCTGGCTCCCTCTCCTGCATCCC | 63 |
| SEQ ID NO: 884 | TCCCTGTCTGGGCTGGGGTGCTGGGTTGGGGGGGAAAGAG | 68 |
| SEQ ID NO: 885 | TGTGGGAGTGAGGACTGTTGCAATATGGAGGGGCTGGGGG | 60 |
| SEQ ID NO: 886 | GGGAGAAAGTTCTGGGGTAAGTGGGAGGGAGCGGGGACCT | 63 |
| SEQ ID NO: 887 | TTGTGGGGCTCAAAACCTCCAAGGACCTCTCTCAATGCCA | 53 |
| SEQ ID NO: 888 | TGCCCAACCCTATCCCAGAGACCTTGATGCTTGGCCTCCC | 60 |
| SEQ ID NO: 889 | TCTTGCCCTAGGATACCCAGATGCCAACCAGACACCTCCT | 55 |
| SEQ ID NO: 890 | TTCCTAGCCAGGCTATCTGGCCTGAGACAACAAATGGGTC | 53 |
| SEQ ID NO: 891 | TCTTAGCCCCAGACTCTTCATTCAGTGGCCCACATTTTCC | 50 |
| SEQ ID NO: 892 | AGGAAAAACATGAGCATCCCCAGCCACAACTGCCAGCTCT | 53 |
| SEQ ID NO: 893 | CCCCTTCAGAGTTACTGACAAACAGGTGGGCACTGAGACT | 53 |
| SEQ ID NO: 894 | TGGAAAGTTAGCTTATTTGTTTGCAAGTCAGTAAAATGTC | 33 |

TABLE 2-continued

Exemplary Probe Nucleotide Sequences

| SEQ ID NO | Nucleotide Sequence | % GC Content |
|---|---|---|
| SEQ ID NO: 895 | GACTCAGGAGTCTCATGGACTCTGCCAGCATTCACAAAAC | 50 |
| SEQ ID NO: 896 | ATGCTGTCTGCTAAGCTGTGAGCAGTAAAAGCCTTTGCCT | 48 |
| SEQ ID NO: 897 | GATTTGGGGGGGCAAGGTGTACTAATGTGAACATGAACC | 50 |
| SEQ ID NO: 898 | GTGTGCACAGCATCCACCTAGACTGCTCTGGTCACCCTAC | 58 |
| SEQ ID NO: 899 | AGGATTCCTAATCTCAGGTTTCTCACCAGTGGCACAAACC | 48 |
| SEQ ID NO: 900 | CAAAGGCTGAGCAGGTTTGCAAGTTGTCCCAGTATAAGAT | 45 |
| SEQ ID NO: 901 | GTCAAGGACAATCGATACAATATGTTCCTCCAGAGTAGGT | 43 |
| SEQ ID NO: 902 | GCAAGATGATATCTCTCTCAGATCCAGGCTTGCTTACTGT | 45 |
| SEQ ID NO: 903 | TCTGTGTGTCTTCTGAGCAAAGACAGCAACACCTTTTTTT | 40 |
| SEQ ID NO: 904 | AACGTTGAGACTGTCCTGCAGACAAGGGTGGAAGGCTCTG | 55 |
| SEQ ID NO: 905 | CATAAATAAGCAGGATGTGACAGAAGAAGTATTTAATGGT | 33 |
| SEQ ID NO: 906 | GCTGCCAGACACAGTCGATCGGGACCTAGAACCTTGGTTA | 55 |
| SEQ ID NO: 907 | GGGATCCTGAGCGCTGCCTTATTCTGGGTTTGGCAGTGGA | 58 |
| SEQ ID NO: 908 | TCACTCAAACCCAGAAGTTCTGATCCCCAGCCATGCCCCT | 55 |
| SEQ ID NO: 909 | AGCCTCTTCCTCCTTTGAAATTCAAGAGGGTGGACCCACT | 50 |
| SEQ ID NO: 910 | GGAGCTGGGACCTTACCAGTCTCCTCCCTCATTGACCTAA | 55 |
| SEQ ID NO: 911 | GAGGATATGAGATTCTTAGGCCATTCCCACATCAGTACCT | 45 |
| SEQ ID NO: 912 | TACCCAGAACTCTACCCCTCAGGATTCCAGCACCTTCTTC | 53 |
| SEQ ID NO: 913 | GCCTCTGCCCTTCAGGGGCCAAAGAGCCTTAAGCCACAAA | 58 |
| SEQ ID NO: 914 | ATCCCATTACTATCACCCCAAACCCTGGACCTAATGGTTC | 48 |
| SEQ ID NO: 915 | AATGGGCAACCCTCGATCCTCAGACTCTTGAGGAATCAAG | 50 |
| SEQ ID NO: 916 | GATACCCTCAAGTGGAGTAAGGATTAGGTGGCAAGATGGA | 48 |
| SEQ ID NO: 917 | GTGCTTGCCCAGGGGCACCTTCATGGAGCTAGAAGGGCTG | 63 |
| SEQ ID NO: 918 | GATGACACCCAAGGCCTCTGGGGCATCTTTCATGCTCAGA | 55 |
| SEQ ID NO: 919 | TGCTGGCCACACCCTCAGAGTGTGGATGCTGGATGATGAG | 58 |
| SEQ ID NO: 920 | GAGGCACGCTGCAGGGATAGTCACAGCAACATGACGTCAT | 55 |
| SEQ ID NO: 921 | AGAGGAGGATGTCGGCAGCTCTACGGTTGGCAGGTGGCTG | 63 |
| SEQ ID NO: 922 | GACACTAGGCCTCAGCCTGGCACCATGCAGGCCACTCCCA | 65 |
| SEQ ID NO: 923 | ACTTTTGAGTCCTGGATCCCTATGATTCCAGGCTCCCTGT | 50 |
| SEQ ID NO: 924 | CCTTGAGATTTCATGGATGGTGACATATGGCCATTCTCTA | 43 |
| SEQ ID NO: 925 | AAAACCCATAAGTTCAGGTCCCTGTGCCCTCCACCCAGAA | 53 |
| SEQ ID NO: 926 | TCGTATCTGGGAGACTCACTTGGGAGAGCAATAGACTTGG | 50 |
| SEQ ID NO: 927 | TACAAGATGTGGTGGAGATAAGGCTGATGCTGGCACAGTG | 50 |
| SEQ ID NO: 928 | GTACACACCATGGTGTTCATCAGGGCCCTGGGTAGTCCCT | 58 |
| SEQ ID NO: 929 | GCTGTGACCTCACAGGAGTCCGTGCCTCCACCCCCTACTC | 65 |
| SEQ ID NO: 991 | TTGGCTGACCTGATTGCTGTGTCCTGTGTCAGCTGCTGCT | 55 |
| SEQ ID NO: 992 | ATGTACCATTTGCCCCTGGATGTTCTGCACTATAGGGTAA | 45 |

TABLE 2-continued

Exemplary Probe Nucleotide Sequences

| SEQ ID NO | Nucleotide Sequence | % GC Content |
|---|---|---|
| SEQ ID NO: 993 | TACTTTTACCCATGCATTTAAAGTTCTAGGTGATATGGCC | 38 |
| SEQ ID NO: 994 | AAACATGGGTATCACTTCTGGGCTGAAAGCCTTCTCTTCT | 45 |
| SEQ ID NO: 995 | GGTGTTTAAATCTTGTGGGGTGGCTCCTTCTGATAATGCT | 45 |
| SEQ ID NO: 996 | CATTTGCATGGCTGCTTGATGTCCCCCCACTGTGTTTAGC | 53 |
| SEQ ID NO: 997 | CATCTGGCCTGGTGCAATAGGCCCTGCATGCACTGGATGC | 60 |
| SEQ ID NO: 998 | GGTACTAGTAGTTCCTGCTATGTCACTTCCCCTTGGTTCT | 48 |
| SEQ ID NO: 999 | GATAGGTGGATTATTTGTCATCCATCCTATTTGTTCCTGA | 38 |
| SEQ ID NO: 1000 | GTCCAGAATGCTGGTAGGGCTATACATTCTTACTATTTTA | 38 |
| SEQ ID NO: 1001 | GTCTACATAGTCTCTAAAGGGTTCCTTTGGTCCTTGTCTT | 43 |
| SEQ ID NO: 1002 | CTCCTGTGAAGCTTGCTCGGCTCTTAGAGTTTTATAGAAC | 45 |
| SEQ ID NO: 1003 | CGCATTTTGGACCAACAAGGTTTCTGTCATCCAATTTTTT | 38 |
| SEQ ID NO: 1004 | TCCTACTCCCTGACATGCTGTCATCATTTCTTCTAGTGTA | 43 |
| SEQ ID NO: 1005 | GCTCATTGCTTCAGCCAAAACTCTTGCCTTATGGCCGGGT | 53 |
| SEQ ID NO: 1006 | ATTGCCTCTCTGCATCATTATGGTAGCTGAATTTGTTACT | 38 |
| SEQ ID NO: 1007 | GCCACAATTGAAACACTTAACAATCTTTCTTTGGTTCCTA | 35 |
| SEQ ID NO: 1008 | TTTCCTAGGGGCCCTGCAATTTCTGGCTGTGTGCCCTTCT | 55 |
| SEQ ID NO: 1009 | CCCAGACCTGAAGCTCTCTTCTGGTGGGCTGTTGGCTCT | 60 |
| SEQ ID NO: 1010 | GTCTATCGGCTCCTGCTTCTGAGGGGAGTTGTTGTCTCT | 55 |
| SEQ ID NO: 1011 | GCCAAAGAGTGACCTGAGGGAAGTTAAAGGATACAGTTCC | 48 |
| SEQ ID NO: 1012 | CCTTTAGTTGCCCCCCTATCTTTATTGTGACGAGGGGTCG | 53 |
| SEQ ID NO: 1013 | CTTCTAATACTGTATCATCTGCTCCTGTATCTAATAGAGC | 38 |
| SEQ ID NO: 1014 | GTATCTGATCATACTGTCTTACTTTGATAAAACCTCCAAT | 33 |
| SEQ ID NO: 1015 | CTAATACTGTACCTATAGCTTTATGTCCACAGATTTCTAT | 33 |
| SEQ ID NO: 1016 | TCAACAGATTTCTTCCAATTATGTTGACAGGTGTAGGTCC | 40 |
| SEQ ID NO: 1017 | TTGGGCCATCCATTCCTGGCTTTAATTTTACTGGTACAGT | 43 |
| SEQ ID NO: 1018 | CAAATACTGGAGTATTGTATGGATTTTCAGGCCCAATTTT | 35 |
| SEQ ID NO: 1019 | CTTCCCAGAAGTCTTGAGTTCTCTTATTAAGTTCTCTGAA | 38 |
| SEQ ID NO: 1020 | CTGAAAAATATGCATCACCCACATCCAGTACTGTTACTGA | 40 |
| SEQ ID NO: 1021 | TGGTAAATGCAGTATACTTCCTGAAGTCTTCATCTAAGGG | 40 |
| SEQ ID NO: 1022 | ACTGATATCTAATCCCTGGTGTCTCATTGTTTATACTAGG | 38 |
| SEQ ID NO: 1023 | ATATTGCTGGTGATCCTTTCCATCCCTGTGGAAGCACATT | 45 |
| SEQ ID NO: 1024 | GTTTTCTAAAAGGCTCTAAGATTTTGTCATGCTACTTTG | 33 |
| SEQ ID NO: 1025 | ACAAATCATCCATGTATTGATAGATAACTATGTCTGGATT | 30 |
| SEQ ID NO: 1026 | TTTTTGTTCTATGCTGCCCTATTTCTAAGTCAGATCCTAC | 38 |
| SEQ ID NO: 1027 | TGGTAAGTCCCCACCTCAACAGATGTTGTCTCAGCTCCTC | 53 |
| SEQ ID NO: 1028 | TAGGCTGTACTGTCCATTTATCAGGATGGAGTTCATAACC | 43 |
| SEQ ID NO: 1029 | GTATGTCATTGACAGTCCAGCTGTCTTTTTCTGGCAGCAC | 48 |
| SEQ ID NO: 1030 | GGTAAATCTGACTTGCCCAATTCAATTTCCCCACTAACTT | 40 |

TABLE 2-continued

Exemplary Probe Nucleotide Sequences

| SEQ ID NO | Nucleotide Sequence | % GC Content |
|---|---|---|
| SEQ ID NO: 1031 | TTCCTCTAAGGAGTTTACATAATTGCCTTACTTTAATCCC | 35 |
| SEQ ID NO: 1032 | CTGCTTCTTCTGTTAGTGGTATTACTTCTGTTAGTGCTTT | 38 |
| SEQ ID NO: 1033 | CTGCTATTAAGTCTTTTGATGGGTCATAATACACTCCATG | 38 |
| SEQ ID NO: 1034 | AAATTTGATATGTCCATTGGCCTTGCCCCTGCTTCTGTAT | 43 |
| SEQ ID NO: 1035 | CTGTTAATTGTTTTACATCATTAGTGTGGGCACCCCTCAT | 40 |
| SEQ ID NO: 1036 | ATGTTTCCTTTTGTATGGGCAGTTTAAATTTAGGAGTCTT | 33 |
| SEQ ID NO: 1037 | GAATCCAGGTGGCTTGCCAATACTCTGTCCACCATGTTTC | 50 |
| SEQ ID NO: 1038 | ATAATTTCACTAAGGGAGGGTATTAACAAACTCCCACTC | 40 |
| SEQ ID NO: 1039 | AGGTTTCTGCTCCTACTATGGGTTCTTTCTCTAACTGGTA | 43 |
| SEQ ID NO: 1040 | TTCCTAATTTAGTCTCCCTGTTAGCTGCCCCATCTACATA | 43 |
| SEQ ID NO: 1041 | TTGCTTGTAACTCAGTCTTCTGATTTGTTGTGTCAGTTAG | 38 |
| SEQ ID NO: 1042 | CTATGTTTACTTCTAATCCCGAATCCTGCAAAGCTAGATA | 38 |
| SEQ ID NO: 1043 | GTTGTGCTTGAATGATTCCTAATGCATATTGTGAGTCTGT | 38 |
| SEQ ID NO: 1044 | GCTCTATTATTTGATTGACTAACTCTGATTCACTTTGATC | 33 |
| SEQ ID NO: 1045 | TCCAATTACTGTGATATTTCTCATGTTCATCTTGGGCCTT | 38 |
| SEQ ID NO: 1046 | TTGCTACTACAGGTGGCAGGTTAAAATCACTAGCCATTGC | 45 |
| SEQ ID NO: 1047 | CTCCTTTTAGCTGACATTTATCACAGCTGGCTACTATTTC | 40 |
| SEQ ID NO: 1048 | CTACCAGGATAACTTTTCCTTCTAAATGTGTACAATCTAG | 35 |
| SEQ ID NO: 1049 | GAATAACTTCTGCTTCTATATATCCACTGGCTACATGAAC | 38 |
| SEQ ID NO: 1050 | ACCAACAGGCGGCCCTAACCGTAGCACCGGTGAAATTGCT | 58 |
| SEQ ID NO: 1051 | GGGGATTGTAGGGAATTCCAAATTCCTGCTTGATTCCCGC | 50 |
| SEQ ID NO: 1052 | TCTTAAGATGTTCAGCCTGATCTCTTACCTGTCCTATAAT | 38 |
| SEQ ID NO: 1053 | CTACTATTCTTTCCCCTGCACTGTACCCCCAATCCCCCC | 58 |
| SEQ ID NO: 1054 | TCCAGAGGAGCTTTGCTGGTCCTTTCCAAAGTGGATTTCT | 48 |
| SEQ ID NO: 1055 | TTATGTCACTATTATCTTGTATTACTACTGCCCCTTCACC | 38 |
| SEQ ID NO: 1056 | CCTGTCTACTTGCCACACAATCATCACCTGCCATCTGTTT | 48 |
| SEQ ID NO: 1057 | CATATGGTGTTTTACTAAACTTTTCCATGTTCTAATCCTC | 33 |
| SEQ ID NO: 1058 | GTGATGTCTATAAAACCATCCCCTAGCTTTCCCTGAAACA | 43 |
| SEQ ID NO: 1059 | GATGTGTACTTCTGAACTTATTCTTGGATGAGGGCTTTCA | 40 |
| SEQ ID NO: 1060 | ACCCCAATATGTTGTTATTACCAATCTAGCATCCCCTAGT | 40 |
| SEQ ID NO: 1061 | GTCAAAGTAATACAGATGAATTAGTTGGTCTGCTAGTTCA | 35 |
| SEQ ID NO: 1062 | GTGTCCTAATAAGGCCTTTCTTATAGCAGAGTCTGAAAAA | 38 |
| SEQ ID NO: 1063 | CTTGTTATGTCCTGCTTGATATTCACACCTAGGGCTAACT | 43 |
| SEQ ID NO: 1064 | TGTTATTAATGCTGCTAGTGCCAAGTATTGTAGAGATCCT | 38 |
| SEQ ID NO: 1065 | CAGTTTCGTAACACTAGGCAAAGGTGGCTTTATCTTTTTT | 38 |
| SEQ ID NO: 1066 | GTGGCCCTTGGTCTTCTGGGGCTTGTTCCATCTATCCTCT | 55 |
| SEQ ID NO: 1067 | CCTCTAAAAGCTCTAGTGTCCATTCATTGTGTGGCTCCCT | 48 |

TABLE 2-continued

Exemplary Probe Nucleotide Sequences

| SEQ ID NO | Nucleotide Sequence | % GC Content |
|---|---|---|
| SEQ ID NO: 1068 | GCCAAATCCTAGGAAAATGTCTAACAGCTTCATTCTTAAG | 38 |
| SEQ ID NO: 1069 | TATCCCCATAAGTTTCATAGATATGTTGCCCTAAGCCATG | 40 |
| SEQ ID NO: 1070 | GTTGTTGCAGAATTCTTATTATGGCTTCCACTCCTGCCCA | 45 |
| SEQ ID NO: 1071 | TCTGCTATGTCGACACCCAATTCTGAAAATGGATAAACAG | 40 |
| SEQ ID NO: 1072 | ACTGGCTCCATTTCTTGCTCTCCTCTGTCGAGTAACGCCT | 53 |
| SEQ ID NO: 1073 | GGCTGACTTCCTGGATGCTTCCAGGGCTCTAGTCTAGGAT | 55 |
| SEQ ID NO: 1074 | GAGATGCCTAAGGCTTTTGTTATGAAACAAACTTGGCAAT | 38 |
| SEQ ID NO: 1075 | TGATGAGCTCTTCGTCGCTGTCTCCGCTTCTTCCTGCCAT | 55 |
| SEQ ID NO: 1076 | ACTTACTGCTTTGATAGAGAAGCTTGATGAGTCTGACTGT | 40 |
| SEQ ID NO: 1077 | GCTACTATTGCTACTATTGGTATAGGTTGCATTACATGTA | 35 |
| SEQ ID NO: 1078 | CTGTCTTCTGCTCTTTCTATTAGTCTATCAATTAACCTGT | 35 |
| SEQ ID NO: 1079 | TCATCAACATCCCAAGGAGCATGGTGCCCCATCTCCACCC | 58 |
| SEQ ID NO: 1080 | CATAATAGACTGTGACCCACAATTTTTCTGTAGCACTACA | 38 |
| SEQ ID NO: 1081 | CACAAAATAGAGTGGTGGTTGCTTCCTTCCACACAGGTAC | 48 |
| SEQ ID NO: 1082 | AAACATTATGTACCTCTGTATCATATGCTTTAGCATCTGA | 33 |
| SEQ ID NO: 1083 | CTTGTGGGTTGGGGTCTGTGGGTACACAGGCATGTGTGGC | 60 |
| SEQ ID NO: 1084 | AACTGATTATATCCTCATGCATCTGTTCTACCATGTCATT | 35 |
| SEQ ID NO: 1085 | GTGGGGTTAATTTTACACATGGCTTTAGGCTTTGATCCCA | 43 |
| SEQ ID NO: 1086 | TAGTATCATTCTTCAAATCAGTGCACTTTAAACTAACACA | 30 |
| SEQ ID NO: 1087 | CTCCTTTCTCCATTATCATTCTCCCGCTACTACTATTGGT | 43 |
| SEQ ID NO: 1088 | TTGTCAACTTATAGCTGGTAGTATCATTATCTATTGGTAT | 30 |
| SEQ ID NO: 1089 | ATACCTTTGGACAGGCCTGTGTAATGACTGAGGTGTTACA | 45 |
| SEQ ID NO: 1090 | TTCCATGTGTACATTGTACTGTGCTGACATTTGTACATGG | 40 |
| SEQ ID NO: 1091 | GACTGCCATTTAACAGCAGTTGAGTTGATACTACTGGCCT | 45 |
| SEQ ID NO: 1092 | CCGTGAAATTGACAGATCTAATTACTACCTCTTCTTCTGC | 40 |
| SEQ ID NO: 1093 | CTACAGATGTGTTCAGCTGTACTATTATGGTTTTAGCATT | 35 |
| SEQ ID NO: 1094 | CTATTGTAACAAATGCTCTCCCTGGTCCTCTCTGGATACG | 48 |
| SEQ ID NO: 1095 | TACTAATGTTACAATGTGCTTGTCTCATATTTCCTATTTT | 28 |
| SEQ ID NO: 1096 | ATTTGCTAGCTATCTGTTTTAAAGTGTTATTCCATTTTGC | 30 |
| SEQ ID NO: 1097 | TAAAACTGTGCGTTACAATTTCTGGGTCCCCTCCTGAGGA | 48 |
| SEQ ID NO: 1098 | ACAGTTGTGTTGAATTACAGTAGAAAAATTCCCCTCCACA | 38 |
| SEQ ID NO: 1099 | ACCCTTCAGTACTCCAAGTACTATTAAACCAAGTACTATT | 35 |
| SEQ ID NO: 1100 | TGCATGGGAGGGTGATTGTGTCACTTCCTTCAGTGTTATT | 45 |
| SEQ ID NO: 1101 | ATGAACATCTAATTTGTCCACTGATGGGAGGGGCATACAT | 43 |
| SEQ ID NO: 1102 | TATTACCACCATCTCTTGTTAATAGCAGCCCTGTAATATT | 35 |
| SEQ ID NO: 1103 | TATCTCCTCCTCCAGGTCTGAAGATCTCGGACTCATTGTT | 48 |
| SEQ ID NO: 1104 | GTGGTAGCTGAAGAGGCACAGGCTCCGCAGATCGTCCCAG | 63 |
| SEQ ID NO: 1105 | TTCCACAATCCTCGTTACAATCAAGAGTAAGTCTCTCAAG | 40 |

TABLE 2-continued

Exemplary Probe Nucleotide Sequences

| SEQ ID NO | Nucleotide Sequence | % GC Content |
|---|---|---|
| SEQ ID NO: 1106 | CCACCAATATTTGAGGGCTTCCCACCCCCTGCGTCCCAGA | 60 |
| SEQ ID NO: 1107 | AGCACTATTCTTTAGTTCCTGACTCCAATACTGTAGGAGA | 40 |
| SEQ ID NO: 1108 | CCCCTCAGCTACTGCTATGGCTGTGGCATTGAGCAAGCTA | 55 |
| SEQ ID NO: 1109 | AGCTCTACAAGCTCCTTGTACTACTTCTATAACCCTATCT | 40 |
| SEQ ID NO: 1110 | ACACTACTTTTTGACCACTTGCCACCCATCTTATAGCAAA | 40 |
| SEQ ID NO: 1111 | TCAGCTCGTCTCATTCTTTCCCTTACAGTAGGCCATCCAA | 48 |
| SEQ ID NO: 1112 | TCCAGGTCTCGAGATGCTGCTCCCACCCTATCTGCTGCTG | 60 |
| SEQ ID NO: 1113 | TTGGTAGCTGCTGTATTGCTACTTGTGATTGCTCCATGTT | 43 |
| SEQ ID NO: 1114 | GTCATTGGTCTTAAAGGTACCTGAGGTGTGACTGGAAAAC | 45 |
| SEQ ID NO: 1115 | TCTTGTCTTCTTTGGGAGTGAATTAGCCCTTCCAGTCCCC | 50 |
| SEQ ID NO: 1116 | GGGAAGTAGCCTTGTGTGTGGTAGATCCACAGATCAAGGA | 50 |
| SEQ ID NO: 1117 | GGATATCTGACCCCTGGCCCTGGTGTGTAGTTCTGCTAAT | 53 |
| SEQ ID NO: 1118 | GGCTCAACTGGTACTAGCTTGTAGCACCATCCAAAGGTCA | 50 |
| SEQ ID NO: 1119 | AAGCTGGTGTTCTCTCCTTTATTGGCCTCTTCTATCTTAT | 40 |
| SEQ ID NO: 1120 | CTCTCCGGGTCATCCATCCCATGCAGGCTCACAGGGTGTA | 60 |
| SEQ ID NO: 1121 | TGAAATGCTAGGCGGCTGTCAAACCTCCACTCTAACACTT | 48 |
| SEQ ID NO: 1122 | CAGTTCTTGAAGTACTCCGGATGCAGCTCTCGGGCCACGT | 58 |

A nucleic acid probe may be a non-labeled probe, or a probe that does not contain a detectable moiety. A non-labeled probe may further interact with a labeled probe (e.g., a labeled nucleic acid probe). A non-labeled probe may hybridize with a labeled nucleic acid probe. A non-labeled probe may also interact with a labeled polypeptide probe. The labeled polypeptide probe may be a protein that recognizes a sequence within the non-labeled probe. A labeled probe may include a nucleic acid portion and a polypeptide tag portion and the polypeptide tag portion may further interact with a molecule comprising a detectable moiety. For example, a non-labeled probe may be a nucleic acid probe comprising a streptavidin which may interact with a biotinylated molecule comprising a detectable moiety.

A nucleic acid probe may comprise about 95%, about 96%, about 97%, about 98%, about 99%, or about 100% sequence specificity or sequence complementarity to a target site of a regulatory element. A nucleic acid probe may comprise about 95%, about 96%, about 97%, about 98%, about 99%, or about 100% sequence specificity or sequence complementarity to a target nucleic acid sequence. A nucleic acid probe may comprise about 95%, about 96%, about 97%, about 98%, about 99%, or about 100% sequence specificity or sequence complementarity to a target viral nucleic acid sequence The hybridization may be a high stringent hybridization condition.

A nucleic acid probe may hybridize with a genomic sequence that is present in low or single copy numbers (e.g., genomic sequences that are not repetitive elements). As used herein, repetitive element refers to a DNA sequence that is present in many identical or copies in the genome. Repetitive elements are not intended to refer to a DNA sequence that is present on each copy of the same chromosome (e.g., a DNA sequence that is present only once, but is found on both copies of chromosome 11, would not be considered a repetitive element, and would be considered a sequence that is present in the genome as one copy). The genome may consist of three broad sequence components: single copy or at least very low copy number DNA (approximately 60% of the human genome); moderately repetitive elements (approximately 30% of the human genome); and highly repetitive elements (approximately 10% of the human genome). For a review, see Human Molecular Genetics, Chapter 7 (1999), John Wiley & Sons, Inc.

A nucleic acid probe may have reduced off-target interaction. For example, "off-target" or "off-target interaction" may refer to an instance in which a nucleic acid probe against a given target hybridizes or interact with another target site (e.g., a different DNA sequence, RNA sequence, or a cellular protein or other moiety).

A nucleic acid probe may further be cross-linked to a target site of a regulatory element. For example, the nucleic acid probe may be cross-linked by a photo-crosslinking means such as UV or by a chemical cross-linking means such as by formaldehyde, or through a reactive group within the nucleic acid probe. Reactive group may include sulfhydryl-reactive linkers such as bismaleimidohexane (BMH), and the like.

A nucleic acid probe may include natural or unnatural nucleotide analogues or bases or a combination thereof. The unnatural nucleotide analogues or bases may comprise modifications at one or more of ribose moiety, phosphate moiety, nucleoside moiety, or a combination thereof. The unnatural nucleotide analogues or bases may comprise 2'-O-methyl, 2'-O-methoxyethyl (2'-O-MOE), 2'-O-aminopropyl, 2'-deoxy, T-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), T-O-dimethylaminoethyloxyethyl (2'-O-DMAEOE), or 2'-O—N-methylacetamido (2'-O-NMA) modified, locked nucleic acid (LNA), ethylene nucleic acid (ENA), peptide nucleic acid (PNA), 1', 5'-anhydrohexitol nucleic acids (HNA), morpholino, methylphosphonate nucleotides, thiolphosphonate nucleotides, or 2'-fluoro N3-P5'-phosphoramidites. The nucleic acid probes may further comprise one or more abasic sites. The abasic site may further be functionalized with a detectable moiety.

A nucleic acid probe may comprise a Transcription Activator-Like Effector (TALE) sequence. A TALE may comprise a DNA-binding module which includes a variable number of about 33-35 amino acid residue repeats. Each amino acid repeat recognizes one base pair through two adjacent amino acids (such as at amino acid positions 12 and 13 of the repeat). As such, the amino acid repeat may also be referred to as repeat-variable diresidue (RVD).

A TALE probe described herein may comprise between about 1 to about 50 TALE repeat modules. A TALE probe described herein may comprise between about 5 and about 45, between about 8 and about 45, between about 10 and about 40, between about 12 and about 35, between about 15 and about 30, between about 20 and about 30, between about 8 and about 40, between about 8 and about 35, between about 8 and about 30, between about 10 and about 35, between about 10 and about 30, between about 10 and about 25, between about 10 and about 20, or between about 15 and about 25 TAL effector repeat modules.

A TALE probe described herein may comprise about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 45, or about 50 TALE repeat modules. A TALE probe described herein may comprise about 5 TALE repeat modules. A TALE probe described herein may comprise about 10 TALE repeat modules. A TALE probe described herein may comprise about 11 TALE repeat modules. A TALE probe described herein may comprise about 12 TALE repeat modules. A TALE probe described herein may comprise about 13 TALE repeat modules. A TALE probe described herein may comprise about 14 TALE repeat modules. A TALE probe described herein may comprise about 15 TALE repeat modules. A TALE probe described herein may comprise about 16 TALE repeat modules. A TALE probe described herein may comprise about 17 TALE repeat modules. A TALE probe described herein may comprise about 18 TALE repeat modules. A TALE probe described herein may comprise about 19 TALE repeat modules. A TALE probe described herein may comprise about 20 TALE repeat modules. A TALE probe described herein may comprise about 21 TALE repeat modules. A TALE probe described herein may comprise about 22 TALE repeat modules. A TALE probe described herein may comprise about 23 TALE repeat modules. A TALE probe described herein may comprise about 24 TALE repeat modules. A TALE probe described herein may comprise about 25 TALE repeat modules. A TALE probe described herein may comprise about 26 TALE repeat modules. A TALE probe described herein may comprise about 27 TALE repeat modules. A TALE probe described herein may comprise about 28 TALE repeat modules. A TALE probe described herein may comprise about 29 TALE repeat modules. A TALE probe described herein may comprise about 30 TALE repeat modules. A TALE probe described herein may comprise about 35 TALE repeat modules. A TALE probe described herein may comprise about 40 TALE repeat modules. A TALE probe described herein may comprise about 45 TALE repeat modules. A TALE probe described herein may comprise about 50 TALE repeat modules.

A TAL effector repeat module may be a wild-type TALE DNA-binding module or a modified TALE DNA-binding repeat module enhanced for specific recognition of a nucleotide. A TALE probe described herein may comprise one or more wild-type TALE DNA-binding module. A TALE probe described herein may comprise one or more modified TAL effector DNA-binding repeat module enhanced for specific recognition of a nucleotide. A modified TALE DNA-binding repeat module may comprise 1, 2, 3, 4, 5, 6, 7, 8, 9, 10, 15, 20, 25 or more mutations that may enhance the repeat module for specific recognition of a nucleic acid sequence (e.g., a target sequence). In some cases, a modified TALE DNA-binding repeat module is modified at amino acid position 2, 3, 4, 11, 12, 13, 21, 23, 24, 25, 26, 27, 28, 30, 31, 32, 33, 34, or 35. In some cases, a modified TALE DNA-binding repeat module is modified at amino acid positions 12 or 13.

A TALE repeat module may be a repeat module-like domain or RVD-like domain. A RVD-like domain has a sequence different from naturally occurring polynucleotidic repeat module comprising RVD (RVD domain) but have a similar function and/or global structure. Non-limiting examples of RVD-like domains include protein domains selected from Puf RNA binding protein or Ankyrin superfamily.

A TALE repeat module may comprise a RVD domain of TABLE 3. A TALE probe described herein may comprise one or more RVD domains selected from TABLE 3. Sometimes, A TALE probe described herein may comprise up to 1, up to 2, up to 3, up to 4, up to 5, up to 6, up to 7, up to 8, up to 9, up to 10, up to 11, up to 12, up to 13, up to 14, up to 15, up to 16, up to 17, up to 18, up to 19, up to 20, up to 21, up to 22, up to 23, up to 24, up to 25, up to 26, up to 27, up to 28, up to 29, up to 30, up to 31, up to 32, up to 33, up to 34, up to 35, up to 36, up to 37, up to 38, up to 39, up to 40, up to 45, up to 50, up to 60, up to 70, up to 80, up to 90, or up to 100 RVD domains selected from TABLE 3.

TABLE 3

| RVD | Nucleotide |
| --- | --- |
| HD | C |
| NG | T |
| NI | A |
| NN | G > A |
| NS | G, A > C > T |
| NH | G |
| N* | T > C >> G, A |
| NP | T > A, C |
| HG | T |
| H* | T |
| IG | T |
| HA | C |
| ND | C |
| NK | G |

TABLE 3-continued

| RVD | Nucleotide |
|-----|------------|
| HI  | C          |
| HN  | G > A      |
| NT  | G > A      |
| NA  | G          |
| SN  | G or A     |
| SH  | G          |
| YG  | T          |
| IS  | —          |

*Denotes a gap in the repeat sequence corresponding to a lack of an amino acid residue at the second position of the RVD.

An RVD domain may recognize or interact with one nucleotide. An RVD domain may recognize or interact with more than one nucleotide. The efficiency of a RVD domain at recognizing a nucleotide is ranked as "strong", "intermediate" or "weak". The ranking may be according to a ranking described in Streubel et al., "TAL effector RVD specificities and efficiencies," *Nature Biotechnology* 30(7): 593-595 (2012). The ranking of RVD may be as illustrated in TABLE 4, based on the ranking provided in Streubel et al. *Nature Biotechnology* 30(7): 593-595 (2012).

TABLE 4

| RVD | Nucleotide   | Efficiency                     |
|-----|--------------|--------------------------------|
| HD  | C            | strong                         |
| NG  | T            | weak                           |
| NI  | A            | weak                           |
| NN  | G > A        | Strong (G), intermediate (A)   |
| NS  | G, A > C > T | intermediate                   |
| NH  | G            | intermediate                   |
| N*  | T > C >> G, A| weak                           |
| NP  | T > A, C     | intermediate                   |
| NK  | G            | weak                           |
| HN  | G > A        | intermediate                   |
| NT  | G > A        | intermediate                   |
| SN  | G or A       | Weak                           |
| SH  | G            | Weak                           |
| IS  | —            | weak                           |

*Denotes a gap in the repeat sequence corresponding to a lack of an amino acid residue at the second position of the RVD.

A TALE DNA-binding domain may further comprise a C-terminal truncated TALE DNA-binding repeat module. A C-terminal truncated TALE DNA-binding repeat module may be between about 18 and about 40 residues in length. A C-terminal truncated TALE DNA-binding repeat module may be between about 20 and about 40, between about 22 and about 38, between about 24 and about 35, between about 28 and about 32, between about 25 and about 40, between about 25 and about 38, between about 25 and about 30, between about 28 and about 40, or between about 28 and about 35 residues in length. A C-terminal truncated TALE DNA-binding repeat module may be at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, or more residues in length. A C-terminal truncated TALE DNA-binding repeat module may be about 18, about 19, about 20, about 21, about 22, about 23, about 24, about 25, about 26, about 27, about 28, about 29, about 30, about 31, about 32, about 33, about 34, about 35, about 36 about 37, about 38, about 39, or about 40 residues in length. A C-terminal truncated TALE DNA-binding repeat module may be about 18 residues in length. A C-terminal truncated TALE DNA-binding repeat module may be about 19 residues in length. A C-terminal truncated TALE DNA-binding repeat module may be about 20 residues in length. A C-terminal truncated TALE DNA-binding repeat module may be about 21 residues in length. A C-terminal truncated TALE DNA-binding repeat module may be about 22 residues in length. A C-terminal truncated TALE DNA-binding repeat module may be about 23 residues in length. A C-terminal truncated TALE DNA-binding repeat module may be about 24 residues in length. A C-terminal truncated TALE DNA-binding repeat module may be about 25 residues in length. A C-terminal truncated TALE DNA-binding repeat module may be about 26 residues in length. A C-terminal truncated TALE DNA-binding repeat module may be about 27 residues in length. A C-terminal truncated TALE DNA-binding repeat module may be about 28 residues in length. A C-terminal truncated TALE DNA-binding repeat module may be about 29 residues in length. A C-terminal truncated TALE DNA-binding repeat module may be about 30 residues in length. A C-terminal truncated TALE DNA-binding repeat module may be about 31 residues in length. A C-terminal truncated TALE DNA-binding repeat module may be about 32 residues in length. A C-terminal truncated TALE DNA-binding repeat module may be about 33 residues in length. A C-terminal truncated TALE DNA-binding repeat module may be about 34 residues in length. A C-terminal truncated TALE DNA-binding repeat module may be about 35 residues in length. A C-terminal truncated TALE DNA-binding repeat module may be about 36 residues in length. A C-terminal truncated TALE DNA-binding repeat module may be about 37 residues in length. A C-terminal truncated TALE DNA-binding repeat module may be about 38 residues in length. A C-terminal truncated TALE DNA-binding repeat module may be about 39 residues in length. A C-terminal truncated TALE DNA-binding repeat module may be about 40 residues in length. A C-terminal truncated TALE DNA-binding repeat module may be a RVD domain of TABLE 3.

A TALE DNA-binding domain may further comprise an N-terminal cap. An N-terminal cap may be a polypeptide portion flanking the DNA-binding repeat module. An N-terminal cap may be any length and may comprise from about 0 to about 136 amino acid residues in length. An N-terminal cap may be about 5, about 10, about 15, about 20, about 25, about 30, about 35, about 40, about 45, about 50, about 60, about 70, about 80, about 90, about 100, about 110, about 120, or about 130 amino acid residues in length. An N-terminal cap may modulate structural stability of the DNA-binding repeat modules. An N-terminal cap may modulate nonspecific interactions. An N-terminal cap may decrease nonspecific interaction. An N-terminal cap may reduce off-target effect. As used here, off-target effect refers to the interaction of a TALE protein with a sequence that is not the target sequence of interest. An N-terminal cap may further comprise a wild-type N-terminal cap sequence of a TALE protein or may comprise a modified N-terminal cap sequence.

A TALE DNA-binding domain may further comprise a C-terminal cap sequence. A C-terminal cap sequence may be a polypeptide portion flanking the C-terminal truncated TALE DNA-binding repeat module. A C-terminal cap may be any length and may comprise from about 0 to about 278 amino acid residues in length. A C-terminal cap may be about 5, about 10, about 15, about 20, about 25, about 30, about 35, about 40, about 45, about 50, about 60, about 80, about 100, about 150, about 200, or about 250 amino acid residues in length. A C-terminal cap may further comprise a wild-type C-terminal cap sequence of a TALE protein, or may comprise a modified C-terminal cap sequence.

A nuclease domain may be linked to a TALE DNA-binding domain either directly or through a linker. A linker may be between about 1 and about 50 amino acid residues in length. A linker may be from about 5 to about 45, from about 5 to about 40, from about 5 to about 35, from about 5 to about 30, from about 5 to about 25, from about 5 to about 20, from about 5 to about 15, from about 10 to about 40, from about 10 to about 35, from about 10 to about 30, from about 10 to about 25, from about 10 to about 20, from about 12 to about 40, from about 12 to about 35, from about 12 to about 30, from about 12 to about 25, from about 12 to about 20, from about 14 to about 40, from about 14 to about 35, from about 14 to about 30, from about 14 to about 25, from about 14 to about 20, from about 14 to about 16, from about 15 to about 40, from about 15 to about 35, from about 15 to about 30, from about 15 to about 25, from about 15 to about 20, from about 15 to about 18, from about 18 to about 40, from about 18 to about 35, from about 18 to about 30, from about 18 to about 25, from about 18 to about 24, from about 20 to about 40, from about 20 to about 35, from about 20 to about 30, or from about 25 to about 30 amino acid residues in length.

A linker for linking a nuclease domain to a TALE DNA-binding domain may be about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 35, about 40, about 45, or about 50 amino acid residues in length. A linker may be about 10 amino acid residues in length. A linker may be about 11 amino acid residues in length. A linker may be about 12 amino acid residues in length. A linker may be about 13 amino acid residues in length. A linker may be about 14 amino acid residues in length. A linker may be about 15 amino acid residues in length. A linker may be about 16 amino acid residues in length. A linker may be about 17 amino acid residues in length. A linker may be about 18 amino acid residues in length. A linker may be about 19 amino acid residues in length. A linker may be about 20 amino acid residues in length. A linker may be about 21 amino acid residues in length. A linker may be about 22 amino acid residues in length. A linker may be about 23 amino acid residues in length. A linker may be about 24 amino acid residues in length. A linker may be about 25 amino acid residues in length. A linker may be about 26 amino acid residues in length. A linker may be about 27 amino acid residues in length. A linker may be about 28 amino acid residues in length. A linker may be about 29 amino acid residues in length. A linker may be about 30 amino acid residues in length.

A TALE probe may be designed to recognize each strand of a double-stranded segment of DNA by engineering the TALE to include a sequence of repeat-variable diresidue subunits that may comprise about 22, about 23, about 24, about 25, about 26, about 27, about 28, about 29, about 30, about 31, about 32, about 33, about 34, about 35, about 36, about 37, about 38, about 39, or about 40 amino acid repeats capable of associating with specific DNA sequences, such that the detectable label of the TALE probe is located at the target nucleic acid sequence.

A nucleic acid probe may be a locked nucleic acid probe (such as a labeled locked nucleic acid probe), a labeled or unlabeled peptide nucleic acid (PNA) probe, a labeled or unlabeled oligonucleotide, an oligopaint, an ECHO probe, a molecular beacon probe, a padlock (or molecular inversion probe), a labeled or unlabeled toe-hold probe, a labeled TALE probe, a labeled ZFN probe, or a labeled CRISPR probe.

A nucleic acid probe may be a labeled or unlabeled locked nucleic acid probe or a labeled or unlabeled peptide nucleic acid probe. Locked nucleic acid probes and peptide nucleic acid probes are known to those of skill in the art and are described in Briones et al., Anal Bioanal Chem (2012) 402:3071-3089.

A nucleic acid probe may be a padlock (or molecular inversion probe). A padlock probe may be hybridized to a target regulatory element sequence in which the two ends may correspond to the target sequence. A padlock probe may be ligated together by a ligase (such as T4 ligase) when bound to the target sequence. An amplification (such as a rolling circle amplification or RCA) may be performed utilizing for example Φ29 polymerase, which may result in a single stranded DNA comprising multiple tandem copies of the target sequence.

A nucleic acid probe may be an oligopaint as described in U.S. Publication No. 2010/0304994; and in Beliveau, et al., "Versatile design and synthesis platform for visualizing genomes with oligopaint FISH probes," PNAS 109(52): 21301-21306 (2012). Oligopaint may refer to detectably labeled polynucleotides that have sequences complementary to an oligonucleotide sequence (such as a portion of a DNA sequence, like a particular chromosome or sub-chromosomal region of a particular chromosome). Oligopaints may be generated from synthetic probes and arrays that are, optionally, computationally patterned (rather than using natural DNA sequences and/or chromosomes as a template).

A nucleic acid probe can be a labeled or unlabeled toe-hold probe. Toe-hold probes are known to those of skill in the art as described in Zhang et al., Optimizing the Specificity of Nucleic Acid Hybridization, Nature Chemistry 4: 208-214 (2012).

A nucleic acid probe may be a molecular beacon. Molecular beacons may be hairpin shaped molecules with an internally quenched fluorophore whose fluorescence is restored when they bind to a target nucleic acid sequence. Molecular beacons are known to those of skill in the art as described in Guo et al., Anal. Bioanal. Chem. (2012) 402: 3115-3125.

A nucleic acid probe may be an ECHO probe. ECHO probes may be sequence-specific, hybridization-sensitive, quencher-free fluorescent probes for RNA detection, which may be designed using the concept of fluorescence quenching caused by intramolecular excitonic interaction of fluorescent dyes. ECHO probes are known to those of skill in the art as described in Kubota et al., PLoS ONE, Vol. 5, Issue 9, e13003 (2010); or Okamoto, Chem. Soc. Rev., 2011, 40, 5815-5828, Wang et al., RNA (2012), 18:166-175.

A probe may be a clustered regularly interspaced palindromic repeat (CRISPR) probe. The CRISPR system may use a Cas9 protein to recognize DNA sequences, in which the target specificity may be solely determined by a small guide (sg) RNA and a protospacer adjacent motif (PAM). Upon binding to target DNA, the Cas9-sgRNA complex may generate a DNA double-stranded break. For imaging applications, a Cas9 protein may be replaced with an endonuclease-deactivated Cas9 (dCas9) protein. For example, imaging a cell, such as by fluorescence in situ hybridization (FISH), may be achieved by synthesizing a dCas9 within the cell, synthesizing RNA within the cell to bind genomic DNA and to complex with the dCas9 forming a dCas9/RNA complex, labeling the dCas9/RNA complex, and imaging the labeled dCas9/RNA complex within the live cell bound to genomic DNA. The endonuclease-deactivated Cas9 may be synthesized in vivo by using an integrated construct, a transiently transfected construct, by injection into the cell of a syncitia of nuclei or via electroporation into cells and/or nuclei.

A probe may comprise an endonuclease-deactivated Cas9 (dCas9) protein as described in Chen et al., "Dynamic imaging of genomic loci in living human cells by an optimized CRISPR/Cas system," Cell 155(7): 1479-1491 (2013); or Ma et al., "Multicolor CRISPR labeling of chromosomal loci in human cells," PNAS 112(10): 3002-3007 (2015). The dCas9 protein may be further labeled with a detectable moiety.

The RNA of the Cas9/RNA complex may be synthesized in vivo by using an integrated construct, a transiently transfected construct, by injection into the cell of a syncitia of nuclei or via electroporation into cells and/or nuclei. The Cas9/RNA complex may be labeled by making a fusion protein that includes Cas9 and a reporter, by injection of RNA that has been attached to a reporter into the cell or by a syncitia of nuclei including RNA that has been attached to a reporter, by electroporation into cells or nuclei or by indirect labeling of the RNA by hybridization with a labeled secondary oligonucleotide. The label may be a conditional reporter, based on the binding of Cas9/RNA to the target nucleic acid. The label may be quenched and may then be activated upon the Cas9/RNA complex binding to the target nucleic acid.

A probe may be a transcription activator-like effector nuclease (TALEN) probe. TALENs are engineered restriction enzymes generated by fusing the TALE DNA binding domain to a FokI DNA cleavage domain. A FokI DNA cleavage domain may comprise an endonuclease-deactivated FokI domain. A nucleic acid probe may be a TALEN probe comprising an endonuclease-deactivated FokI domain.

A probe may be a zinc-finger nuclease (ZFN) probe Similar to TALEN, a zinc-finger nuclease is an engineered restriction enzyme generated by fusing a zinc finger DNA-binding domain to a zinc finger nuclease. A zinc finger nuclease may comprise an endonuclease-deactivated zinc finger nuclease. A nucleic acid probe may be a ZFN probe comprising an endonuclease-deactivated zinc finger nuclease.

A probe disclosed herein may be a polypeptide probe. A polypeptide probe may include a protein or a binding fragment thereof that interacts with a target site (such as a nucleic acid target site or a protein target) of interest. A polypeptide probe may comprise a DNA-binding protein, a RNA-binding protein, a protein involved in the transcription/translation process or detects the transcription/translation process, a protein that may detect an open or relaxed portion of a chromatin, or a protein interacting partner of a product of a regulatory element.

A polypeptide probe may be a DNA-binding protein. The DNA-binding protein may be a transcription factor that modulates the transcription process, polymerases, or histones. A DNA-binding protein may comprise a zinc finger domain, a helix-turn-helix domain, a leucine zipper domain (such as a basic leucine zipper domain), a high mobility group box (HMG-box) domain, and the like. The DNA-binding protein may interact with a nucleic acid region in a sequence specific manner. The DNA-binding protein may interact with a nucleic acid region in a sequence non-specific manner. The DNA-binding protein may interact with single-stranded DNA. The DNA-binding protein may interact with double-stranded DNA. The DNA-binding protein probe may further comprise a detectable moiety.

A polypeptide probe may be a RNA-binding protein. The RNA-binding protein may participate in forming ribonucleoprotein complexes. The RNA-binding protein may modulate post-transcription such as in splicing, polyadenylation, mRNA stabilization, mRNA localization, or in translation. A RNA-binding protein may comprise a RNA recognition motif (RRM), dsRNA binding domain, zinc finger domain, K-Homology domain (KH domain), and the like. The RNA-binding protein may interact with single-stranded RNA. The RNA-binding protein may interact with double-stranded RNA. The RNA-binding protein probe may further comprise a detectable moiety.

A polypeptide probe may be a protein that may detect an open or relaxed portion of a chromatin. The polypeptide probe may be a modified enzyme that lacks cleavage activity. The modified enzyme may be an enzyme that recognizes DNA or RNA (double-stranded or single-stranded). Examples of modified enzymes may be obtained from oxidoreductases, transferases, hydrolases, lyases, isomerases, or ligases. A modified enzyme may be an endonuclease (such as a deactivated restriction endonuclease such as the TALEN or CRISPR probes described herein).

A polypeptide probe may be an antibody or binding fragment thereof. The antibody or binding fragment thereof may be a protein interacting partner of a product of a regulatory element. The antibody or binding fragment thereof may comprise a humanized antibody or binding fragment thereof, murine antibody or binding fragment thereof, chimeric antibody or binding fragment thereof, monoclonal antibody or binding fragment thereof, monovalent Fab', divalent Fab2, F(ab)'3 fragments, single-chain variable fragment (scFv), bis-scFv, (scFv)2, diabody, minibody, nanobody, triabody, tetrabody, disulfide stabilized Fv protein (dsFv), single-domain antibody (sdAb), Ig NAR, camelid antibody or binding fragment thereof, or a chemically modified derivative thereof. The antibody or binding fragment thereof may further comprise a detectable moiety.

Multiple probes may be used together in a probe set to detect a nucleic acid sequence using Nano-FISH. A probe set can also be referred to herein as a "probe pool." The probe set may be designed for the detection of the target nucleic acid sequence. For example, the probe set may be optimized for probes based on GC content, 16 mer base matches (for determining binding specificity of the probe), and their predicted melting temperature when hybridized. The 16 mer base matches may have a total of 24 matches to the 16 mer database. In some embodiments, probe sets with greater than 100 16-mer database matches may be discarded.

Exemplary probe nucleotide sequences are shown in TABLE 2, TABLE 5, and TABLE 14 for probe sets for different target sequences. Some exemplary probe sequences may be target sequences located in the GREB1 promoter of chromosome 2, ER iDHS1 of chromosome 2, ER iDHS2 of chromosome 2, HBG1up of chromosome 11, HBG2 up of chromosome 11, HS1 of chromosome 11, HS2 of chromosome 11, HS3 of chromosome 11, HS4 of chromosome 11, HS5 of chromosome 11, HS1 Lflank of chromosome 11, HS1 2flank of chromosome 11, HS23 flank of chromosome 11, HS34flank of chromosome 11, HS45 flank of chromosome 11, HS5 Rflank of chromosome 11, CCND1 SNP of chromosome 11, CCND1 CTL of chromosome 11, the CCND1 promoter of chromosome 11, Chromosome 18 dead1 of chromosome 18, Chromosome 18 dead2 of chromosome 18, Chromosome dead3 of chromosome 18, CNOT promoter of chromosome 19, CNOT inter1 of chromosome 19, CNOT inter2 of chromosome 19, CNOT inter3 of chromosome 19, TSEN promoter of chromosome 19, KLK2 promoter of chromosome 19, KLK3 promoter of chromosome 19, or KLK eRNA of chromosome 19. GREB1 is gene that may be induced by estrogen stimulation of MCF-7 breast cancer cells. ER iDHS1 and ER iDHS2 are DHS that may be induced by estrogen stimulation of MCF-7 breast cancer cells. HBG1up and HBG2up are hemoglobin genes expressed in K562 erthyroleukemia cells. HS1, HS2, HS3, HS4, and HS5 are hypersensitive sits in the beta-globin locus control region, and HS1 Lflank, HS23flank, HS3 4flank, HS45flank, HS5 Rflank are sequences in the intervening regions between HS1-HS5. CCND SNP is an enhancer for the CCND1 gene, CCND1 CTL is a control region adjacent to the CCND1 SNP, and the CCND1 promoter is the promoter region of the CCND1 gene. Chromosome 18 dead1, Chromosome 18 dead 2, and Chromosome 18 dead3 are non-hypersensitive regions of chromosome 18. The CNOT promoter is the promoter (active region) of CNOT. The TSEN promoter is the promoter (active region) of TSEN. The KLK2 promoter is the promoter KLK2. The KLK3 promoter is the promoter of KLK3. KLK eRNA is an enhancer for the KLK2 gene and/or the KLK3 gene, and which may also enhance RNA. For example, a probe set comprising at least nine different Q570 labeled probes selected from the group consisting of SEQ ID NO: 1-SEQ ID NO: 39 may be used to detect the GREB1 promoter in chromosome 2. A Q570 labeled probe set comprising probes with SEQ ID NO: 7 SEQ ID NO: 35 may be used to detect the GREB1 promoter in chromosome 2. A probe set comprising at least nine different Q670 labeled probes selected from the group consisting of SEQ ID NO: 40-SEQ ID NO: 72 may be used to detect the ER iDHS 1 in chromosome 2. A probe set comprising at least nine different Q670 labeled probes selected from the group consisting of SEQ ID NO: 73-SEQ ID NO: 104 may be used to detect the ER iDHS 2 in chromosome 2. A probe set comprising at least nine different Q570 labeled probes selected from the group consisting of SEQ ID NO: 105-SEQ ID NO: 134 may be used to detect the HBG1up in chromosome 11. A probe set comprising at least nine different Q570 labeled probes selected from the group consisting of SEQ ID NO: 135-SEQ ID NO: 164 may be used to detect the HBG2up in chromosome 11. A probe set comprising at least nine different Q570/670 labeled probes selected from the group consisting of SEQ ID NO: 165-SEQ ID NO: 194 may be used to detect HS1 in chromosome 11. A probe set comprising at least nine different Q570/670 labeled probes selected from the group consisting of SEQ ID NO: 195-SEQ ID NO: 224 may be used to detect HS2 in chromosome 11. A probe set comprising at least nine different Q570/670 labeled probes selected from the group consisting of SEQ ID NO: 225-SEQ ID NO: 254 may be used to detect HS3 in chromosome 11. A probe set comprising at least nine different Q670 labeled probes selected from the group consisting of SEQ ID NO: 255-SEQ ID NO: 298 may be used to detect HS4 in chromosome 11. A probe set comprising at least nine different Q570/670 labeled probes selected from the group consisting of SEQ ID NO: 299-SEQ ID NO: 340 may be used to detect HS5 in chromosome 11. A probe set comprising at least nine different Q670 labeled probes selected from the group consisting of SEQ ID NO: 341-SEQ ID NO: 370 may be used to detect HS1 Lflank in chromosome 11. A probe set comprising at least nine different Q570 labeled probes selected from the group consisting of SEQ ID NO: 371-SEQ ID NO: 400 may be used to detect HS12flank in chromosome 11. A probe set comprising at least nine different Q670 labeled probes selected from the group consisting of SEQ ID NO: 401-SEQ ID NO: 430 may be used to detect HS23flank in chromosome 11. A probe set comprising at least nine different Q570 labeled probes selected from the group consisting of SEQ ID NO: 431-SEQ ID NO: 460 may be used to detect HS34flank in chromosome 11. A probe set comprising at least nine different Q670 labeled probes selected from the group consisting of SEQ ID NO: 461-SEQ ID NO: 484 may be used to detect HS45flank in chromosome 11. A probe set comprising at least nine different Q570 labeled probes selected from the group consisting of SEQ ID NO: 485-SEQ ID NO: 514 may be used to detect HS5 Rflank in chromosome 11. A probe set comprising at least nine different Q570 labeled probes selected from the group consisting of SEQ ID NO: 515-SEQ ID NO: 544 may be used to detect CCND1 SNP in chromosome 11. A probe set comprising at least nine different Q670 labeled probes selected from the group consisting of SEQ ID NO: 545, SEQ ID NO: 539-SEQ ID NO: 544, or SEQ ID NO: 546-SEQ ID NO: 564 may be used to detect CCND1 CTL in chromosome 11. A probe set comprising at least nine different Q670 labeled probes selected from the group consisting of SEQ ID NO: 559-SEQ ID NO: 592 may be used to detect the CCND1 promoter in chromosome 11. A probe set comprising at least nine different Q670 labeled probes selected from the group consisting of SEQ ID NO: 593-SEQ ID NO: 622 may be used to detect Chromosome 18 dead1 in chromosome 18. A probe set comprising at least nine different Q670 labeled probes selected from the group consisting of SEQ ID NO: 623-SEQ ID NO: 652 may be used to detect Chromosome 18 dead2 in chromosome 18. A probe set comprising at least nine different Q670 labeled probes selected from the group consisting of SEQ ID NO: 653-SEQ ID NO: 682 may be used to detect Chromosome 18 dead3 in chromosome 18. A probe set comprising at least nine different Q670 labeled probes selected from the group consisting of SEQ ID NO: 683-SEQ ID NO: 712 may be used to detect the CNOT3 promoter in chromosome 19. A probe set comprising at least nine different Q670 labeled probes selected from the group consisting of SEQ ID NO: 713-SEQ ID NO: 742 may be used to detect the TSEN34 promoter in chromosome 19. A probe set comprising at least nine different Q670 labeled probes selected from the group consisting of SEQ ID NO: 743-SEQ ID NO: 772 may be used to detect CNOT3 inter1 in chromosome 19. A probe set comprising at least nine different Q670 labeled probes selected from the group consisting of SEQ ID NO: 773-SEQ ID NO: 802 may be used to detect CNOT3 inter2 in chromosome 19. A probe set comprising at least nine different Q670 labeled probes selected from the group consisting of SEQ ID NO: 803-SEQ ID NO: 832 may be used to detect CNOT3 inter3 in chromosome 19. A probe set comprising at least nine different Q570 labeled probes selected from the group consisting of SEQ ID NO: 833-SEQ ID NO: 862 may be used to detect the KLK2 promoter in chromosome 19. A probe set comprising at least nine different Q570 labeled probes selected from the group consisting of SEQ ID NO: 863-SEQ ID NO: 892 may be used to detect the KLK3 promoter in chromosome 19. A probe set comprising at least nine different Q670 labeled probes selected from the group consisting of SEQ ID NO: 893-SEQ ID NO: 929 may be used to detect KLK eRNA in chromosome 19. A probe set comprising at least nine different probes labeled with a detection agent selected from the group consisting of SEQ ID NO: 930-SEQ ID NO: 988 or SEQ ID NO: 1123 may be used to detect a lentiviral nucleic acid sequence. A probe set comprising at least nine different probes labeled with a detection agent selected from the group consisting of SEQ ID NO: 991-SEQ ID NO: 1122 or SEQ ID NO: 965-SEQ ID NO: 987 may be used to detect an HIV nucleic acid sequence. A probe set comprising at least nine different probes labeled with a detection agent selected from the group consisting of SEQ ID NO: 989-SEQ ID NO: 990 or SEQ ID NO: 1124-SEQ ID NO: 1211 may be used to detect the Cas9 gene payload. TABLE 5 below shows probes of the present disclosure that target the lentivirus backbone or a Cas9 gene payload region of a lentivirus encoding for Cas9. FIG. 46 shows a vector map of where each of the probes described in TABLE 5 are designed to bind.

TABLE 5

Lentivirus/Cas9 Vector Targeting Probes

| SEQ ID NO | Nucleotide Sequence | Sequence Name | Probe target | % GC Content |
|---|---|---|---|---|
| SEQ ID NO: 930 | TTGTTGCGCCGGATCCCTTATCGTCATCGTCTTTGTAATC | lentiCas9_0 | Lentivirus vector backbone | 48 |
| SEQ ID NO: 931 | GATTCTCTTCGACATCTCCGGCTTGTTTCAGCAGAGAGAA | lentiCas9_1 | Lentivirus vector backbone | 48 |
| SEQ ID NO: 932 | GGGTGGATTCTTCTTGAGACAAAGGCTTGGCCATCGGTCC | lentiCas9_2-BSD | Lentivirus vector backbone | 55 |
| SEQ ID NO: 933 | AGATGGGGATGCTGTTGATTGTAGCCGTTGCTCTTTCAAT | lentiCas9_3-BSD | Lentivirus vector backbone | 45 |
| SEQ ID NO: 934 | CGTCGCTAGAGAGAGCTGCGCTGGCGACGCTGTAGTCTTC | lentiCas9_4-BSD | Lentivirus vector backbone | 63% GC |
| SEQ ID NO: 935 | CCCCAGTAAAATGATATACATTGACACCAGTGAAGATGCG | lentiCas9_5-BSD | Lentivirus vector backbone | 43% GC |
| SEQ ID NO: 936 | CAGCAGCAGCAGTGCCCAGCACCACGAGTTCTGCACAAGG | lentiCas9_6-BSD | Lentivirus vector backbone | 63% GC |
| SEQ ID NO: 937 | CATTTCCGATCGCGACGATACAAGTCAGGTTGCCAGCTGC | lentiCas9_7-BSD | Lentivirus vector backbone | 55 |
| SEQ ID NO: 938 | CCTGTCGGCACCGTCCGCAGGGGCTCAAGATGCCCCTGTT | lentiCas9_8-BSD | Lentivirus vector backbone | 68 |
| SEQ ID NO: 939 | CCTTCACTATGGCTTTGATCCCAGGATGCAGATCGAGAAG | lentiCas9_9-BSD | Lentivirus vector backbone | 50 |
| SEQ ID NO: 940 | GCAATTCACGAATCCCAACTGCCGTCGGCTGTCCATCACT | lentiCas9_10-BSD | Lentivirus vector backbone | 55 |
| SEQ ID NO: 941 | TGATATCGAATTCTTAGCCCTCCCACACATAACCAGAGGG | lentiCas9_11-BSD+ | Lentivirus vector backbone | 48 |
| SEQ ID NO: 942 | ATAGCGTAAAAGGAGCAACATAGTTAAGAATACCAGTCAA | lentiCas9_13-WPRE | Lentivirus vector backbone | 35 |
| SEQ ID NO: 943 | AAGCAATAGCATGATACAAAGGCATTAAAGCAGCGTATCC | lentiCas9_14-WPRE | Lentivirus vector backbone | 40 |
| SEQ ID NO: 944 | ACCAGGATTTATACAAGGAGGAGAAAATGAAAGCCATACG | lentiCas9_15-WPRE | Lentivirus vector backbone | 40 |
| SEQ ID NO: 945 | GTTGCCTGACAACGGGCCACAACTCCTCATAAAGAGACAG | lentiCas9_16-WPRE | Lentivirus vector backbone | 53 |
| SEQ ID NO: 946 | CAGTGGGGGTTGCGTCAGCAAACACAGTGCACACCACGCC | lentiCas9_17-WPRE | Lentivirus vector backbone | 63 |
| SEQ ID NO: 947 | AAGTCCCGGAAAGGAGCTGACAGGTGGTGGCAATGCCCCA | lentiCas9_18-WPRE | Lentivirus vector backbone | 60 |
| SEQ ID NO: 948 | CGGCGATGAGTTCCGCCGTGGCAATAGGGAGGGGGAAAGC | lentiCas9_19-WPRE | Lentivirus vector backbone | 65 |
| SEQ ID NO: 949 | TGCCCAACAGCCGAGCCCCTGTCCAGCAGCGGGCAAGGCA | lentiCas9_20-WPRE | Lentivirus vector backbone | 70 |
| SEQ ID NO: 950 | GAAGGACGATGATTTCCCCGACAACACCACGGAATTGTC | lentiCas9_21-WPRE | Lentivirus vector backbone | 50 |
| SEQ ID NO: 951 | TCCCGCGCAGAATCCAGGTGGCAACACAGGCGAGCAGCCA | lentiCas9_22-WPRE | Lentivirus vector backbone | 65 |

TABLE 5-continued

Lentivirus/Cas9 Vector Targeting Probes

| SEQ ID NO | Nucleotide Sequence | Sequence Name | Probe target | % GC Content |
|---|---|---|---|---|
| SEQ ID NO: 952 | GGTCCGCTGGATTGAGGGCC GAAGGGACGTAGCAGAAGGA | lentiCas9_23-WPRE | Lentivirus vector backbone | 63 |
| SEQ ID NO: 953 | GCGGAAGAGGCCGCAGAGCC GGCAGCAGGCCGCGGGAAGG | lentiCas9_24-WPRE | Lentivirus vector backbone | 78 |
| SEQ ID NO: 954 | CCCAAAGGGAGATCCGACTC GTCTGAGGGCGAAGGCGAAG | lentiCas9_25-WPRE | Lentivirus vector backbone | 63 |
| SEQ ID NO: 955 | TTGCTCCATGTTTTCTAGG TCTCGAGGTCGACGGTATCG | lentiCas9_post-WPRE-to-LTR_0 | Lentivirus vector backbone | 50 |
| SEQ ID NO: 956 | AGGCACAATCAGCATTGGTA GCTGCTGTATTGCTACTTGT | lentiCas9_post-WPRE-to-LTR_1 | Lentivirus vector backbone | 45 |
| SEQ ID NO: 957 | CAGCTGCCTTGTAAGTCATT GGTCTTAAAGGTACCTGAGG | lentiCas9_post-WPRE-to-LTR_3 | Lentivirus vector backbone | 48 |
| SEQ ID NO: 958 | ACAGATCAAGGATATCTTGT CTTCGTTGGGAGTGAATTAG | lentiCas9_post-WPRE-to-LTR_5 | Lentivirus vector backbone | 40 |
| SEQ ID NO: 959 | AGTTCTGCCAATCAGGGAAG TAGCCTTGTGTGTGGTAGAT | lentiCas9_post-WPRE-to-LTR_6 | Lentivirus vector backbone | 48 |
| SEQ ID NO: 960 | ATCCAAAGGTCAGTGGATAT CTGATCCCTGGCCCTGGTGT | lentiCas9_post-WPRE-to-LTR_7 | Lentivirus vector backbone | 53 |
| SEQ ID NO: 961 | CTTCTACCTTCTCTTGCTCA ACTGGTACTAGCTTGTAGCA | lentiCas9_post-WPRE-to-LTR_8 | Lentivirus vector backbone | 45 |
| SEQ ID NO: 962 | TCACAGGGTGTAACAAGCGG GTGTTCTCTCCTTCATTGGC | lentiCas9_post-WPRE-to-LTR_9 | Lentivirus vector backbone | 53 |
| SEQ ID NO: 963 | ACTCTAATACTTCTCTCTCC GGGTCATCCATCCCATGCAG | lentiCas9_post-WPRE-to-LTR_10 | Lentivirus vector backbone | 50 |
| SEQ ID NO: 964 | CTCGGGCCATGTGATGAAAT GCTAGGCGGCTGTCAAACCT | lentiCas9_post-WPRE-to-LTR_11 | Lentivirus vector backbone | 55 |
| SEQ ID NO: 965 | GCGCGCTTCAGCAAGCCGAG TCCTGCGTCGAGAGAGCTCC | lentiCas9pack_0 | Lentivirus vector backbone | 68 |
| SEQ ID NO: 966 | TTTTGGCGTACTCACCAGTC GCCGCCCCTCGCCTCTTGCC | lentiCas9pack_1 | Lentivirus vector backbone | 65 |
| SEQ ID NO: 967 | CTCGCACCCATCTCTCTCCT TCTAGCCTCCGCTAGTCAAA | lentiCas9pack_2 | Lentivirus vector backbone | 55 |
| SEQ ID NO: 968 | CCCATAGTGCTTCCTGCTGC TCCCAAGAACCCAAGGAACA | lentiCas9RRE_15 | Lentivirus vector backbone | 55 |
| SEQ ID NO: 969 | AATAATTGTCTGGCCTGTAC CGTCAGCGTCATTGACGCTG | lentiCas9RRE_16 | Lentivirus vector backbone | 50 |
| SEQ ID NO: 970 | ATAGCCCTCAGCAAATTGTT CTGCTGCTGCACTATACCAG | lentiCas9RRE_17 | Lentivirus vector backbone | 48 |
| SEQ ID NO: 971 | ATGCCCCAGACTGTGAGTTG CAACAGATGCTGTTGCGCCT | lentiCas9RRE_18 | Lentivirus vector backbone | 55 |
| SEQ ID NO: 972 | AGGTATCTTTCCACAGCCAG GATTCTTGCCTGGAGCTGCT | lentiCas9RRE_19 | Lentivirus vector backbone | 53 |
| SEQ ID NO: 973 | TTTCCAGAGCAACCCCAAAT CCCCAGGAGCTGTTGATCCT | lentiCas9RRE_20 | Lentivirus vector backbone | 53 |
| SEQ ID NO: 974 | TTCCATCGCGATCTAATTC TCCCCCGCTTAATACTGACG | lentiCas9tween_3 | Lentivirus vector backbone | 50 |
| SEQ ID NO: 975 | TGCGAATCGTTCTAGCTCCC TGCTTGCCCATACTATATGT | lentiCas9tween_5 | Lentivirus vector backbone | 48 |
| SEQ ID NO: 976 | TTGTCTACAGCCTTCTGATG TTTCTAACAGGCCAGGATTA | lentiCas9tween_6 | Lentivirus vector backbone | 43 |

TABLE 5-continued

Lentivirus/Cas9 Vector Targeting Probes

| SEQ ID NO | Nucleotide Sequence | Sequence Name | Probe target | % GC Content |
|---|---|---|---|---|
| SEQ ID NO: 977 | TTCTGATCCTGTCTGAAGGG ATGGTTGTAGCTGTCCCAGT | lentiCas9tween_7 | Lentivirus vector backbone | 50 |
| SEQ ID NO: 978 | TAAAGCTTCCTTGGTGTCTT TTATCTCTATCCTTTGATGC | lentiCas9tween_9 | Lentivirus vector backbone | 38 |
| SEQ ID NO: 979 | ATATCTCCTCCTCCAGGTCT GAAGATCAGCGGCCGCTTGC | lentiCas9tween_11 | Lentivirus vector backbone | 58 |
| SEQ ID NO: 980 | CTCTTTGCCTTGGTGGGTGC TACTCCTAATGGTTCAATTT | lentiCas9tween_13 | Lentivirus vector backbone | 45 |
| SEQ ID NO: 981 | CTCCAACTAGCATTCCAAGG CACAGCAGTGGTGCAAATGA | lentiCas9tween_21 | Lentivirus vector backbone | 50 |
| SEQ ID NO: 982 | ATCCAGGTCGTGTGATTCCA AATCTGTTCCAGAGATTTAT | lentiCas9tween_22 | Lentivirus vector backbone | 40 |
| SEQ ID NO: 983 | TGTATTAAGCTTGTGTAATT GTTAATTTCTCTGTCCCACT | lentiCas9tween_23 | Lentivirus vector backbone | 33 |
| SEQ ID NO: 984 | TCATTCTTTTCTTGCTGGTT TTGCGATTCTTCAATTAAGG | lentiCas9tween_24 | Lentivirus vector backbone | 35 |
| SEQ ID NO: 985 | GAATATCCCTGCCTAACTCT ATTCACTATAGAAAGTACAG | lentiCas9tween_28 | Lentivirus vector backbone | 38 |
| SEQ ID NO: 986 | GGTCCCCTCGGGGTTGGGAG GTGGGTCTGAAACGATAATG | lentiCas9tween_29 | Lentivirus vector backbone | 60 |
| SEQ ID NO: 987 | CGCAGTGCCGATCCGTTCAC TAATCGAATGGATCTGTCTC | lentiCas9tween_31 | Lentivirus vector backbone | 53 |
| SEQ ID NO: 988 | AATTGTGGATGAATACTGCC ATTTGTCTGCAGAATTGGCG | lentiCas9tween_32 | Lentivirus vector backbone | 43 |
| SEQ ID NO: 989 | TGATAATTTTCAGCAGATCG TGGTATGTGCCCAGGGAGGC | Cas9_42 | Cas9 gene payload | 50 |
| SEQ ID NO: 990 | CCAGATTGGCAATGTGCTCG TGCAGGCTATCGCCCTGGCC | Cas9_51 | Cas9 gene payload | 63 |
| SEQ ID NO: 1123 | TTTCCCCTGCACTGTACCCC CCAATCCCCCCTTTTCTTTT | lentiCas9cPPT_33 | Lentivirus vector backbone | 53 |
| SEQ ID NO: 1124 | TGGTGCCGATGTCCAGGCCG ATGCTGTACTTCTTGTCCAT | Cas9_0 | Cas9 gene payload | 55 |
| SEQ ID NO: 1125 | GCACCTTGTACTCGTCGGTG ATCACGGCCCAGCCCACAGA | Cas9_1 | Cas9 gene payload | 63 |
| SEQ ID NO: 1126 | TGTGCCGGTCGGTGTTGCCC AGCACCTTGAATTTCTTGCT | Cas9_2 | Cas9 gene payload | 55 |
| SEQ ID NO: 1127 | CGCTGTCGAACAGCAGGGCT CCGATCAGGTTCTTCTTGAT | Cas9_3 | Cas9 gene payload | 55 |
| SEQ ID NO: 1128 | TTCTGGCGGTTCTCTTCAGC CGGGTGGCCTCGGCTGTTTC | Cas9_4 | Cas9 gene payload | 63 |
| SEQ ID NO: 1129 | CTTGCAGATAGCAGATCCGG TTCTTCCGTCTGGTGTATCT | Cas9_5 | Cas9 gene payload | 50 |
| SEQ ID NO: 1130 | AGAAGCTGTCGTCCACCTTG GCCATCTCGTTGCTGAAGAT | Cas9_6 | Cas9 gene payload | 53 |
| SEQ ID NO: 1131 | CCTCGTCCACGATGTTGCCG AAGATGGGGTGCCGCTCGTG | Cas9_8 | Cas9 gene payload | 65 |
| SEQ ID NO: 1132 | TTCTCAGGTGGTAGATGGTG GGGTACTTCTCGTGGTAGGC | Cas9_9 | Cas9 gene payload | 55 |
| SEQ ID NO: 1133 | TCAGCCGCAGGTCGGCCTTG TCGGTGCTGTCCACCAGTTT | Cas9_10 | Cas9 gene payload | 63 |

TABLE 5-continued

Lentivirus/Cas9 Vector Targeting Probes

| SEQ ID NO | Nucleotide Sequence | Sequence Name | Probe target | % GC Content |
|---|---|---|---|---|
| SEQ ID NO: 1134 | AGTGGCCCCGGAACTTGATC ATGTGGGCCAGGGCCAGATA | Cas9_11 | Cas9 gene payload | 60 |
| SEQ ID NO: 1135 | CCACGTCGCTGTTGTCGGGG TTCAGGTCGCCCTCGATCAG | Cas9_12 | Cas9 gene payload | 65 |
| SEQ ID NO: 1136 | ACAGCTGGTTGTAGGTCTGC ACCAGCTGGATGAACAGCTT | Cas9_13 | Cas9 gene payload | 53 |
| SEQ ID NO: 1137 | CCTTGGCGTCCACGCCGCTG GCGTTGATGGGGTTTTCCTC | Cas9_14 | Cas9 gene payload | 65 |
| SEQ ID NO: 1138 | TTTCCAGCCGTCTGCTCTTG CTCAGTCTGGCAGACAGGAT | Cas9_15 | Cas9 gene payload | 55 |
| SEQ ID NO: 1139 | ACAGGCCATTCTTCTTCTCG CCGGGCAGCTGGGCGATCAG | Cas9_16 | Cas9 gene payload | 63 |
| SEQ ID NO: 1140 | GCTGCAGTTTGGCATCCTCG GCCAGGTCGAAGTTGCTCTT | Cas9_18 | Cas9 gene payload | 58 |
| SEQ ID NO: 1141 | CCAGCAGGTTGTCCAGGTCG TCGTCGTAGGTGTCCTTGCT | Cas9_19 | Cas9 gene payload | 60 |
| SEQ ID NO: 1142 | TGGCGGCCAGAAACAGGTCG GCGTACTGGTCGCCGATCTG | Cas9_20 | Cas9 gene payload | 65 |
| SEQ ID NO: 1143 | CTCTCAGGATGTCGCTCAGC AGGATGGCGTCGGACAGGTT | Cas9_21 | Cas9 gene payload | 60 |
| SEQ ID NO: 1144 | TCATAGAGGCGCTCAGGGGG GCCTTGGTGATCTCGGTGTT | Cas9_22 | Cas9 gene payload | 60 |
| SEQ ID NO: 1145 | TCAGCAGGGTCAGGTCCTGG TGGTGCTCGTCGTATCTCTT | Cas9_23 | Cas9 gene payload | 58 |
| SEQ ID NO: 1146 | CAATGTAGCCGGCGTAGCCG TTCTTGCTCTGGTCGAAGAA | Cas9_25 | Cas9 gene payload | 55 |
| SEQ ID NO: 1147 | GCTTGATGAACTTGTAGAAC TCTTCCTGGCTGGCTCCGCC | Cas9_26 | Cas9 gene payload | 55 |
| SEQ ID NO: 1148 | TCACGAGCAGTTCCTCGGTG CCGTCCATCTTTTCCAGGAT | Cas9_27 | Cas9 gene payload | 55 |
| SEQ ID NO: 1149 | GCAGCTCTCCCAGGTGGATC TGGTGGGGATGCTGCCGTT | Cas9_29 | Cas9 gene payload | 65 |
| SEQ ID NO: 1150 | TCAGGAATGGGTAAAAATCT TCCTGCCGCCGCAGAATGGC | Cas9_30 | Cas9 gene payload | 53 |
| SEQ ID NO: 1151 | TGCGGAAGGTCAGGATCTTC TCGATCTTTTCCCGGTTGTC | Cas9_31 | Cas9 gene payload | 53 |
| SEQ ID NO: 1152 | ATCTGCTGTTTCCCCTGGCC AGAGGGCCCACGTAGTAGGG | Cas9_32 | Cas9 gene payload | 63 |
| SEQ ID NO: 1153 | AGGGGGTGATGGTTTCCTCG CTCTTTCTGGTCATCCAGGC | Cas9_33 | Cas9 gene payload | 58 |
| SEQ ID NO: 1154 | TCTGGGCGGAAGCGCCCTTG TCCACCACTTCCTCGAAGTT | Cas9_34 | Cas9 gene payload | 60 |
| SEQ ID NO: 1155 | TGGGCAGGTTCTTATCGAAG TTGGTCATCCGCTCGATGAA | Cas9_35 | Cas9 gene payload | 50 |
| SEQ ID NO: 1156 | AGTACTCGTACAGCAGGCTG TGCTTGGGCAGCACCTTCTC | Cas9_36 | Cas9 gene payload | 58 |
| SEQ ID NO: 1157 | CGGTCACGTATTTCACTTTG GTCAGCTCGTTATACACGGT | Cas9_37 | Cas9 gene payload | 48 |
| SEQ ID NO: 1158 | TTTTCTGCTCGCCGCTCAGG AAGGCGGGCTTTCTCATTCC | Cas9_38 | Cas9 gene payload | 58 |

TABLE 5-continued

Lentivirus/Cas9 Vector Targeting Probes

| SEQ ID NO | Nucleotide Sequence | Sequence Name | Probe target | % GC Content |
|---|---|---|---|---|
| SEQ ID NO: 1159 | TCACTTTCCGGTTGGTCTTG AACAGCAGGTCCACGATGGC | Cas9_39 | Cas9 gene payload | 55 |
| SEQ ID NO: 1160 | ACTCGATTTTCTTGAAGTAG TCCTCTTTCAGCTGCTTCAC | Cas9_40 | Cas9 gene payload | 43 |
| SEQ ID NO: 1161 | TGAACCGATCTTCCACGCCG GAGATTTCCACGGAGTCGAA | Cas9_41 | Cas9 gene payload | 55 |
| SEQ ID NO: 1162 | GAATGTCCTCGTTTTCCTCA TTGTCCAGGAAGTCCTTGTC | Cas9_43 | Cas9 gene payload | 48 |
| SEQ ID NO: 1163 | CTCTGTCCTCAAACAGTGTC AGGGTCAGCACGATATCTTC | Cas9_44 | Cas9 gene payload | 50 |
| SEQ ID NO: 1164 | CGAACAGGTGGGCATAGGTT TTCAGCCGTTCCTCGATCAT | Cas9_45 | Cas9 gene payload | 53 |
| SEQ ID NO: 1165 | CGGTGTATCTCCGCCGCTTC AGCTGCTTCATCACTTTGTC | Cas9_46 | Cas9 gene payload | 55 |
| SEQ ID NO: 1166 | CCCGGATGCCGTTGATCAGC TTCCGGCTCAGCCTGCCCCA | Cas9_47 | Cas9 gene payload | 68 |
| SEQ ID NO: 1167 | CGGACTTCAGGAAATCCAGG ATTGTCTTGCCGGACTGCTT | Cas9_48 | Cas9 gene payload | 53 |
| SEQ ID NO: 1168 | CGTCGTGGATCAGCTGCATG AAGTTTCTGTTGGCGAAGCC | Cas9_49 | Cas9 gene payload | 55 |
| SEQ ID NO: 1169 | ACACCTGGGCTTTCTGGATG TCCTCTTTAAAGGTCAGGCT | Cas9_50 | Cas9 gene payload | 50 |
| SEQ ID NO: 1170 | TCACTGTCTGCAGGATGCCC TTCTTAATGGCGGGGCTGCC | Cas9_52 | Cas9 gene payload | 60 |
| SEQ ID NO: 1171 | GCTTGTGCCGGCCCATCACT TTCACGAGCTCGTCCACCAC | Cas9_53 | Cas9 gene payload | 63 |
| SEQ ID NO: 1172 | TGGTCTGGTTCTCTCTGGCC ATTTCGATCACGATGTTCTC | Cas9_54 | Cas9 gene payload | 50 |
| SEQ ID NO: 1173 | TCCGCTTCATTCTCTCGCGG CTGTTCTTCTGTCCCTTCTG | Cas9_55 | Cas9 gene payload | 55 |
| SEQ ID NO: 1174 | CTTTCAGGATCTGGCTGCCC AGCTCTTTGATGCCCTCTTC | Cas9_56 | Cas9 gene payload | 55 |
| SEQ ID NO: 1175 | ACAGCTTCTCGTTCTGCAGC TGGGTGTTTTCCACGGGGTG | Cas9_57 | Cas9 gene payload | 58 |
| SEQ ID NO: 1176 | GGTCCACGTACATATCCCGC CCATTCTGCAGGTAGTACAG | Cas9_58 | Cas9 gene payload | 55 |
| SEQ ID NO: 1177 | GGTCCACATCGTAGTCGGAC AGCCGGTTGATGTCCAGTTC | Cas9_59 | Cas9 gene payload | 58 |
| SEQ ID NO: 1178 | TGTCGATGGAGTCGTCCTTC AGAAAGCTCTGAGGCACGAT | Cas9_60 | Cas9 gene payload | 53 |
| SEQ ID NO: 1179 | CGCTCTTGCCCCGGTTCTTG TCGCTTCTGGTCAGCACCTT | Cas9_61 | Cas9 gene payload | 60 |
| SEQ ID NO: 1180 | AGTTCTTCATCTTCTTCACG ACCTCTTCGGAGGGCACGTT | Cas9_62 | Cas9 gene payload | 50 |
| SEQ ID NO: 1181 | TTCTCTGGGTAATCAGCTTG GCGTTCAGCAGCTGCCGCCA | Cas9_63 | Cas9 gene payload | 58 |
| SEQ ID NO: 1182 | CGCTCAGGCCGCCTCTCTCG GCCTTGGTCAGATTGTCGAA | Cas9_64 | Cas9 gene payload | 63 |
| SEQ ID NO: 1183 | TTTCCACCAGCTGTCTCTTG ATGAAGCCGGCCTTATCCAG | Cas9_65 | Cas9 gene payload | 53 |

TABLE 5-continued

Lentivirus/Cas9 Vector Targeting Probes

| SEQ ID NO | Nucleotide Sequence | Sequence Name | Probe target | % GC Content |
|---|---|---|---|---|
| SEQ ID NO: 1184 | GGGAGTCCAGGATCTGTGCC ACGTGCTTTGTGATCTGCCG | Cas9_66 | Cas9 gene payload | 60 |
| SEQ ID NO: 1185 | CCCGGATCAGCTTGTCATTC TCGTCGTACTTAGTGTTCAT | Cas9_67 | Cas9 gene payload | 48 |
| SEQ ID NO: 1186 | AATCGGACACCAGCTTGGAC TTCAGGGTGATCACTTTCAC | Cas9_68 | Cas9 gene payload | 50 |
| SEQ ID NO: 1187 | CCACGACGGCGTTCAGGTAG GCGTCGTGGGCGTGGTGGTA | Cas9_70 | Cas9 gene payload | 68 |
| SEQ ID NO: 1188 | ACTCGCTTTCCAGCTTAGGG TACTTTTTGATCAGGGCGGT | Cas9_71 | Cas9 gene payload | 50 |
| SEQ ID NO: 1189 | TCATCTTCCGCACGTCGTAC ACCTTGTAGTCGCCGTACAC | Cas9_72 | Cas9 gene payload | 55 |
| SEQ ID NO: 1190 | ACTTGGCGGTAGCCTTGCCG ATTTCCTGCTCGCTCTTGGC | Cas9_73 | Cas9 gene payload | 60 |
| SEQ ID NO: 1191 | TCTCGGTCTTGAAAAAGTTC ATGATGTTGCTGTAGAAGAA | Cas9_74 | Cas9 gene payload | 38 |
| SEQ ID NO: 1192 | CGATCAGAGGCCGCTTCCGG ATCTCGCCGTTGGCCAGGGT | Cas9_75 | Cas9 gene payload | 68 |
| SEQ ID NO: 1193 | GGCCCTTATCCCACACGATC TCCCCGGTTTCGCCGTTTGT | Cas9_76 | Cas9 gene payload | 60 |
| SEQ ID NO: 1194 | CTTGGGGCATGCTCAGCACT TTCCGCACGGTGGCAAAATC | Cas9_77 | Cas9 gene payload | 58 |
| SEQ ID NO: 1195 | TGAAGCCGCCTGTCTGCACC TCGGTCTTTTTCACGATATT | Cas9_78 | Cas9 gene payload | 50 |
| SEQ ID NO: 1196 | TCAGCTTATCGCTGTTCCTC TTGGGCAGGATAGACTCTTT | Cas9_79 | Cas9 gene payload | 48 |
| SEQ ID NO: 1197 | AGCCGCCGTACTTCTTAGGG TCCCAGTCCTTCTTTCTGGC | Cas9_80 | Cas9 gene payload | 58 |
| SEQ ID NO: 1198 | TCTCGAAGCTGCTTCTTTCC ATGATGGTGATCCCCAGTAG | Cas9_83 | Cas9 gene payload | 50 |
| SEQ ID NO: 1199 | CTTCTTTGTAGCCCTTGGCT TCCAGAAAGTCGATGGGATT | Cas9_84 | Cas9 gene payload | 48 |
| SEQ ID NO: 1200 | ACAGGGAGTACTTAGGCAGC TTGATGATCAGGTCCTTTTT | Cas9_85 | Cas9 gene payload | 45 |
| SEQ ID NO: 1201 | CGGCAGAGGCCAGCATTCTC TTCCGGCCGTTTTCCAGCTC | Cas9_86 | Cas9 gene payload | 63 |
| SEQ ID NO: 1202 | ATTTGGAGGGCAGGGCCAGT TCGTTTCCCTTCTGCAGTTC | Cas9_87 | Cas9 gene payload | 55 |
| SEQ ID NO: 1203 | TCAGCTTCTCATAGTGGCTG GCCAGGTACAGGAAGTTCAC | Cas9_88 | Cas9 gene payload | 53 |
| SEQ ID NO: 1204 | CCACAAACAGCTGTTTCTGC TCATTATCCTCGGGGGAGCC | Cas9_89 | Cas9 gene payload | 55 |
| SEQ ID NO: 1205 | TGATCTGCTCGATGATCTCG TCCAGGTAGTGCTTGTGCTG | Cas9_90 | Cas9 gene payload | 53 |
| SEQ ID NO: 1206 | CCAGATTAGCGTCGGCCAGG ATCACTCTCTTGGAGAACTC | Cas9_91 | Cas9 gene payload | 55 |
| SEQ ID NO: 1207 | TGGGCTTATCCCGGTGCTTG TTGTAGGCGGACAGCACTTT | Cas9_92 | Cas9 gene payload | 55 |
| SEQ ID NO: 1208 | TCAGGGTAAACAGGTGGATG ATATTCTCGGCCTGCTCTCT | Cas9_93 | Cas9 gene payload | 50 |

TABLE 5-continued

Lentivirus/Cas9 Vector Targeting Probes

| SEQ ID NO | Nucleotide Sequence | Sequence Name | Probe target | % GC Content |
|---|---|---|---|---|
| SEQ ID NO: 1209 | TGGTGTCAAAGTACTTGAAG GCGGCAGGGGCTCCCAGATT | Cas9_94 | Cas9 gene payload | 55 |
| SEQ ID NO: 1210 | CCAGCACCTCTTTGGTGCTG GTGTACCTCTTCCGGTCGAT | Cas9_95 | Cas9 gene payload | 58 |
| SEQ ID NO: 1211 | TCTCGTACAGGCCGGTGATG CTCTGGTGGATCAGGGTGGC | Cas9_96 | Cas9 gene payload | 63 |

In some embodiments, a probe set of the present disclosure comprising a plurality of probes can be used to detect nucleic acid insertions stemming from a lentiCas9-Blast vector, as set forth in SEQ ID NO: 1284. In some embodiments, a probe set of the present disclosure comprising a plurality of probes can be used to detect viral insertions stemming from a target nucleic acid that shares at least 60%, at least 65%, at least 70%, at least 75%, at least 80%, at least 85%, at least 90%, at least 92%, at least 95%, at least 97%, or at least 99% sequence identity with SEQ ID NO: 1284. In some embodiments, a probe set of the present disclosure comprising a plurality of probes can be used to detect nucleic insertions stemming from a CAR transfer plasmid, as set forth in SEQ ID NO: 1285. In some embodiments, a probe set of the present disclosure comprising a plurality of probes can be used to detect viral insertions stemming from a target nucleic acid that shares at least 60%, at least 65%, at least 70%, at least 75%, at least 80%, at least 85%, at least 90%, at least 92%, at least 95%, at least 97%, or at least 99% sequence identity with SEQ ID NO: 1285. TABLE 6 shows nucleic acid sequences of a lentivirus vector and a CAR transfer plasmid. In some embodiments, a probe set of the present disclosure comprising a plurality of probes can be used to detect nucleic acid insertions stemming from a lentivirus vector encoding for a gene of interest. The gene of interest can be a therapeutic gene, such as nucleic acid sequences encoding for: CTLA-4, BTLA, TIM-3, CCR5, CXCR4, TCR, B2M, a chimeric antigen receptor (CAR), genes responsible for bioprotein production, albumin in the liver, the hemoglobin subunit beta gene, the hemoglobin subunit alpha 1 gene, transthyretin (TTR), CCR5, glucocorticoid (GR), T cell receptor (TCR), CD52, BCL11A, alpha-L iduronidase (IDUA), iduronate-2-sulfatase (IDS), Factor 9, PD-1/TCR-A/TCR-B, TCR/CS-1, TCR, CEP290, TCR/B2M, CBLB, TGFbR, dystrophin, CFTR, serpina1, IL2Rg, or HBV.

TABLE 6

Nucleic Acid Sequences of Lentivirus Vector and CAR Transfer Plasmid

| SEQ ID NO | Nucleotide Sequence |
|---|---|
| SEQ ID NO: 1284 | GTTACACCCTGTGAGCCTGCATGGGATGGATGACCCGGAGAGAGAAG TATTAGAGTGGAGGTTTGACAGCCGCCTAGCATTTCATCACATGGCCC GAGAGCTGCATCCGGACTGTACTGGGTCTCTCTGGTTAGACCAGATCT GAGCCTGGGAGCTCTCTGGCTAACTAGGGAACCCACTGCTTAAGCCTC AATAAAGCTTGCCTTGAGTGCTTCAAGTAGTGTGTGCCCGTCTGTTGT GTGACTCTGGTAACTAGAGATCCCTCAGACCCTTTTAGTCAGTGTGGA AAATCTCTAGCAGGGCCCGTTTAAACCCGCTGATCAGCCTCGACTGTG CCTTCTAGTTGCCAGCCATCTGTTGTTTGCCCCTCCCCCGTGCCTTCCTT GACCCTGGAAGGTGCCACTCCCACTGTCCTTTCCTAATAAAATGAGGA AATTGCATCGCATTGTCTGAGTAGGTGTCATTCTATTCTGGGGGGTGG GGTGGGGCAGGACAGCAAGGGGGAGGATTGGGAAGACAATAGCAGG CATGCTGGGGATGCGGTGGGCTCTATGGCTTCTGAGGCGGAAAGAAC CAGCTGGGGCTCTAGGGGGTATCCCCACGCGCCCTGTAGCGGCGCATT AAGCGCGGCGGGTGTGGTGGTTACGCGCAGCGTGACCGCTACACTTGC CAGCGCCCTAGCGCCCGCTCCTTTCGCTTTCTTCCCTTCCTTTCTCGCC ACGTTCGCCGGCTTTCCCCGTCAAGCTCTAAATCGGGGGCTCCCTTTA GGGTTCCGATTTAGTGCTTTACGGCACCTCGACCCCAAAAAACTTGAT TAGGGTGATGGTTCACGTAGTGGGCCATCGCCCTGATAGACGGTTTTT CGCCCTTTGACGTTGGAGTCCACGTTCTTTAATAGTGGACTCTTGTTCC AAACTGGAACAACACTCAACCCTATCTCGGTCTATTCTTTTGATTTATA AGGGATTTTGCCGATTTCGGCCTATTGGTTAAAAAATGAGCTGATTTA ACAAAAATTTAACGCGAATTAATTCTGTGGAATGTGTGTCAGTTAGGG TGTGGAAAGTCCCCAGGCTCCCCAGCAGGCAGAAGTATGCAAAGCAT GCATCTCAATTAGTCAGCAACCAGGTGTGGAAAGTCCCCAGGCTCCCC AGCAGGCAGAAGTATGCAAAGCATGCATCTCAATTAGTCAGCAACCA TAGTCCCGCCCCTAACTCCGCCCAGTTCCGCCCATTCTCCGCCCCATGG CTGACTAATTTTTTTTATTTATGCAGAGGCCGAGGCCGCCTCTGCCTCT GAGCTATTCCAGAAGTAGTGAGGAGGCTTTTTTGGAGGCCTAGGCTTT TGCAAAAAGCTCCCGGGAGCTTGTATATCCATTTTCGGATCTGATCAG CACGTGTTGACAATTAATCATCGGCATAGTATATCGGCATAGTATAAT ACGACAAGGTGAGGAACTAAACCATGGCCAAGTTGACCAGTGCCGTT CCGGTGCTCACCGCGCGCGACGTCGCCGGAGCGGTCGAGTTCTGGACC GACCGGCTCGGGTTCTCCCGGGACTTCGTGGAGGACGACTTCGCCGGT |

TABLE 6-continued

Nucleic Acid Sequences of Lentivirus
Vector and CAR Transfer Plasmid

| SEQ ID NO | Nucleotide Sequence |
|---|---|
| | GTGGTCCGGGACGACGTGACCCTGTTCATCAGCGCGGTCCAGGACCAG
GTGGTGCCGGACAACACCCTGGCCTGGGTGTGGGTGCGCGGCCTGGA
CGAGCTGTACGCCGAGTGGTCGGAGGTCGTGTCCACGAACTTCCGGGA
CGCCTCCGGGCCGGCCATGACCGAGATCGGCGAGCAGCCGTGGGGGC
GGGAGTTCGCCCTGCGCGACCCGGCCGGCAACTGCGTGCACTTCGTGG
CCGAGGAGCAGGACTGACACGTGCTACGAGATTTCGATTCCACCGCCG
CCTTCTATGAAAGGTTGGGCTTCGGAATCGTTTTCCGGGACGCCGGCT
GGATGATCCTCCAGCGCGGGGATCTCATGCTGGAGTTCTTCGCCCACC
CCAACTTGTTTATTGCAGCTTATAATGGTTACAAATAAAGCAATAGCA
TCACAAATTTCACAAATAAAGCATTTTTTTCACTGCATTCTAGTTGTGG
TTTGTCCAAACTCATCAATGTATCTTATCATGTCTGTATACCGTCGACC
TCTAGCTAGAGCTTGGCGTAATCATGGTCATAGCTGTTTCCTGTGTGA
AATTGTTATCCGCTCACAATTCCACACAACATACGAGCCGGAAGCATA
AAGTGTAAAGCCTGGGGTGCCTAATGAGTGAGCTAACTCACATTAATT
GCGTTGCGCTCACTGCCCGCTTTCCAGTCGGGAAACCTGTCGTGCCAG
CTGCATTAATGAATCGGCCAACGCGCGGGGAGAGGCGGTTTGCGTATT
GGGCGCTCTTCCGCTTCCTCGCTCACTGACTCGCTGCGCTCGGTCGTTC
GGCTGCGGCGAGCGGTATCAGCTCACTCAAAGGCGGTAATACGGTTAT
CCACAGAATCAGGGGATAACGCAGGAAAGAACATGTGAGCAAAAGG
CCAGCAAAAGGCCAGGAACCGTAAAAAGGCCGCGTTGCTGGCGTTTT
TCCATAGGCTCCGCCCCCCTGACGAGCATCACAAAAATCGACGCTCAA
GTCAGAGGTGGCGAAACCCGACAGGACTATAAAGATACCAGGCGTTT
CCCCCTGGAAGCTCCCTCGTGCGCTCTCCTGTTCCGACCCTGCCGCTTA
CCGGATACCTGTCCGCCTTTCTCCCTTCGGGAAGCGTGGCGCTTTCTCA
TAGCTCACGCTGTAGGTATCTCAGTTCGGTGTAGGTCGTTCGCTCCAA
GCTGGGCTGTGTGCACGAACCCCCCGTTCAGCCCGACCGCTGCGCCTT
ATCCGGTAACTATCGTCTTGAGTCCAACCCGGTAAGACACGACTTATC
GCCACTGGCAGCAGCCACTGGTAACAGGATTAGCAGAGCGAGGTATG
TAGGCGGTGCTACAGAGTTCTTGAAGTGGTGGCCTAACTACGGCTACA
CTAGAAGAACAGTATTTGGTATCTGCGCTCTGCTGAAGCCAGTTACCT
TCGGAAAAAGAGTTGGTAGCTCTTGATCCGGCAAACAAACCACCGCT
GGTAGCGGTGGTTTTTTTGTTTGCAAGCAGCAGATTACGCGCAGAAAA
AAAGGATCTCAAGAAGATCCTTTGATCTTTTCTACGGGGTCTGACGCT
CAGTGGAACGAAAACTCACGTTAAGGGATTTTGGTCATGAGATTATCA
AAAAGGATCTTCACCTAGATCCTTTTAAATTAAAAATGAAGTTTTAAA
TCAATCTAAAGTATATATGAGTAAACTTGGTCTGACAGTTACCAATGC
TTAATCAGTGAGGCACCTATCTCAGCGATCTGTCTATTTCGTTCATCCA
TAGTTGCCTGACTCCCCGTCGTGTAGATAACTACGATACGGGAGGGCT
TACCATCTGGCCCCAGTGCTGCAATGATACCGCGAGACCCACGCTCAC
CGGCTCCAGATTTATCAGCAATAAACCAGCCAGCCGGAAGGGCCGAG
CGCAGAAGTGGTCCTGCAACTTTATCCGCCTCCATCCAGTCTATTAATT
GTTGCCGGGAAGCTAGAGTAAGTAGTTCGCCAGTTAATAGTTTGCGCA
ACGTTGTTGCCATTGCTACAGGCATCGTGGTGTCACGCTCGTCGTTTGG
TATGGCTTCATTCAGCTCCGGTTCCCAACGATCAAGGCGAGTTACATG
ATCCCCCATGTTGTGCAAAAAAGCGGTTAGCTCCTTCGGTCCTCCGAT
CGTTGTCAGAAGTAAGTTGGCCGCAGTGTTATCACTCATGGTTATGGC
AGCACTGCATAATTCTCTTACTGTCATGCCATCCGTAAGATGCTTTTCT
GTGACTGGTGAGTACTCAACCAAGTCATTCTGAGAATAGTGTATGCGG
CGACCGAGTTGCTCTTGCCCGGCGTCAATACGGGATAATACCGCGCCA
CATAGCAGAACTTTAAAAGTGCTCATCATTGGAAAACGTTCTTCGGGG
CGAAAACTCTCAAGGATCTTACCGCTGTTGAGATCCAGTTCGATGTAA
CCCACTCGTGCACCCAACTGATCTTCAGCATCTTTTACTTTCACCAGCG
TTTCTGGGTGAGCAAAAACAGGAAGGCAAAATGCCGCAAAAAAGGGA
ATAAGGGCGACACGGAAATGTTGAATACTCATACTCTTCCTTTTTCAA
TATTATTGAAGCATTTATCAGGGTTATTGTCTCATGAGCGGATACATAT
TTGAATGTATTTAGAAAAATAAACAAATAGGGGTTCCGCGCACATTTC
CCCGAAAAGTGCCACCTGACGTCGACGGATCGGGAGATCTCCCGATCC
CCTATGGTGCACTCTCAGTACAATCTGCTCTGATGCCGCATAGTTAAG
CCAGTATCTGCTCCCTGCTTGTGTGTTGGAGGTCGCTGAGTAGTGCGC
GAGCAAAATTTAAGCTACAACAAGGCAAGGCTTGACCGACAATTGCA
TGAAGAATCTGCTTAGGGTTAGGCGTTTTGCGCTGCTTCGCGATGTAC
GGGCCAGATATACGCGTTGACATTGATTATTGACTAGTTATTAATAGT
AATCAATTACGGGGTCATTAGTTCATAGCCCATATATGGAGTTCCGCG
TTACATAACTTACGGTAAATGGCCCGCCTGGCTGACCGCCCAACGACC
CCCGCCCATTGACGTCAATAATGACGTATGTTCCCATAGTAACGCCAA
TAGGGACTTTCCATTGACGTCAATGGGTGGAGTATTTACGGTAAACTG
CCCACTTGGCAGTACATCAAGTGTATCATATGCCAAGTACGCCCCCTA
TTGACGTCAATGACGGTAAATGGCCCGCCTGGCATTATGCCCAGTACA
TGACCTTATGGGACTTTCCTACTTGGCAGTACATCTACGTATTAGTCAT
CGCTATTACCATGGTGATGCGGTTTTGGCAGTACATCAATGGGCGTGG
ATAGCGGTTTGACTCACGGGGATTTCCAAGTCTCCACCCCATTGACGT
CAATGGGAGTTTGTTTTGGCACCAAAATCAACGGGACTTTCCAAAATG
TCGTAACAACTCCGCCCCATTGACGCAAATGGGCGGTAGGCGTGTACG
GTGGGAGGTCTATATAAGCAGCGCGTTTTGCCTGTACTGGGTCTCTCT
GGTTAGACCAGATCTGAGCCTGGGAGCTCTCTGGCTAACTAGGGAACC |

TABLE 6-continued

Nucleic Acid Sequences of Lentivirus
Vector and CAR Transfer Plasmid

| SEQ ID NO | Nucleotide Sequence |
|---|---|
| | CACTGCTTAAGCCTCAATAAAGCTTGCCTTGAGTGCTTCAAGTAGTGT
GTGCCCGTCTGTTGTGTGACTCTGGTAACTAGAGATCCCTCAGACCCTT
TTAGTCAGTGTGGAAAATCTCTAGCAGTGGCGCCCGAACAGGGACTTG
AAAGCGAAAGGGAAACCAGAGGAGCTCTCTCGACGCAGGACTCGGCT
TGCTGAAGCGCGCACGGCAAGAGGCGAGGGGCGGCGACTGGTGAGTA
CGCCAAAAATTTTGACTAGCGGAGGCTAGAAGGAGAGAGATGGGTGC
GAGAGCGTCAGTATTAAGCGGGGGAGAATTAGATCGCGATGGGAAAA
AATTCGGTTAAGGCCAGGGGGAAAGAAAAAATATAAATTAAAACATA
TAGTATGGGCAAGCAGGGAGCTAGAACGATTCGCAGTTAATCCTGGC
CTGTTAGAAACATCAGAAGGCTGTAGACAAATACTGGGACAGCTACA
ACCATCCCTTCAGACAGGATCAGAAGAACTTAGATCATTATATAATAC
AGTAGCAACCCTCTATTGTGTGCATCAAAGGATAGAGATAAAAGACA
CCAAGGAAGCTTTAGACAAGATAGAGGAAGAGCAAAACAAAAGTAA
GACCACCGCACAGCAAGCGGCCGCTGATCTTCAGACCTGGAGGAGGA
GATATGAGGGACAATTGGAGAAGTGAATTATATAAATATAAAGTAGT
AAAAATTGAACCATTAGGAGTAGCACCCACCAAGGCAAAGAGAAGAG
TGGTGCAGAGAGAAAAAAGAGCAGTGGGAATAGGAGCTTTGTTCCTT
GGGTTCTTGGGAGCAGCAGGAAGCACTATGGGCGCAGCGTCAATGAC
GCTGACGGTACAGGCCAGACAATTATTGTCTGGTATAGTGCAGCAGCA
GAACAATTTGCTGAGGGCTATTGAGGCGCAACAGCATCTGTTGCAACT
CACAGTCTGGGGCATCAAGCAGCTCCAGGCAAGAATCCTGGCTGTGG
AAAGATACCTAAAGGATCAACAGCTCCTGGGGATTTGGGGTTGCTCTG
GAAAACTCATTTGCACCACTGCTGTGCCTTGGAATGCTAGTTGGAGTA
ATAAATCTCTGGAACAGATTTGGAATCACACGACCTGGATGGAGTGG
GACAGAGAAATTAACAATTACACAAGCTTAATACACTCCTTAATTGAA
GAATCGCAAAACCAGCAAGAAAAGAATGAACAAGAATTATTGGAATT
AGATAAATGGGCAAGTTTGTGGAATTGGTTTAACATAACAAATTGGCT
GTGGTATATAAAATTATTCATAATGATAGTAGGAGGCTTGGTAGGTTT
AAGAATAGTTTTTGCTGTACTTTCTATAGTGAATAGAGTTAGGCAGGG
ATATTCACCATTATCGTTTCAGACCCACCTCCCAACCCCGAGGGGACC
CGACAGGCCCGAAGGAATAGAAGAAGAAGGTGGAGAGAGAGACAGA
GACAGATCCATTCGATTAGTGAACGGATCGGCACTGCGTGCGCCAATT
CTGCAGACAAATGGCAGTATTCATCCACAATTTTAAAAGAAAAGGGG
GGATTGGGGGGTACAGTGCAGGGGAAAGAATAGTAGACATAATAGCA
ACAGACATACAAACTAAAGAATTACAAAAACAAATTACAAAAATTCA
AAATTTTCGGGTTTATTACAGGGACAGCAGAGATCCAGTTTGGTTAAT
TAGCTAGCTAGGTCTTGAAAGGAGTGGGAATTGGCTCCGGTGCCCGTC
AGTGGGCAGAGCGCACATCGCCCACAGTCCCCGAGAAGTTGGGGGA
GGGGTCGGCAATTGATCCGGTGCCTAGAGAAGGTGGCGCGGGGTAAA
CTGGGAAAGTGATGTCGTGTACTGGCTCCGCCTTTTTCCCGAGGGTGG
GGGAGAACCGTATATAAGTGCAGTAGTCGCCGTGAACGTTCTTTTTCG
CAACGGGTTTGCCGCCAGAACACAGGACCGGTTCTAGAGCGCTGCCA
CCATGGACAAGAAGTACAGCATCGGCCTGGACATCGGCACCAACTCT
GTGGGCTGGGCCGTGATCACCGACGAGTACAAGGTGCCCAGCAAGAA
ATTCAAGGTGCTGGGCAACACCGACCGGCACAGCATCAAGAAGAACC
TGATCGGAGCCCTGCTGTTCGACAGCGGCGAAACAGCCGAGGCCACC
CGGCTGAAGAGAACCGCCAGAAGAAGATACACCAGACGGAAGAACC
GGATCTGCTATCTGCAAGAGATCTTCAGCAACGAGATGGCCAAGGTG
GACGACAGCTTCTTCCACAGACTGGAAGAGTCCTTCCTGGTGGAAGAG
GATAAGAAGCACGAGCGGCACCCCATCTTCGGCAACATCGTGGACGA
GGTGGCCTACCACGAGAAGTACCCCACCATCTACCACCTGAGAAAGA
AACTGGTGGACAGCACCGACAAGGCCGACCTGCGGCTGATCTATCTG
GCCCTGGCCCACATGATCAAGTTCCGGGGCCACTTCCTGATCGAGGGC
GACCTGAACCCCGACAACAGCGACGTGGACAAGCTGTTCATCCAGCT
GGTGCAGACCTACAACCAGCTGTTCGAGGAAAACCCCATCAACGCCA
GCGGCGTGGACGCCAAGGCCATCCTGTCTGCCAGACTGAGCAAGAGC
AGACGGCTGGAAAATCTGATCGCCCAGCTGCCCGGCGAGAAGAAGAA
TGGCCTGTTCGGAAACCTGATTGCCCTGAGCCTGGGCCTGACCCCCAA
CTTCAAGAGCAACTTCGACCTGGCCGAGGATGCCAAACTGCAGCTGA
GCAAGGACACCTACGACGACGACCTGGACAACCTGCTGGCCCAGATC
GGCGACCAGTACGCCGACCTGTTTCTGGCCGCCAAGAACCTGTCCGAC
GCCATCCTGCTGAGCGACATCCTGAGAGTGAACACCGAGATCACCAA
GGCCCCCCTGAGCGCCTCTATGATCAAGAGATACGACGAGCACCACC
AGGACCTGACCCTGCTGAAAGCTCTCGTGCGGCAGCAGCTGCCTGAGA
AGTACAAAGAGATTTTCTTCGACCAGAGCAAGAACGGCTACGCCGGC
TACATTGACGGCGGAGCCAGCCAGGAAGAGTTCTACAAGTTCATCAA
GCCCATCCTGGAAAAGATGGACGGCACCGAGGAACTGCTCGTGAAGC
TGAACAGAGAGGACCTGCTGCGGAAGCAGCGGACCTTCGACAACGGC
AGCATCCCCCACCAGATCCACCTGGGAGAGCTGCACGCCATTCTGCGG
CGGCAGGAAGATTTTTACCCATTCCTGAAGGACAACCGGGAAAAGAT
CGAGAAGATCCTGACCTTCCGCATCCCCTACTACGTGGGCCCTCTGGC
CAGGGGAAACAGCAGATTCGCCTGGATGACCAGAAAGAGCGAGGAA
ACCATCACCCCCTGGAACTTCGAGGAAGTGGTGGACAAGGGCGCTTCC
GCCCAGAGCTTCATCGAGCGGATGACCAACTTCGATAAGAACCTGCCC
AACGAGAAGGTGCTGCCCAAGCACAGCCTGCTGTACGAGTACTTCACC |

TABLE 6-continued

Nucleic Acid Sequences of Lentivirus
Vector and CAR Transfer Plasmid

| SEQ ID NO | Nucleotide Sequence |
|---|---|
| | GTGTATAACGAGCTGACCAAAGTGAAATACGTGACCGAGGGAATGAG |
| | AAAGCCCGCCTTCCTGAGCGGCGAGCAGAAAAAGGCCATCGTGGACC |
| | TGCTGTTCAAGACCAACCGGAAAGTGACCGTGAAGCAGCTGAAAGAG |
| | GACTACTTCAAGAAAATCGAGTGCTTCGACTCCGTGGAAATCTCCGGC |
| | GTGGAAGATCGGTTCAACGCCTCCCTGGGCACATACCACGATCTGCTG |
| | AAAATTATCAAGGACAAGGACTTCCTGGACAATGAGGAAAACGAGGA |
| | CATTCTGGAAGATATCGTGCTGACCCTGACACTGTTTGAGGACAGAGA |
| | GATGATCGAGGAACGGCTGAAAACCTATGCCCACCTGTTCGACGACA |
| | AAGTGATGAAGCAGCTGAAGCGGCGGAGATACACCGGCTGGGGCAGG |
| | CTGAGCCGGAAGCTGATCAACGGCATCCGGGACAAGCAGTCCGGCAA |
| | GACAATCCTGGATTTCCTGAAGTCCGACGGCTTCGCCAACAGAAACTT |
| | CATGCAGCTGATCCACGACGACAGCCTGACCTTTAAAGAGGACATCCA |
| | GAAAGCCCAGGTGTCCGGCCAGGGCGATAGCCTGCACGAGCACATTG |
| | CCAATCTGGCCGGCAGCCCCGCCATTAAGAAGGGCATCCTGCAGACA |
| | GTGAAGGTGGTGGACGAGCTCGTGAAAGTGATGGGCCGGCACAAGCC |
| | CGAGAACATCGTGATCGAAATGGCCAGAGAGAACCAGACCACCCAGA |
| | AGGGACAGAAGAACAGCCGCGAGAGAATGAAGCGGATCGAAGAGGG |
| | CATCAAAGAGCTGGGCAGCCAGATCCTGAAAGAACACCCCGTGGAAA |
| | ACACCCAGCTGCAGAACGAGAAGCTGTACCTGTACTACCTGCAGAAT |
| | GGGCGGGATATGTACGTGGACCAGGAACTGGACATCAACCGGCTGTC |
| | CGACTACGATGTGGACCATATCGTGCCTCAGAGCTTTCTGAAGGACGA |
| | CTCCATCGACAACAAGGTGCTGACCAGAAGCGACAAGAACCGGGGCA |
| | AGAGCGACAACGTGCCCTCCGAAGAGGTCGTGAAGAAGATGAAGAAC |
| | TACTGGCGGCAGCTGCTGAACGCCAAGCTGATTACCCAGAGAAAGTTC |
| | GACAATCTGACCAAGGCCGAGAGAGGCGGCCTGAGCGAACTGGATAA |
| | GGCCGGCTTCATCAAGAGACAGCTGGTGGAAACCCGGCAGATCACAA |
| | AGCACGTGGCACAGATCCTGGACTCCCGGATGAACACTAAGTACGAC |
| | GAGAATGACAAGCTGATCCGGGAAGTGAAAGTGATCACCCTGAAGTC |
| | CAAGCTGGTGTCCGATTTCCGGAAGGATTTCCAGTTTTACAAAGTGCG |
| | CGAGATCAACAACTACCACCACGCCCACGACGCCTACCTGAACGCCGT |
| | CGTGGGAACCGCCCTGATCAAAAAGTACCCTAAGCTGGAAAGCGAGT |
| | TCGTGTACGGCGACTACAAGGTGTACGACGTGCGGAAGATGATCGCC |
| | AAGAGCGAGCAGGAAATCGGCAAGGCTACCGCCAAGTACTTCTTCTA |
| | CAGCAACATCATGAACTTTTTCAAGACCGAGATTACCCTGGCCAACGG |
| | CGAGATCCGGAAGCGGCCTCTGATCGAGACAAACGGCGAAACCGGGG |
| | AGATCGTGTGGGATAAGGGCCGGGATTTTGCCACCGTGCGGAAAGTG |
| | CTGAGCATGCCCCAAGTGAATATCGTGAAAAAGACCGAGGTGCAGAC |
| | AGGCGGCTTCAGCAAAGAGTCTATCCTGCCCAAGAGGAACAGCGATA |
| | AGCTGATCGCCAGAAAGAAGGACTGGGACCCTAAGAAGTACGGCGGC |
| | TTCGACAGCCCCACCGTGGCCTATTCTGTGCTGGTGGTGGCCAAAGTG |
| | GAAAAGGGCAAGTCCAAGAAACTGAAGAGTGTGAAAGAGCTACTGGG |
| | GATCACCATCATGGAAAGAAGCAGCTTCGAGAAGAATCCCATCGACT |
| | TTCTGGAAGCCAAGGGCTACAAAGAAGTGAAAAAGGACCTGATCATC |
| | AAGCTGCCTAAGTACTCCCTGTTCGAGCTGGAAAACGGCCGGAAGAG |
| | AATGCTGGCCTCTGCCGGCGAACTGCAGAAGGGAAACGAACTGGCCC |
| | TGCCCTCCAAATATGTGAACTTCCTGTACCTGGCCAGCCACTATGAGA |
| | AGCTGAAGGGCTCCCCCGAGGATAATGAGCAGAAACAGCTGTTTGTG |
| | GAACAGCACAAGCACTACCTGGACGAGATCATCGAGCAGATCAGCGA |
| | GTTCTCCAAGAGAGTGATCCTGGCCGACGCTAATCTGGACAAAGTGCT |
| | GTCCGCCTACAACAAGCACCGGGATAAGCCCATCAGAGAGCAGGCCG |
| | AGAATATCATCCACCTGTTTACCCTGACCAATCTGGGAGCCCCTGCCG |
| | CCTTCAAGTACTTTGACACCACCATCGACCGGAAGAGGTACACCAGCA |
| | CCAAAGAGGTGCTGGACGCCACCCTGATCCACCAGAGCATCACCGGC |
| | CTGTACGAGACACGGATCGACCTGTCTCAGCTGGGAGGCGACAAGCG |
| | ACCTGCCGCCACAAAGAAGGCTGGACAGGCTAAGAAGAAGAAAGATT |
| | ACAAAGACGATGACGATAAGGGATCCGGCGCAACAAACTTCTCTCTG |
| | CTGAAACAAGCCGGAGATGTCGAAGAGAATCCTGGACCGATGGCCAA |
| | GCCTTTGTCTCAAGAAGAATCCACCCTCATTGAAAGAGCAACGGCTAC |
| | AATCAACAGCATCCCCATCTCTGAAGACTACAGCGTCGCCAGCGCAGC |
| | TCTCTCTAGCGACGGCCGCATCTTCACTGGTGTCAATGTATATCATTTT |
| | ACTGGGGGACCTTGTGCAGAACTCGTGGTGCTGGGCACTGCTGCTGCT |
| | GCGGCAGCTGGCAACCTGACTTGTATCGTCGCGATCGGAAATGAGAA |
| | CAGGGGCATCTTGAGCCCCTGCGGACGGTGCCGACAGGTGCTTCTCGA |
| | TCTGCATCCTGGGATCAAAGCCATAGTGAAGGACAGTGATGGACAGC |
| | CGACGGCAGTTGGGATTCGTGAATTGCTGCCCTCTGGTTATGTGTGGG |
| | AGGGCTAAGAATTCGATATCAAGCTTATCGGTAATCAACCTCTGGATT |
| | ACAAAATTTGTGAAAGATTGACTGGTATTCTTAACTATGTTGCTCCTTT |
| | TACGCTATGTGGATACGCTGCTTTAATGCCTTTGTATCATGCTATTGCT |
| | TCCCGTATGGCTTTCATTTTCTCCTCCTTGTATAAATCCTGGTTGCTGTC |
| | TCTTTATGAGGAGTTGTGGCCCGTTGTCAGGCAACGTGGCGTGGTGTG |
| | CACTGTGTTTGCTGACGCAACCCCCACTGGTTGGGGCATTGCCACCAC |
| | CTGTCAGCTCCTTTCCGGGACTTTCGCTTTCCCCCTCCCTATTGCCACG |
| | GCGGAACTCATCGCCGCCTGCCTTGCCCGCTGCTGGACAGGGGCTCGG |
| | CTGTTGGGCACTGACAATTCCGTGGTGTTGTCGGGGAAATCATCGTCC |
| | TTTCCTTGGCTGCTCGCCTGTGTTGCCACCTGGATTCTGCGCGGGACGT |

TABLE 6-continued

Nucleic Acid Sequences of Lentivirus
Vector and CAR Transfer Plasmid

| SEQ ID NO | Nucleotide Sequence |
|---|---|
| | CCTTCTGCTACGTCCCTTCGGCCCTCAATCCAGCGGACCTTCCTTCCCG<br>CGGCCTGCTGCCGGCTCTGCGGCCTCTTCCGCGTCTTCGCCTTCGCCCT<br>CAGACGAGTCGGATCTCCCTTTGGGCCGCCTCCCCGCATCGATACCGT<br>CGACCTCGAGACCTAGAAAAACATGGAGCAATCACAAGTAGCAATAC<br>AGCAGCTACCAATGCTGATTGTGCCTGGCTAGAAGCACAAGAGGAGG<br>AGGAGGTGGGTTTTCCAGTCACACCTCAGGTACCTTTAAGACCAATGA<br>CTTACAAGGCAGCTGTAGATCTTAGCCACTTTTTAAAAGAAAAGGGGG<br>GACTGGAAGGGCTAATTCACTCCCAACGAAGACAAGATATCCTTGATC<br>TGTGGATCTACCACACACAAGGCTACTTCCCTGATTGGCAGAACTACA<br>CACCAGGGCCAGGGATCAGATATCCACTGACCTTTGGATGGTGCTACA<br>AGCTAGTACCAGTTGAGCAAGAGAAGGTAGAAGAAGCCAATGAAGGA<br>GAGAACACCCGCTT |
| SEQ ID NO: 1285 | TGGAAGGGCTAATTCACTCCCAAAGAAGACAAGATATCCTTGATCTGT<br>GGATCTACCACACACAAGGCTACTTCCCTGATTAGCAGAACTACACAC<br>CAGGGCCAGGGGTCAGATATCCACTGACCTTTGGATGGTGCTACAAGC<br>TAGTACCAGTTGAGCCAGATAAGGTAGAAGAGGCCAATAAAGGAGAG<br>AACACCAGCTTGTTACACCCTGTGAGCCTGCATGGGATGGATGACCCG<br>GAGAGAGAAGTGTTAGAGTGGAGGTTTGACAGCCGCCTAGCATTTCAT<br>CACGTGGCCCGAGAGCTGCATCCGGAGTACTTCAAGAACTGCTGATAT<br>CGAGCTTGCTACAAGGGACTTTCCGCTGGGGACTTTCCAGGGAGGCGT<br>GGCCTGGGCGGGACTGGGGAGTGGCGAGCCCTCAGATCCTGCATATA<br>AGCAGCTGCTTTTTGCCTGTACTGGGTCTCTCTGGTTAGACCAGATCTG<br>AGCCTGGGAGCTCTCTGGCTAACTAGGGAACCCACTGCTTAAGCCTCA<br>ATAAAGCTTGCCTTGAGTGCTTCAAGTAGTGTGTGCCCGTCTGTTGTGT<br>GACTCTGGTAACTAGAGATCCCTCAGACCCTTTTAGTCAGTGTGGAAA<br>ATCTCTAGCAGTGGCGCCCGAACAGGGACTTGAAAGCGAAAGGGAAA<br>CCAGAGGAGCTCTCTCGACGCAGGACTCGGCTTGCTGAAGCGCGCAC<br>GGCAAGAGGCGAGGGGCGGCGACTGGTGAGTACGCCAAAAATTTTGA<br>CTAGCGGAGGCTAGAAGGAGAGAGATGGGTGCGAGAGCGTCAGTATT<br>AAGCGGGGGAGAATTAGATCGCGATGGGAAAAAATTCGGTTAAGGCC<br>AGGGGGAAAGAAAAAATATAAATTAAAACATATAGTATGGGCAAGCA<br>GGGAGCTAGAACGATTCGCAGTTAATCCTGGCCTGTTAGAAACATCAG<br>AAGGCTGTAGACAAATACTGGGACAGCTACAACCATCCCTTCAGACA<br>GGATCAGAAGAACTTAGATCATTATATAATACAGTAGCAACCCTCTAT<br>TGTGTGCATCAAAGGATAGAGATAAAAGACACCAAGGAAGCTTTAGA<br>CAAGATAGAGGAAGAGCAAAACAAAAGTAAGACCACCGCACAGCAA<br>GCGGCCGGCCGCTGATCTTCAGACCTGGAGGAGGAGATATGAGGGAC<br>AATTGGAGAAGTGAATTATATAAATATAAAGTAGTAAAAATTGAACC<br>ATTAGGAGTAGCACCCACCAAGGCAAAGAGAAGAGTGGTGCAGAGAG<br>AAAAAAGAGCAGTGGGAATAGGAGCTTTGTTCCTTGGGTTCTTGGGAG<br>CAGCAGGAAGCACTATGGGCGCAGCGTCAATGACGCTGACGGTACAG<br>GCCAGACAATTATTGTCTGGTATAGTGCAGCAGCAGAACAATTTGCTG<br>AGGGCTATTGAGGCGCAACAGCATCTGTTGCAACTCACAGTCTGGGGC<br>ATCAAGCAGCTCCAGGCAAGAATCCTGGCTGTGGAAAGATACCTAAA<br>GGATCAACAGCTCCTGGGGATTTGGGGTTGCTCTGGAAAACTCATTTG<br>CACCACTGCTGTGCCTTGGAATGCTAGTTGGAGTAATAAATCTCTGGA<br>ACAGATTTGGAATCACACGACCTGGATGGAGTGGGACAGAGAAATTA<br>ACAATTACACAAGCTTAATACACTCCTTAATTGAAGAATCGCAAAACC<br>AGCAAGAAAAGAATGAACAAGAATTATTGGAATTAGATAAATGGGCA<br>AGTTTGTGGAATTGGTTTAACATAACAAATTGGCTGTGGTATATAAAA<br>TTATTCATAATGATAGTAGGAGGCTTGGTAGGTTTAAGAATAGTTTTT<br>GCTGTACTTTCTATAGTGAATAGAGTTAGGCAGGGATATTCACCATTA<br>TCGTTTCAGACCCACCTCCCAACCCCGAGGGGACCCGACAGGCCCGAA<br>GGAATAGAAGAAGAAGGTGGAGAGAGAGACAGAGACAGATCCATTC<br>GATTAGTGAACGGATCTCGACGGTATCGCCTTTAAAAGAAAAGGGGG<br>GATTGGGGGGTACAGTGCAGGGGAAAGAATAGTAGACATAATAGCAA<br>CAGACATACAAACTAAAGAATTACAAAAACAAATTACAAAAATTCAA<br>AATTTTCGGGTTTATTACAGGGACAGCAGAGATCCAGTTTATCGATGA<br>GTAATTCATACAAAAGGACTCGCCCCTGCCTTGGGGAATCCCAGGGAC<br>CGTCGTTAAACTCCCACTAACGTAGAACCCAGAGATCGCTGCGTTCCC<br>GCCCCCTCACCCGCCCGCTCTCGTCATCACTGAGGTGGAGAAGAGCAT<br>GCGTGAGGCTCCGGTGCCCGTCAGTGGGCAGAGCGCACATCGCCCAC<br>AGTCCCCGAGAAGTTGGGGGAGGGGTCGGCAATTGAACCGGTGCCT<br>AGAGAAGGTGGCGCGGGGTAAACTGGGAAAGTGATGTCGTGTACTGG<br>CTCCGCCTTTTTCCCGAGGGTGGGGGAGAACCGTATATAAGTGCAGTA<br>GTCGCCGTGAACGTTCTTTTTCGCAACGGGTTTGCCGCCAGAACACAG<br>GTAAGTGCCGTGTGTGGTTCCCGCGGGCCTGGCCTCTTTACGGGTTAT<br>GGCCCTTGCGTGCCTTGAATTACTTCCACGCCCTGGCTGCAGTACGT<br>GATTCTTGATCCCGAGCTTCGGGTTGGAAGTGGGTGGGAGAGTTCGAG<br>GCCTTGCGCTTAAGGAGCCCCTTCGCCTCGTGCTTGAGTTGAGGCCTG<br>GCTTGGGCGCTGGGGCCGCCGCGTGCGAATCTGGTGGCACCTTCGCGC<br>CTGTCTCGCTGCTTTCGATAAGTCTCTAGCCATTTAAAATTTTTGATGA<br>CCTGCTGCGACGCTTTTTTTCTGGCAAGATAGTCTTGTAAATGCGGGCC<br>AAGATCTGCACACTGGTATTTCGGTTTTTGGGGCCGCGGGCGGCGACG |

TABLE 6-continued

Nucleic Acid Sequences of Lentivirus
Vector and CAR Transfer Plasmid

| SEQ ID NO | Nucleotide Sequence |
|---|---|
| | GGGCCCGTGCGTCCCAGCGCACATGTTCGGCGAGGCGGGGCCTGCGA
GCGCGGCCACCGAGAATCGGACGGGGGTAGTCTCAAGCTGGCCGGCC
TGCTCTGGTGCCTGGCCTCGCGCCGCCGTGTATCGCCCCGCCCTGGGC
GGCAAGGCTGGCCCGGTCGGCACCAGTTGCGTGAGCGGAAAGATGGC
CGCTTCCCGGCCCTGCTGCAGGGAGCTCAAATGGAGGACGCGGCGC
TCGGGAGAGCGGGGGTGAGTCACCCACACAAAGGAAAAGGGCCTT
TCCGTCCTCAGCCGTCGCTTCATGTGACTCCACGGAGTACCGGGCGCC
GTCCAGGCACCTCGATTAGTTCTCGAGCTTTTGGAGTACGTCGTCTTTA
GGTTGGGGGGAGGGGTTTTATGCGATGGAGTTTCCCCACACTGAGTGG
GTGGAGACTGAAGTTAGGCCAGCTTGGCACTTGATGTAATTCTCCTTG
GAATTTGCCCTTTTTGAGTTTGGATCTTGGTTCATTCTCAAGCCTCAGA
CAGTGGTTCAAAGTTTTTTTCTTCCATTTCAGGTGTCGTGATTCGAATT
CGCCGCCACCATGGCCTTACCAGTGACCGCCTTGCTCCTGCCGCTGGC
CTTGCTGCTCCACGCCGCCAGGCCGGACATCCAGATGACACAGACTAC
ATCCTCCCTGTCTGCCTCTCTGGGAGACAGAGTCACCATCAGTTGCAG
GGCAAGTCAGGACATTAGTAAATATTTAAATTGGTATCAGCAGAAACC
AGATGGAACTGTTAAACTCCTGATCTACCATACATCAAGATTACACTC
AGGAGTCCCATCAAGGTTCAGTGGCAGTGGGTCTGGAACAGATTATTC
TCTCACCATTAGCAACCTGGAGCAAGAAGATATTGCCACTTACTTTTG
CCAACAGGGTAATACGCTTCCGTACACGTTCGGAGGGGGGACCAAGC
TGGAGATCACAGGTGGCGGTGGCTCGGGCGGTGGTGGGTCGGGTGGC
GGCGGATCTGAGGTGAAACTGCAGGAGTCAGGACCTGGCCTGGTGGC
GCCCTCACAGAGCCTGTCCGTCACATGCACTGTCTCAGGGGTCTCATT
ACCCGACTATGGTGTAAGCTGGATTCGCCAGCCTCCACGAAAGGGTCT
GGAGTGGCTGGGAGTAATATGGGGTAGTGAAACCACATACTATAATT
CAGCTCTCAAATCCAGACTGACCATCATCAAGGACAACTCCAAGAGCC
AAGTTTTCTTAAAAATGAACAGTCTGCAAACTGATGACACAGCCATTT
ACTACTGTGCCAAACATTATTACTACGGTGGTAGCTATGCTATGGACT
ACTGGGGCCAAGGAACCTCAGTCACCGTCTCCTCAACCACGACGCCAG
CGCCGCGACCACCAACACCGGCGCCCACCATCGCGTCGCAGCCCCTGT
CCCTGCGCCCAGAGGCGTGCCGGCCAGCGGCGGGGGGCGCAGTGCAC
ACGAGGGGGCTGGACTTCGCCTGTGATTTCTGGGTGCTGGTCGTTGTG
GGCGGCGTGCTGGCCTGCTACAGCCTGCTGGTGACAGTGGCCTTCATC
ATCTTTTGGGTGAGGAGCAAGCGGAGCAGACTGCTGCACAGCGACTA
CATGAACATGACCCCCCGGAGGCCTGGCCCCACCCGGAAGCACTACC
AGCCCTACGCCCCTCCCAGGGATTTCGCCGCCTACCGGAGCAAACGGG
GCAGAAAGAAACTCCTGTATATATTCAAACAACCATTTATGAGACCAG
TACAAACTACTCAAGAGGAAGATGGCTGTAGCTGCCGATTTCCAGAA
GAAGAAGAAGGAGGATGTGAACTGAGAGTGAAGTTCAGCAGGAGCG
CAGACGCCCCCGCGTACAAGCAGGGCCAGAACCAGCTCTATAACGAG
CTCAATCTAGGACGAAGAGAGGAGTACGATGTTTTGGACAAGAACG
TGGCCGGGACCCTGAGATGGGGGGAAAGCCGAGAAGGAAGAACCCTC
AGGAAGGCCTGTACAATGAACTGCAGAAAGATAAGATGGCGGAGGCC
TACAGTGAGATTGGGATGAAAGGCGAGCGCCGGAGGGGCAAGGGGC
ACGATGGCCTTTACCAGGGTCTCAGTACAGCCACCAAGGACACCTACG
ACGCCCTTCACATGCAGGCCCTGCCCCCTCGCGAGGGCAGAGGCAGCC
TGCTGACATGTGGCGACGTGGAAGAGAACCCTGGCCCCATGTGGCTGC
AGAGCCTGCTGCTCTTGGGCACTGTGGCCTGCAGCATCTCTCGCAAAG
TGTGTAACGGAATAGGTATTGGTGAATTTAAAGACTCACTCTCCATAA
ATGCTACGAATATTAAACACTTCAAAAACTGCACCTCCATCAGTGGCG
ATCTCCACATCCTGCCGGTGGCATTTAGGGGTGACTCCTTCACACATA
CTCCTCCTCTGGATCCACAGGAACTGGATATTCTGAAAACCGTAAAGG
AAATCACAGGGTTTTTGCTGATTCAGGCTTGGCCTGAAAACAGGACGG
ACCTCCATGCCTTTGAGAACCTAGAAATCATACGCGGCAGGACCAAGC
AACATGGTCAGTTTTCTCTTGCAGTCGTCAGCCTGAACATAACATCCTT
GGGATTACGCTCCCTCAAGGAGATAAGTGATGGAGATGTGATAATTTC
AGGAAACAAAAATTTGTGCTATGCAAATACAATAAACTGGAAAAAAC
TGTTTGGGACCTCCGGTCAGAAAACCAAAATTATAAGCAACAGAGGT
GAAAACAGCTGCAAGGCCACAGGCCAGGTCTGCCATGCCTTGTGCTCC
CCCGAGGGCTGCTGGGGCCGGAGCCCAGGGACTGCGTCTCTTGCCGG
AATGTCAGCCGAGGCAGGGAATGCGTGGACAAGTGCAACCTTCTGGA
GGGTGAGCCAAGGGAGTTTGTGGAGAACTCTGAGTGCATACAGTGCC
ACCCAGAGTGCCTGCCTCAGGCCATGAACATCACCTGCACAGGACGG
GGACCAGACAACTGTATCCAGTGTGCCCACTACATTGACGGCCCCCAC
TGCGTCAAGACCTGCCCGGCAGGAGTCATGGGAGAAAACAACACCCT
GGTCTGGAAGTACGCAGACGCCGGCCATGTGTGCCACCTGTGCCATCC
AAACTGCACCTACGGATGCACTGGGCCAGGTCTTGAAGGCTGTCCAAC
GAATGGGCCTAAGATCCCGTCCATCGCCACTGGGATGGTGGGGGCCCT
CCTCTTGCTGCTGGTGGTGGCCCTGGGGATCGGCCTCTTCATGTAATA
ATCTAGACCGCGTCTGGAACAATCAACCTCTGGATTACAAAATTTGTG
AAAGATTGACTGGTATTCTTAACTATGTTGCTCCTTTTACGCTATGTGG
ATACGCTGCTTTAATGCCTTTGTATCATGCTATTGCTTCCCGTATGGCT
TTCATTTTCTCCTCCTTGTATAAATCCTGGTTGCTGTCTCTTTATGAGGA
GTTGTGGCCCGTTGTCAGGCAACGTGGCGTGGTGTGCACTGTGTTTGC
TGACGCAACCCCCACTGGTTGGGGCATTGCCACCACCTGTCAGCTCCT |

TABLE 6-continued

Nucleic Acid Sequences of Lentivirus
Vector and CAR Transfer Plasmid

| SEQ ID NO | Nucleotide Sequence |
|---|---|
| | TTCCGGGACTTTCGCTTTCCCCCTCCCTATTGCCACGGCGGAACTCATC |
| | GCCGCCTGCCTTGCCCGCTGCTGGACAGGGGCTCGGCTGTTGGGCACT |
| | GACAATTCCGTGGTGTTGTCGGGGAAGCTGACGTCCTTTCCATGGCTG |
| | CTCGCCTGTGTTGCCACCTGGATTCTGCGCGGGACGTCCTTCTGCTACG |
| | TCCCTTCGGCCCTCAATCCAGCGGACCTTCCTTCCCGCGGCCTGCTGCC |
| | GGCTCTGCGGCCTCTTCCGCGTCTTCGCCTTCGCCCTCAGACGAGTCGG |
| | ATCTCCCTTTGGGCCGCCTCCCCGCCTGGAATTAATTCTGCAGTCGAG |
| | ACCTAGAAAAACATGGAGCAATCACAAGTAGCAATACAGCAGCTACC |
| | AATGCTGATTGTGCCTGGCTAGAAGCACAAGAGGAGGAGGAGGTGGG |
| | TTTTCCAGTCACACCTCAGGTACCTTTAAGACCAATGACTTACAAGGC |
| | AGCTGTAGATCTTAGCCACTTTTTAAAAGAAAAGAGGGGACTGGAAG |
| | GGCTAATTCACTCCCAACGAAGACAAGATATCCTTGATCTGTGGATCT |
| | ACCACACACAAGGCTACTTCCCTGATTAGCAGAACTACACACCAGGGC |
| | CAGGGGTCAGATATCCACTGACCTTTGGATGGTGCTACAAGCTAGTAC |
| | CAGTTGAGCCAGATAAGGTAGAAGAGGCCAATAAAGGAGAGAACACC |
| | AGCTTGTTACACCCTGTGAGCCTGCATGGGATGGATGACCCGGAGAGA |
| | GAAGTGTTAGAGTGGAGGTTTGACAGCCGCCTAGCATTTCATCACGTG |
| | GCCCGAGAGCTGCATCCGGAGTACTTCAAGAACTGCTGATATCGAGCT |
| | TGCTACAAGGGACTTTCCGCTGGGGACTTTCCAGGGAGGCGTGGCCTG |
| | GGCGGGACTGGGGAGTGGCGAGCCCTCAGATCCTGCATATAAGCAGC |
| | TGCTTTTTGCCTGTACTGGGTCTCTCTGGTTAGACCAGATCTGAGCCTG |
| | GGAGCTCTCTGGCTAACTAGGGAACCCACTGCTTAAGCCTCAATAAAG |
| | CTTGCCTTGAGTGCTTCAAGTAGTGTGTGCCCGTCTGTTGTGTGACTCT |
| | GGTAACTAGAGATCCCTCAGACCCTTTTAGTCAGTGTGGAAAATCTCT |
| | AGCAGTAGTAGTTCATGTCATCTTATTATTCAGTATTTATAACTTGCAA |
| | AGAAATGAATATCAGAGAGTGAGAGGCCTTGACATTGCTAGCGTTTTA |
| | CCGTCGACCTCTAGCTAGAGCTTGGCGTAATCATGGTCATAGCTGTTT |
| | CCTGTGTGAAATTGTTATCCGCTCACAATTCCACACAACATACGAGCC |
| | GGAAGCATAAAGTGTAAAGCCTGGGGTGCCTAATGAGTGAGCTAACT |
| | CACATTAATTGCGTTGCGCTCACTGCCCGCTTTCCAGTCGGGAAACCT |
| | GTCGTGCCAGCTGCATTAATGAATCGGCCAACGCGCGGGGAGAGGCG |
| | GTTTGCGTATTGGGCGCTCTTCCGCTTCCTCGCTCACTGACTCGCTGCG |
| | CTCGGTCGTTCGGCTGCGGCGAGCGGTATCAGCTCACTCAAAGGCGGT |
| | AATACGGTTATCCACAGAATCAGGGGATAACGCAGGAAAGAACATGT |
| | GAGCAAAAGGCCAGCAAAAGGCCAGGAACCGTAAAAAGGCCGCGTT |
| | GCTGGCGTTTTTCCATAGGCTCCGCCCCCCTGACGAGCATCACAAAAA |
| | TCGACGCTCAAGTCAGAGGTGGCGAAACCCGACAGGACTATAAAGAT |
| | ACCAGGCGTTTCCCCCTGGAAGCTCCCTCGTGCGCTCTCCTGTTCCGAC |
| | CCTGCCGCTTACCGGATACCTGTCCGCCTTTCTCCCTTCGGGAAGCGTG |
| | GCGCTTTCTCATAGCTCACGCTGTAGGTATCTCAGTTCGGTGTAGGTCG |
| | TTCGCTCCAAGCTGGGCTGTGTGCACGAACCCCCCGTTCAGCCCGACC |
| | GCTGCGCCTTATCCGGTAACTATCGTCTTGAGTCCAACCCGGTAAGAC |
| | ACGACTTATCGCCACTGGCAGCAGCCACTGGTAACAGGATTAGCAGA |
| | GCGAGGTATGTAGGCGGTGCTACAGAGTTCTTGAAGTGGTGGCCTAAC |
| | TACGGCTACACTAGAAGAACAGTATTTGGTATCTGCGCTCTGCTGAAG |
| | CCAGTTACCTTCGGAAAAAGAGTTGGTAGCTCTTGATCCGGCAAACAA |
| | ACCACCGCTGGTAGCGGTGGTTTTTTTGTTTGCAAGCAGCAGATTACG |
| | CGCAGAAAAAAAGGATCTCAAGAAGATCCTTTGATCTTTTCTACGGGG |
| | TCTGACGCTCAGTGGAACGAAAACTCACGTTAAGGGATTTTGGTCATG |
| | AGATTATCAAAAAGGATCTTCACCTAGATCCTTTTAAATTAAAAATGA |
| | AGTTTTAAATCAATCTAAAGTATATATGAGTAAACTTGGTCTGACAGT |
| | TACCAATGCTTAATCAGTGAGGCACCTATCTCAGCGATCTGTCTATTTC |
| | GTTCATCCATAGTTGCCTGACTCCCCGTCGTGTAGATAACTACGATAC |
| | GGGAGGGCTTACCATCTGGCCCCAGTGCTGCAATGATACCGCGAGACC |
| | CACGCTCACCGGCTCCAGATTTATCAGCAATAAACCAGCCAGCCGGAA |
| | GGGCCGAGCGCAGAAGTGGTCCTGCAACTTTATCCGCCTCCATCCAGT |
| | CTATTAATTGTTGCCGGGAAGCTAGAGTAAGTAGTTCGCCAGTTAATA |
| | GTTTGCGCAACGTTGTTGCCATTGCTACAGGCATCGTGGTGTCACGCT |
| | CGTCGTTTGGTATGGCTTCATTCAGCTCCGGTTCCCAACGATCAAGGC |
| | GAGTTACATGATCCCCATGTTGTGCAAAAAAGCGGTTAGCTCCTTCG |
| | GTCCTCCGATCGTTGTCAGAAGTAAGTTGGCCGCAGTGTTATCACTCA |
| | TGGTTATGGCAGCACTGCATAATTCTCTTACTGTCATGCCATCCGTAAG |
| | ATGCTTTTCTGTGACTGGTGAGTACTCAACCAAGTCATTCTGAGAATA |
| | GTGTATGCGGCGACCGAGTTGCTCTTGCCCGGCGTCAATACGGGATAA |
| | TACCGCGCCACATAGCAGAACTTTAAAAGTGCTCATCATTGGAAAACG |
| | TTCTTCGGGGCGAAAACTCTCAAGGATCTTACCGCTGTTGAGATCCAG |
| | TTCGATGTAACCCACTCGTGCACCCAACTGATCTTCAGCATCTTTTACT |
| | TTCACCAGCGTTTCTGGGTGAGCAAAAACAGGAAGGCAAAATGCCGC |
| | AAAAAAGGGAATAAGGGCGACACGGAAATGTTGAATACTCATACTCT |
| | TCCTTTTTCAATATTATTGAAGCATTTATCAGGGTTATTGTCTCATGAG |
| | CGGATACATATTTGAATGTATTTAGAAAAATAAACAAATAGGGGTTCC |
| | GCGCACATTTCCCCGAAAAGTGCCACCTGACGTCGACGGATCGGGAG |
| | ATCAACTTGTTTATTGCAGCTTATAATGGTTACAAATAAAGCAATAGC |
| | ATCACAAATTTCACAAATAAAGCATTTTTTTCACTGCATTCTAGTTGTG |
| | GTTTGTCCAAACTCATCAATGTATCTTATCATGTCTGGATCAACTGGAT |

TABLE 6-continued

Nucleic Acid Sequences of Lentivirus
Vector and CAR Transfer Plasmid

| SEQ ID NO | Nucleotide Sequence |
|---|---|
| | AACTCAAGCTAACCAAAATCATCCCAAACTTCCCACCCCATACCCTAT<br>TACCACTGCCAATTACCTGTGGTTTCATTTACTCTAAACCTGTGATTCC<br>TCTGAATTATTTTCATTTTAAAGAAATTGTATTTGTTAAATATGTACTA<br>CAAACTTAGTAGTTTTTAAAGAAATTGTATTTGTTAAATATGTACTACA<br>AACTTAGTAGT |

In some embodiments, a probe set of the present disclosure comprising a plurality of probes can be used to detect target nucleic acid insertions stemming from an integrating virus or a non-integrating virus. In some embodiments, the target nucleic acid can be from an integrating virus, such as a retrovirus. In some embodiments, the target nucleic acid can be from a retrovirus, which is selected from a lentivirus, a gamma retrovirus, or a foamy virus. In some embodiments, the target nucleic acid can be from a non-integrating virus, which can be selected from an adenovirus or an adeno-associated virus.

In some embodiments, the target nucleic acid can be from an adeno-associated virus, which can be selected from adeno-associated virus serotype 1, adeno-associated virus serotype 2, adeno-associated virus serotype 3, adeno-associated virus serotype 4, adeno-associated virus serotype 5, adeno-associated virus serotype 6, adeno-associated virus serotype 7, adeno-associated virus serotype 8, adeno-associated virus serotype 9, or a synthetic adeno-associated virus with an evolved capsid protein. In some embodiments, the target nucleic acid can be from a lentivirus, for example, a gamma380:GFP lentivirus transfer plasmid, as set forth in SEQ ID NO: 1405. In some embodiments, the target nucleic acid can be from an adeno-associated virus comprises adeno-associated virus 1, for example as set forth in SEQ ID NO: 1406. In some embodiments, the target nucleic acid can be from an adeno-associated virus comprises adeno-associated virus 2, for example, as set forth in SEQ ID NO: 1407. In some embodiments, the target nucleic acid can be from an adeno-associated virus comprises adeno-associated virus 3, for example, as set forth in SEQ ID NO: 1408. In some embodiments, the target nucleic acid can be from an adeno-associated virus comprises adeno-associated virus 4, for example, as set forth in SEQ ID NO: 1409. In some embodiments, the target nucleic acid can be from an adeno-associated virus comprises adeno-associated virus 5, for example, as set forth in SEQ ID NO: 1410. In some embodiments, the target nucleic acid can be from an adeno-associated virus comprises adeno-associated virus 6, for example, as set forth in SEQ ID NO: 1411. In some embodiments, the target nucleic acid can be from an adeno-associated virus comprises adeno-associated virus 7, for example, as set forth in SEQ ID NO: 1412. In some embodiments, the target nucleic acid can be from an adeno-associated virus comprises adeno-associated virus 8, for example, as set forth in SEQ ID NO: 1413. In some embodiments, the target nucleic acid can be from an adeno-associated virus comprises adeno-associated virus 9, for example, as set forth in SEQ ID NO: 1414. In some embodiments, the target nucleic acid can be from an adeno-associated virus comprises adeno-associated virus 10, for example, as set forth in SEQ ID NO: 1415. In some embodiments, the target nucleic acid can be from an adeno-associated virus comprises adeno-associated virus 11, for example, as set forth in SEQ ID NO: 1416. In some embodiments, the target nucleic acid can be from an adeno-associated virus comprises adeno-associated virus 12, for example, as set forth in SEQ ID NO: 1417. In some embodiments, the target nucleic acid can be from an adeno-associated virus comprises adeno-associated virus 13, for example, as set forth in SEQ ID NO: 1418. In some embodiments, the target nucleic acid can be from an adeno-associated virus comprises the pAAV DJ vector, also referred to herein as VPK-520-DJ (PN-340001), for example, as set forth in SEQ ID NO: 1419.

In some aspects, an adeno-associated virus is selected from adeno-associated virus serotype 1; adeno-associated virus serotype 2; adeno-associated virus serotype 3; adeno-associated virus serotype 4; adeno-associated virus serotype 5; adeno-associated virus serotype 6; adeno-associated virus serotype 7; adeno-associated virus serotype 8; adeno-associated virus serotype 9; adeno-associated virus serotype 10; adeno-associated virus serotype 11; adeno-associated virus serotype 12; adeno-associated virus serotype 13; pAAV-DJ (VPK-420-DJ (PN-340001)), synthetically evolved adeno-associated viruses of any one of adeno-associated virus 1, adeno-associated virus 2, adeno-associated virus 3, adeno-associated virus 4, adeno-associated virus 5, adeno-associated virus 6, adeno-associated virus 7, adeno-associated virus 8, adeno-associated virus 9; adeno-associated virus 10, adeno-associated virus 11, adeno-associated virus 12, adeno-associated virus 13, a naturally occurring adeno-associated virus, or a synthetic adeno-associated virus comprising chimeras of any combination of adeno-associated virus 1, adeno-associated virus 2, adeno-associated virus 3, adeno-associated virus 4, adeno-associated virus 5, adeno-associated virus 6, adeno-associated virus 7, adeno-associated virus 8, adeno-associated virus 9; adeno-associated virus 10; adeno-associated virus 11; adeno-associated virus 12; adeno-associated virus 13. In some aspects, the human papillomavirus is selected from human papillomavirus 116.

In some embodiments, the target nucleic acid can be from an adenovirus, as set forth in the following examples. In some embodiments, the target nucleic acid can be from a Human mastadenovirus D, for example, as set forth in SEQ ID NO: 1420. In some embodiments, the target nucleic acid can be from a Human mastadenovirus D, for example, as set forth in SEQ ID NO: 1421. In some embodiments, the target nucleic acid can be from a Human mastadenovirus D, for example, as set forth in SEQ ID NO: 1422. In some embodiments, the target nucleic acid can be from a Human mastadenovirus D, for example, as set forth in SEQ ID NO: 1423. In some embodiments, the target nucleic acid can be from a Human adenovirus 81, for example, as set forth in SEQ ID NO: 1424. In some embodiments, the target nucleic acid can be from a Human mastadenovirus B, for example, as set forth in SEQ ID NO: 1425. In some embodiments, the target nucleic acid can be from a Human mastadenovirus B, for example, as set forth in SEQ ID NO: 1426. In some embodiments, the target nucleic acid can be from a Human mastadenovirus B, for example, as set forth in SEQ ID NO: 1427. In some embodiments, the target nucleic acid can be from a Human mastadenovirus B, for example, as set forth in SEQ ID NO: 1428. In some embodiments, the target nucleic acid can be from a Human mastadenovirus D, for example, as set forth in SEQ ID NO: 1429. In some embodiments, the target nucleic acid can be from a Human mastadenovirus D, for example, as set forth in SEQ ID NO: 1430. In some embodiments, the target nucleic acid can be from a Human mastadenovirus D, for example, as set forth in SEQ ID NO: 1431. In some embodiments, the target nucleic acid can be from a Human mastadenovirus D, for example, as set forth in SEQ ID NO: 1432, Human adenovirus 71, for example, as set forth in SEQ ID NO: 1433. In some embodiments, the target nucleic acid can be from a Human mastadenovirus D, for example, as set forth in SEQ ID NO: 1434. In some embodiments, the target nucleic acid can be from a Human adenovirus 69, for example, as set forth in SEQ ID NO: 1435. In some embodiments, the target nucleic acid can be from a Human adenovirus 68, for example, as set forth in SEQ ID NO: 1436. In some embodiments, the target nucleic acid can be from a Human adenovirus 67, for example, as set forth in SEQ ID NO: 1437. In some embodiments, the target nucleic acid can be from a Human adenovirus 66, for example, as set forth in SEQ ID NO: 1438. In some embodiments, the target nucleic acid can be from a Human adenovirus 65, for example, as set forth in SEQ ID NO: 1439. In some embodiments, the target nucleic acid can be from a Human adenovirus 64, for example, as set forth in SEQ ID NO: 1440. In some embodiments, the target nucleic acid can be from a Human adenovirus 63, for example, as set forth in SEQ ID NO: 1441. In some embodiments, the target nucleic acid can be from a Human adenovirus 62, for example, as set forth in SEQ ID NO: 1442. In some embodiments, the target nucleic acid can be from a Human adenovirus 61, for example, as set forth in SEQ ID NO: 1443. In some embodiments, the target nucleic acid can be from a Human mastadenovirus D, for example, as set forth in SEQ ID NO: 1444. In some embodiments, the target nucleic acid can be from a Human mastadenovirus D, for example, as set forth in SEQ ID NO: 1445. In some embodiments, the target nucleic acid can be from a Human adenovirus 58, for example, as set forth in SEQ ID NO: 1446. In some embodiments, the target nucleic acid can be from a Human mastadenovirus C, for example, as set forth in SEQ ID NO: 1447. In some embodiments, the target nucleic acid can be from a Human adenovirus 56, for example, as set forth in SEQ ID NO: 1448. In some embodiments, the target nucleic acid can be from a Human adenovirus 55, for example, as set forth in SEQ ID NO: 1449. In some embodiments, the target nucleic acid can be from a Human adenovirus 54, for example, as set forth in SEQ ID NO: 1450. In some embodiments, the target nucleic acid can be from a Human mastadenovirus D, for example, as set forth in SEQ ID NO: 1451.

In some embodiments, the target nucleic acid can be from a gamma retrovirus, as set forth in the following examples. In some embodiments, the target nucleic acid can be from a Friend murine leukemia virus, for example, as set forth in SEQ ID NO: 1452. In some embodiments, the target nucleic acid can be from a Moloney murine leukemia virus, for example, as set forth in SEQ ID NO: 1453. In some embodiments, the target nucleic acid can be from a Murine type C retrovirus, for example, as set forth in SEQ ID NO: 1453.

In some embodiments, the target nucleic acid can be from a foamy virus, as set forth in the following examples. In some embodiments, the target nucleic acid can be from an Eastern chimpanzee simian foamy virus, for example, as set forth in SEQ ID NO: 1456. In some embodiments, the target nucleic acid can be from Macaque simian foamy virus, for example, as set forth in SEQ ID No: 1456 In some embodiments, the target nucleic acid can be from Feline foamy virus, for example, as set forth in SEQ ID NO: 1457.

In some embodiments, the target nucleic acid can be from a papillomavirus, as set forth in the following examples. In some embodiments, the target nucleic acid can be from Human papillomavirus 116, for example, as set forth in SEQ ID NO: 1458.

In some embodiments, the nucleic acid sequence comprises at least a fragment at least 60%, at least 65%, at least 70%, at least 75%, at least 80%, at least 85%, at least 90%, at least 92%, at least 95%, at least 97%, at least 99%, or at least 100% sequence identity to any one of SEQ ID NO: 1405-SEQ ID NO: 1458.

TABLE 7 shows nucleic acid sequences of a various vectors, of which probes of the present disclosure can recognize in transfected cells.

TABLE 7

Nucleic Acid Sequences of Vectors

| SEQ ID NO | Sequence |
|---|---|
| SEQ ID NO: 1405 | GTACAAGTAAAGCGGCCGCGTCGACAATCAACCTCTGGATTACAAAATTTGTGA<br>AAGATTGACTGGTATTCTTAACTATGTTGCTCCTTTTACGCTATGTGGATACGCT<br>GCTTTAATGCCTTTGTATCATGCTATTGCTTCCCGTATGGCTTTCATTTTCTCCTCC<br>TTGTATAAATCCTGGTTGCTGTCTCTTTATGAGGAGTTGTGGCCCGTTGTCAGGC<br>AACGTGGCGTGGTGTGCACTGTGTTTGCTGACGCAACCCCCACTGGTTGGGGCAT<br>TGCCACCACCTGTCAGCTCCTTTCCGGGACTTTCGCTTTCCCCCTCCCTATTGCCA<br>CGGCGGAACTCATCGCCGCCTGCCTTGCCCGCTGCTGGACAGGGGCTCGGCTGTT<br>GGGCACTGACAATTCCGTGGTGTTGTCGGGGAAGCTGACGTCCTTTCCATGGCTG<br>CTCGCCTGTGTTGCCACCTGGATTCTGCGCGGGACGTCCTTCTGCTACGTCCCTTC<br>GGCCCTCAATCCAGCGGACCTTCCTTCCCGCGGCCTGCTGCCGGCTCTGCGGCCT<br>CTTCCGCGTCTTCGCCTTCGCCCTCAGACGAGTCGGATCTCCCTTTGGGCCGCCT<br>CCCCGCCTGGAATTCATGGTATATGTGTATATATATATATATATATATTCAGGAAAT<br>AATATATTCTAGAATATGTCACATTCTGTCTCAGGCATCCATTTTCTTTATGATGC<br>CGTTTGAGGTGGAGTTTTAGTCAGGTGGTCAGCTTCCTTTTTTTTTGCCATCTGC<br>CCTGTAAGCATCCTGCTGGGGACCCAGATAGGAGTCATCACTCTAGGCTGAGAA<br>CATCTGGGCACACACCCTAAGCCTCAGCATGACTCATCATGACTCAGCATTGCTG<br>TGCTTGAGCCAGAAGGTTTGCTTAGAAGGTTACACAGAACCAGAAGGCGGGGGT<br>GGGGCACTGACCCCGACAGGGGCCTGGCCAGAACTGCTCATGCTTGGACTATGG<br>GAGGTCACTAATGGAGACACACAGAAATGTAACAGGAACTAAGGAAAAACTGA |

TABLE 7-continued

Nucleic Acid Sequences of Vectors

| SEQ ID NO | Sequence |
|---|---|
| | AGCTTATTTAATCAGAGATGAGATGCTGGAAGGGATAGAGGGAGCTGAGCTTGT |
| | AAAAAGTATAGTAATCATTCAGCAAATGGTTTTGAAGCACCTGCTGGATGCTAA |
| | ACACTATTTTCAGTGCTTGAATCATAAATAAGAATAAAACATGTATCTTATTCCC |
| | CACAAGAGTCCAAGTAAAAAATAACAGTTAATTATAATGTGCTCTGTCCCCCAG |
| | GCTGGAGTGCAGTGGCACGATCTCAGCTCACTGCAACCTCCGCCTCCCGGGTTCA |
| | AGCAATTCTCCTGCCTCAGCCACCCTAATAGCTGGGATTACAGGTGCACACCACC |
| | ATGCCAGGCTAATTTTTGTACTTTTTGTAGAGGCAGGGTATCACCATGTTGTCCA |
| | AGATGGTCTTGAACTCCTGAGCTCCAAGCAGTCCACCCACCTCAGCCTCCCAAA |
| | GTGCTATCTCTTTAAGACCAATGACTTACAAGGCAGCTGTAGATCTTAGCCACTT |
| | TTTTAAAAGAAAAGGGGGGACTGGAAGGGCTAATTCACTCCCAACGAAGACAAG |
| | ATCTACGTCTGAATGGTGGCCGTAGTTTGCAGAGCCCTGGTTTCTTCTTGCCTCTC |
| | AGCTTCCAACTTCCCCGTGAGTGCCTGCTCCTTGATGGACTGGACTCTAAGCCCT |
| | TCTTTGCAGCAAGCACGATATCAAGCTTTGTCAGTAGAGGGCGCCGGAGGGACA |
| | CTGTGGAGGAAGGGGCCTTTTCATGGTCCACAGAGCTCTGTTGTGCAATTTCTTG |
| | TTCCTGTTGCATCTTCTCTTAGGGTATGAACGCGGGGGGACATCCTCTGGGGCTT |
| | TTCCTCAGCTGTGCACCCAGAATGCATGGTCCCTCGACCACCTCATAGCCCATCC |
| | TGTATGCTTTTTGCTTGTACTGGGTCTCTCTGGTTAGACCAGATCTGAGCCTGGG |
| | AGCTCTCTGGCTAACTAGGGAACCCACTGCTTAAGCCTCAATAAAGCTTGCCTTG |
| | AGTGCTTCAAGTAGTGTGTGCCCGTCTGTTGTGTGACTCTGGTAACTAGAGATCC |
| | CTCAGACCCTTTTAGTCAGTGTGGAAAATCTCTAGCAGTAGTAGTTCATGTCATC |
| | TTATTATTCAGTATTTATAACTTGCAAAGAAATGAATATCAGAGAGTGAGAGGA |
| | ACTTGTTTATTGCAGCTTATAATGGTTACAAATAAAGCAATAGCATCACAAATTT |
| | CACAAATAAAGCATTTTTTTCACTGCATTCTAGTTGTGGTTTGTCCAAACTCATC |
| | AATGTATCTTATCATGTCTGGCTCTAGCTATCCCGCCCCTAACTCCGCCCAGTTCC |
| | GCCCATTCTCCGCCCCATGGCTGACTAATTTTTTTTATTTATGCAGAGGCCGAGG |
| | CCGCCTCGGCCTCTGAGCTATTCCAGAAGTAGTGAGGAGGCTTTTTTGGAGGCCT |
| | AGGCTTTTGCGTCGAGACGTACCCAATTCGCCCTATAGTGAGTCGTATTACGCGC |
| | GCTCACTGGCCGTCGTTTTACAACGTCGTGACTGGGAAAACCCTGGCGTTACCCA |
| | ACTTAATCGCCTTGCAGCACATCCCCCTTTCGCCAGCTGGCGTAATAGCGAAGAG |
| | GCCCGCACCGATCGCCCTTCCCAACAGTTGCGCAGCCTGAATGGCGAATGGCGC |
| | GACGCGCCCTGTAGCGGCGCATTAAGCGCGGCGGGTGTGGTGGTTACGCGCAGC |
| | GTGACCGCTACACTTGCCAGCGCCCTAGCGCCCGCTCCTTTCGCTTTCTTCCCTTC |
| | CTTTCTCGCCACGTTCGCCGGCTTTCCCCGTCAAGCTCTAAATCGGGGGCTCCCT |
| | TTAGGGTTCCGATTTAGTGCTTTACGGCACCTCGACCCCAAAAAACTTGATTAGG |
| | GTGATGGTTCACGTAGTGGGCCATCGCCCTGATAGACGGTTTTTCGCCCTTTGAC |
| | GTTGGAGTCCACGTTCTTTAATAGTGGACTCTTGTTCCAAACTGGAACAACACTC |
| | AACCCTATCTCGGTCTATTCTTTTGATTTATAAGGGATTTTGCCGATTTCGGCCTA |
| | TTGGTTAAAAAATGAGCTGATTTAACAAAAATTTAACGCGAATTTTAACAAAAT |
| | ATTAACGTTTACAATTTCCCAGGTGGCACTTTTCGGGGAAATGTGCGCGGAACCC |
| | CTATTTGTTTATTTTTCTAAATACATTCAAATATGTATCCGCTCATGAGACAATAA |
| | CCCTGATAAATGCTTCAATAATATTGAAAAAGGAAGAGTATGAGTATTCAACAT |
| | TTCCGTGTCGCCCTTATTCCCTTTTTTGCGGCATTTTGCCTTCCTGTTTTTGCTCAC |
| | CCAGAAACGCTGGTGAAAGTAAAAGATGCTGAAGATCAGTTGGGTGCACGAGT |
| | GGGTTACATCGAACTGGATCTCAACAGCGGTAAGATCCTTGAGAGTTTTCGCCCC |
| | GAAGAACGTTTTCCAATGATGAGCACTTTTAAAGTTCTGCTATGTGGCGCGGTAT |
| | TATCCCGTATTGACGCCGGGCAAGAGCAACTCGGTCGCCGCATACACTATTCTCA |
| | GAATGACTTGGTTGAGTACTCACCAGTCACAGAAAAGCATCTTACGGATGGCAT |
| | GACAGTAAGAGAATTATGCAGTGCTGCCATAACCATGAGTGATAACACTGCGGC |
| | CAACTTACTTCTGACAACGATCGGAGGACCGAAGGAGCTAACCGCTTTTTTGCA |
| | CAACATGGGGGATCATGTAACTCGCCTTGATCGTTGGGAACCGGAGCTGAATGA |
| | AGCCATACCAAACGACGAGCGTGACACCACGATGCCTGTAGCAATGGCAACAAC |
| | GTTGCGCAAACTATTAACTGGCGAACTACTTACTCTAGCTTCCCGGCAACAATTA |
| | ATAGACTGGATGGAGGCGGATAAAGTTGCAGGACCACTTCTGCGCTCGGCCCTT |
| | CCGGCTGGCTGGTTTATTGCTGATAAATCTGGAGCCGGTGAGCGTGGGTCTCGCG |
| | GTATCATTGCAGCACTGGGGCCAGATGGTAAGCCCTCCCGTATCGTAGTTATCTA |
| | CACGACGGGGAGTCAGGCAACTATGGATGAACGAAATAGACAGATCGCTGAGA |
| | TAGGTGCCTCACTGATTAAGCATTGGTAACTGTCAGACCAAGTTTACTCATATAT |
| | ACTTTAGATTGATTTAAAACTTCATTTTTAATTTAAAAGGATCTAGGTGAAGATC |
| | CTTTTTGATAATCTCATGACCAAAATCCCTTAACGTGAGTTTTCGTTCCACTGAG |
| | CGTCAGACCCCGTAGAAAAGATCAAAGGATCTTCTTGAGATCCTTTTTTTCTGCG |
| | CGTAATCTGCTGCTTGCAAACAAAAAAACCACCGCTACCAGCGGTGGTTTGTTTG |
| | CCGGATCAAGAGCTACCAACTCTTTTTCCGAAGGTAACTGGCTTCAGCAGAGCG |
| | CAGATACCAAATACTGTCCTTCTAGTGTAGCCGTAGTTAGGCCACCACTTCAAGA |
| | ACTCTGTAGCACCGCCTACATACCTCGCTCTGCTAATCCTGTTACCAGTGGCTGC |
| | TGCCAGTGGCGATAAGTCGTGTCTTACCGGGTTGGACTCAAGACGATAGTTACC |
| | GGATAAGGCGCAGCGGTCGGGCTGAACGGGGGGTTCGTGCACACAGCCCAGCTT |
| | GGAGCGAACGACCTACACCGAACTGAGATACCTACAGCGTGAGCTATGAGAAA |
| | GCGCCACGCTTCCCGAAGGGAGAAAGGCGGACAGGTATCCGGTAAGCGGCAGG |
| | GTCGGAACAGGAGAGCGCACGAGGGAGCTTCCAGGGGGAAACGCCTGGTATCT |
| | TTATAGTCCTGTCGGGTTTCGCCACCTCTGACTTGAGCGTCGATTTTTGTGATGCT |
| | CGTCAGGGGGGCGGAGCCTATGGAAAAACGCCAGCAACGCGGCCTTTTTACGGT |
| | TCCTGGCCTTTTGCTGGCCTTTTGCTCACATGTTCTTTCCTGCGTTATCCCCTGATT |
| | CTGTGGATAACCGTATTACCGCCTTTGAGTGAGCTGATACCGCTCGCCGCAGCCG |
| | AACGACCGAGCGCAGCGAGTCAGTGAGCGAGGAAGCGGAAGAGCGCCCAATAC |
| | GCAAACCGCCTCTCCCCGCGCGTTGGCCGATTCATTAATGCAGCTGGCACGACA |
| | GGTTTCCCGACTGGAAAGCGGGCAGTGAGCGCAACGCAATTAATGTGAGTTAGC |

TABLE 7-continued

Nucleic Acid Sequences of Vectors

| SEQ ID NO | Sequence |
|---|---|
|  | TCACTCATTAGGCACCCCAGGCTTTACACTTTATGCTTCCGGCTCGTATGTTGTGT |
|  | GGAATTGTGAGCGGATAACAATTTCACACAGGAAACAGCTATGACCATGATTAC |
|  | GCCAAGCGCGCAATTAACCCTCACTAAAGGGAACAAAAGCTGGAGCTGCAAGCT |
|  | TAATGTAGTCTTATGCAATACTCTTGTAGTCTTGCAACATGGTAACGATGAGTTA |
|  | GCAACATGCCTTACAAGGAGAGAAAAAGCACCGTGCATGCCGATTGGTGGAAGT |
|  | AAGGTGGTACGATCGTGCCTTATTAGGAAGGCAACAGACGGGTCTGACATGGAT |
|  | TGGACGAACCACTGAATTGCCGCATTGCAGAGATATTGTATTTAAGTGCCTAGCT |
|  | CGATACAATAAACGGGTCTCTCTGGTTAGACCAGATCTGAGCCTGGGAGCTCTCT |
|  | GGCTAACTAGGGAACCCACTGCTTAAGCCTCAATAAAGCTTGCCTTGAGTGCTTC |
|  | AAGTAGTGTGTGCCCGTCTGTTGTGTGACTCTGGTAACTAGAGATCCCTCAGACC |
|  | CTTTTAGTCAGTGTGGAAAATCTCTAGCAGTGGCGCCCGAACAGGGACCTGAAA |
|  | GCGAAAGGGAAACCAGAGCTCTCTCGACGCAGGACTCGGCTTGCTGAAGCGCGC |
|  | ACGGCAAGAGGCGAGGGGCGGCGACTGGTGAGTACGCCAAAAATTTTGACTAG |
|  | CGGAGGCTAGAAGGAGAGAGATGGGTGCGAGAGCGTCAGTATTAAGCGGGGGA |
|  | GAATTAGATCGCGATGGGAAAAAATTCGGTTAAGGCCAGGGGGAAAGAAAAAA |
|  | TATAAATTAAAACATATAGTATGGGCAAGCAGGGAGCTAGAACGATTCGCAGTT |
|  | AATCCTGGCCTGTTAGAAACATCAGAAGGCTGTAGACAAATACTGGGACAGCTA |
|  | CAACCATCCCTTCAGACAGGATCAGAAGAACTTAGATCATTATATAATACAGTA |
|  | GCAACCCTCTATTGTGTGCATCAAAGGATAGAGATAAAAGACACCAAGGAAGCT |
|  | TTAGACAAGATAGAGGAAGAGCAAAACAAAAGTAAGACCACCGCACAGCAAGC |
|  | GGCCGCTGATCTTCAGACCTGGAGGAGGAGATATGAGGGACAATTGGAGAAGT |
|  | GAATTATATAAATATAAAGTAGTAAAAATTGAACCATTAGGAGTAGCACCCACC |
|  | AAGGCAAAGAGAAGAGTGGTGCAGAGAGAAAAAAGAGCAGTGGGAATAGGAG |
|  | CTTTGTTCCTTGGGTTCTTGGGAGCAGCAGGAAGCACTATGGGCGCAGCCTCAAT |
|  | GACGCTGACGGTACAGGCCAGACAATTATTGTCTGGTATAGTGCAGCAGCAGAA |
|  | CAATTTGCTGAGGGCTATTGAGGCGCAACAGCATCTGTTGCAACTCACAGTCTG |
|  | GGGCATCAAGCAGCTCCAGGCAAGAATCCTGGCTGTGGAAAGATACCTAAAGG |
|  | ATCAACAGCTCCTGGGGATTTGGGGTTGCTCTGGAAAACTCATTTGCACCACTGC |
|  | TGTGCCTTGGAATGCTAGTTGGAGTAATAAATCTCTGGAACAGATTTGGAATCAC |
|  | ACGACCTGGATGGAGTGGGACAGAGAAATTAACAATTACACAAGCTTAATACAC |
|  | TCCTTAATTGAAGAATCGCAAAACCAGCAAGAAAAGAATGAACAAGAATTATTG |
|  | GAATTAGATAAATGGGCAAGTTTGTGGAATTGGTTTAACATAACAAATTGGCTG |
|  | TGGTATATAAAATTATTCATAATGATAGTAGGAGGCTTGGTAGGTTTAAGAATA |
|  | GTTTTTGCTGTACTTTCTATAGTGAATAGAGTTAGGCAGGGATATTCACCATTAT |
|  | CGTTTCAGACCCACCTCCCAACCCCGAGGGGACCCGACAGGCCCGAAGGAATAG |
|  | AAGAAGAAGGTGGAGAGAGAGACAGAGACAGATCCATTCGATTAGTGAACGGA |
|  | TCTCGACGGTATCGGTTAACTTTTAAAAGAAAAGGGGGGATTGGGGGTACAGT |
|  | GCAGGGGAAAGAATAGTAGACATAATAGCAACAGACATACAAACTAAAGAATT |
|  | ACAAAAACAAATTACAAAAATTCAAAATTTTATCGATCACGAGACTAGCCTCGA |
|  | GCTGTGTGTGGAACTGCTGAAGGGTGCTTCCTTTTATTCTTCATCCCTAGCCAGC |
|  | CGCCGGCCCCTGGCCTCACTGGATACTCTAAGACTATTGGTCAAGTTTGCCTTGT |
|  | CAAGGCTATTGGTCAAGGCAAGGCTGGCCAACCCATGGGTGGAGTTTAGCCAGG |
|  | GACCGTTTCAGACAGATATTTGCATTGAGATAGTGTGGGGAAGGGGCCCCCAAG |
|  | AGGATACTGCTAATTTTTTTTATAGCCTTTGCCTTGTTCCGATTCAGTCATTCCAG |
|  | TTTTTCTCTAATTTATTCTTCCCTTTAGCTAGTTTCCTTCTCCCATCATAGAGGATA |
|  | CCAGGACTTCTTTTGTCAGCCGTTTTTTACCTTCTTGTCTCTAGCTCCAGTGAGGA |
|  | AGCGGATCCACCGGTCGCCACCATGGTGAGCAAGGGCGAGGAGCTGTTCACCGG |
|  | GGTGGTGCCCATCCTGGTCGAGCTGGACGGCGACGTAAACGGCCACAAGTTCAG |
|  | CGTGTCCGGCGAGGGCGAGGGCGATGCCACCTACGGCAAGCTGACCCTGAAGTT |
|  | CATCTGCACCACCGGCAAGCTGCCCGTGCCCTGGCCCACCCTCGTGACCACCCTG |
|  | ACCTACGGCGTGCAGTGCTTCAGCCGCTACCCCGACCACATGAAGCAGCACGAC |
|  | TTCTTCAAGTCCGCCATGCCCGAAGGCTACGTCCAGGAGCGCACCATCTTCTTCA |
|  | AGGACGACGGCAACTACAAGACCCGCGCCGAGGTGAAGTTCGAGGGCGACACC |
|  | CTGGTGAACCGCATCGAGCTGAAGGGCATCGACTTCAAGGAGGACGGCAACATC |
|  | CTGGGGCACAAGCTGGAGTACAACTACAACAGCCACAACGTCTATATCATGGCC |
|  | GACAAGCAGAAGAACGGCATCAAGGTGAACTTCAAGATCCGCCACAACATCGA |
|  | GGACGGCAGCGTGCAGCTCGCCGACCACTACCAGCAGAACACCCCCATCGGCGA |
|  | CGGCCCCGTGCTGCTGCCCGACAACCACTACCTGAGCACCCAGTCCGCCCTGAG |
|  | CAAAGACCCCAACGAGAAGCGCGATCACATGGTCCTGCTGGAGTTCGTGACCGC |
|  | CGCCGGGATCACTCTCGGCATGGACGAGCT |
| SEQ ID NO: 1406 | TTGCCCACTCCCTCTCTGCGCGCTCGCTCGCTCGGTGGGGCCTGCGGACCAAAGG |
|  | TCCGCAGACGGCAGAGCTCTGCTCTGCCGGCCCCACCGAGCGAGCGAGCGCGCA |
|  | GAGAGGGAGTGGGCAACTCCATCACTAGGGGTAATCGCGAAGCGCCTCCCACGC |
|  | TGCCGCGTCAGCGCTGACGTAAATTACGTCATAGGGGAGTGGTCCTGTATTAGCT |
|  | GTCACGTGAGTGCTTTTGCGACATTTTGCGACACCACGTGGCCATTTAGGGTATA |
|  | TATGGCGAGTGAGCGAGCAGGATCTCCATTTTGACCGCGAAATTTGAACGAGC |
|  | AGCAGCCATGCCGGGCTTCTACGAGATCGTGATCAAGGTGCCGAGCGACCTGGA |
|  | CGAGCACCTGCCGGGCATTTCTGACTCGTTTGTGAGCTGGGTGGCCGAGAAGGA |
|  | ATGGGAGCTGCCCCCGGATTCTGACATGGATCTGAATCTGATTGAGCAGGCACC |
|  | CCTGACCGTGGCCGAGAAGCTGCAGCGCGACTTCCTGGTCCAATGGCGCCGCGT |
|  | GAGTAAGGCCCCGGAGGCCCTCTTCTTTGTTCAGTTCGAGAAGGGCGAGTCCTA |
|  | CTTCCACCTCCATATTCTGGTGGAGACCACGGGGGTCAAATCCATGGTGCTGGGC |
|  | CGCTTCCTGAGTCAGATTAGGGACAAGCTGGTGCAGACCATCTACCGCGGGATC |
|  | GAGCCGACCCTGCCCAACTGGTTCGCGGTGACCAAGACGCGTAATGGCGCCGGA |
|  | GGGGGGAACAAGGTGGTGGACGAGTGCTACATCCCCAACTACCTCCTGCCCAAG |

TABLE 7-continued

Nucleic Acid Sequences of Vectors

| SEQ ID NO | Sequence |
|---|---|
| | ACTCAGCCCGAGCTGCAGTGGGCGTGGACTAACATGGAGGAGTATATAAGCGCC<br>TGTTTGAACCTGGCCGAGCGCAAACGGCTCGTGGCGCAGCACCTGACCCACGTC<br>AGCCAGACCCAGGAGCAGAACAAGGAGAATCTGAACCCCAATTCTGACGCGCCT<br>GTCATCCGGTCAAAAACCTCCGCGCGCTACATGGAGCTGGTCGGGTGGCTGGTG<br>GACCGGGGCATCACCTCCGAGAAGCAGTGGATCCAGGAGGACCAGGCCTCGTAC<br>ATCTCCTTCAACGCCGCTTCCAACTCGCGGTCCCAGATCAAGGCCGCTCTGGACA<br>ATGCCGGCAAGATCATGGCGCTGACCAAATCCGCGCCCGACTACCTGGTAGGCC<br>CCGCTCCGCCCGCGGACATTAAAACCAACCGCATCTACCGCATCCTGGAGCTGA<br>ACGGCTACGAACCTGCCTACGCCGGCTCCGTCTTTCTCGGCTGGGCCCAGAAAA<br>GGTTCGGGAAGCGCAACACCATCTGGCTGTTTGGGCCGGCCACCACGGGCAAGA<br>CCAACATCGCGGAAGCCATCGCCCACGCCGTGCCCTTCTACGGCTGCGTCAACT<br>GGACCAATGAGAACTTTCCCTTCAATGATTGCGTCGACAAGATGGTGATCTGGT<br>GGGAGGAGGGCAAGATGACGGCCAAGGTCGTGGAGTCCGCCAAGGCCATTCTC<br>GGCGGCAGCAAGGTGCGCGTGGACCAAAAGTGCAAGTCGTCCGCCCAGATCGA<br>CCCCACCCCCGTGATCGTCACCTCCAACACCAACATGTGCGCCGTGATTGACGG<br>GAACAGCACCACCTTCGAGCACCAGCAGCCGTTGCAGGACCGGATGTTCAAATT<br>TGAACTCACCCGCCGTCTGGAGCATGACTTTGGCAAGGTGACAAAGCAGGAAGT<br>CAAAGAGTTCTTCCGCTGGGCGCAGGATCACGTGACCGAGGTGGCGCATGAGTT<br>CTACGTCAGAAAGGGTGGAGCCAACAAAAGACCCGCCCCCGATGACGCGGATA<br>AAAGCGAGCCCAAGCGGGCCTGCCCCTCAGTCGCGGATCCATCGACGTCAGACG<br>CGGAAGGAGCTCCGGTGGACTTTGCCGACAGGTACCAAAACAAATGTTCTCGTC<br>ACGCGGGCATGCTTCAGATGCTGTTTCCCTGCAAGACATGCGAGAGAATGAATC<br>AGAATTTCAACATTTGCTTCACGCACGGGACGAGAGACTGTTCAGAGTGCTTCCC<br>CGGCGTGTCAGAATCTCAACCGGTCGTCAGAAAGAGGACGTATCGGAAACTCTG<br>TGCCATTCATCATCTGCTGGGGCGGGCTCCCGAGATTGCTTGCTCGGCCTGCGAT<br>CTGGTCAACGTGGACCTGGATGACTGTGTTTCTGAGCAATAAATGACTTAAACC<br>AGGTATGGCTGCCGATGGTTATCTTCCAGATTGGCTCGAGGACAACCTCTCTGAG<br>GGCATTCGCGAGTGGTGGGACTTGAAACCTGGAGCCCCGAAGCCCAAAGCCAAC<br>CAGCAAAAGCAGGACGACGGCCGGGGTCTGGTGCTTCCTGGCTACAAGTACCTC<br>GGACCCTTCAACGGACTCGACAAGGGGGAGCCCGTCAACGCGGCGGACGCAGC<br>GGCCCTCGAGCACGACAAGGCCTACGACCAGCAGCTCAAAGCGGGTGACAATCC<br>GTACCTGCGGTATAACCACGCCGACGCCGAGTTTCAGGAGCGTCTGCAAGAAGA<br>TACGTCTTTTGGGGGCAACCTCGGGCGAGCAGTCTTCCAGGCCAAGAAGCGGGT<br>TCTCGAACCTCTCCGGTCTGGTTGAGGAAGGCGCTAAGACGGCTCCTGGAAAGAA<br>ACGTCCGGTAGAGCAGTCGCCACAAGAGCCAGACTCCTCCTCGGGCATCGGCAA<br>GACAGGCCAGCAGCCCGCTAAAAAGAGACTCAATTTTGGTCAGACTGGCGACTC<br>AGAGTCAGTCCCCGATCCACAACCTCTCGGAGAACCTCCAGCAACCCCCGCTGC<br>TGTGGGACCTACTACAATGGCTTCAGGCGGTGGCGCACCAATGGCAGACAATAA<br>CGAAGGCGCCGACGGAGTGGGTAATGCCTCAGGAAATTGGCATTGCGATTCCAC<br>ATGGCTGGGCGACAGAGTCATCACCACCAGCACCCGCACCTGGGCCTTGCCCAC<br>CTACAATAACCACCTCTACAAGCAAATCTCCAGTGCTTCAACGGGGCCAGCAA<br>CGACAACCACTACTTCGGCTACAGCACCCCCTGGGGTATTTTGATTTCAACAGA<br>TTCCACTGCCACTTTTCACCACGTGACTGGCAGCGACTCATCAACAACAATTGGG<br>GATTCCGGCCCAAGAGACTCAACTTCAAACTCTTCAACATCCAAGTCAAGGAGG<br>TCACGACGAATGATGGCGTCACAACCATCGCTAATAACCTTACCAGCACGGTTC<br>AAGTCTTCTCGGACTCGGAGTACCAGCTTCCGTACGTCCTCGGCTCTGCGCACCA<br>GGGCTGCCTCCCTCCGTTCCCGGCGGACGTGTTCATGATTCCGCAATACGGCTAC<br>CTGACGCTCAACAATGGCAGCCAAGCCGTGGGACGTTCATCCTTTTACTGCCTGG<br>AATATTTCCCTTCTCAGATGCTGAGAACGGGCAACAACTTTACCTTCAGCTACAC<br>CTTTGAGGAAGTGCCTTTCCACAGCAGCTACGCGCACAGCCAGAGCCTGGACCG<br>GCTGATGAATCCTCTCATCGACCAATACCTGTATTACCTGAACAGAACTCAAAAT<br>CAGTCCGGAAGTGCCCAAAACAAGGACTTGCTGTTTAGCCGTGGGTCTCCAGCT<br>GGCATGTCTGTTCAGCCCAAAAACTGGCTACCTGGACCCTGTTATCGGCAGCAG<br>CGCGTTTCTAAAACAAAAACAGACAACAACAACAGCAATTTTACCTGGACTGGT<br>GCTTCAAAATATAACCTCAATGGGCGTGAATCCATCATCAACCCTGGCACTGCTA<br>TGGCCTCACACAAAGACGACGAAGACAAGTTCTTTCCCATGAGCGGTGTCATGA<br>TTTTTGGAAAAGAGAGCGCCGGAGCTTCAAACACTGCATTGGACAATGTCATGA<br>TTACAGACGAAGAGGAAATTAAAGCCACTAACCCTGTGGCCACCGAAAGATTTG<br>GGACCGTGGCAGTCAATTTCCAGAGCAGCAGCACAGACCCTGCGACCGGAGATG<br>TGCATGCTATGGGAGCATTACCTGGCATGGTGTGGCAAGATAGAGACGTGTACC<br>TGCAGGGTCCCATTTGGGCCAAAATTCCTCACACAGATGGACACTTTCACCCGTC<br>TCCTCTTATGGGCGGCTTTGGACTCAAGAACCCGCCTCCTCAGATCCTCATCAAA<br>AACACGCCTGTTCCTGCGAATCCTCCGGCGGAGTTTTCAGCTACAAAGTTTGCTT<br>CATTCATCACCCAATACTCCACAGGACAAGTGAGTGTGGAAATTGAATGGGAGC<br>TGCAGAAAGAAAACAGCAAGCGCTGGAATCCCGAAGTGCAGTACACATCCAATT<br>ATGCAAAATCTGCCAACGTTGATTTTACTGTGGACAACAATGGACTTTATACTGA<br>GCCTCGCCCATTGGCACCCGTTACCTTACCCGTCCCCTGTAATTACGTGTTAAT<br>CAATAAACCGGTTGATTCGTTTCAGTTGAACTTTGGTCTCCTGTCCTTCTTATCTT<br>ATCGGTTACCATGGTTATAGCTTACACATTAACTGCTTGGTTGCGCTTCGCGATA<br>AAAGACTTACGTCATCGGGTTACCCCTAGTGATGGAGTTGCCCACTCCCTCTCTG<br>CGCGCTCGCTCGCTCGGTGGGGCCTGCGGACCAAAGGTCCGCAGACGGCAGAGC<br>TCTGCTCTGCCGGCCCCACCGAGCGAGCGAGCGCGCAGAGAGGGAGTGGGCAA |
| SEQ ID<br>NO: 1407 | TTGGCCACTCCCTCTATGCGCACTCGCTCGCTCGGTGGGGCCTGGCGACCAAAGG<br>TCGCCAGACGGACGTGCTTTGCACGTCCGGCCCCACCGAGCGAGCGAGTGCGCA<br>TAGAGGGAGTGGCCAACTCCATCACTAGAGGGTATGGCAGTGACGTAACGCGAAG |

TABLE 7-continued

Nucleic Acid Sequences of Vectors

SEQ ID NO Sequence

```
CGCGCGAAGCGAGACCACGCCTACCAGCTGCGTCAGCAGTCAGGTGACCCTTTT
GCGACAGTTTGCGACACCACGTGGCCGCTGAGGGTATATATTCTCGAGTGAGCG
AACCAGGAGCTCCATTTTGACCGCGAAATTTGAACGAGCAGCAGCCATGCCGGG
GTTCTACGAGATTGTCCTGAAGGTCCCGAGTGACCTGGACGAGCGCCTGCCGGG
CATTTCTAACTCGTTTGTTAACTGGGTGGCCGAGAAGGAATGGGACGTGCCGCC
GGATTCTGACATGGATCCGAATCTGATTGAGCAGGCACCCCTGACCGTGGCCGA
AAAGCTTCAGCGCGAGTTCCTGGTGGAGTGGCGCCGCGTGAGTAAGGCCCCGGA
GGCCCTCTTTTTTGTCCAGTTCGAAAAGGGGGAGACCTACTTCCACCTGCACGTG
CTGATTGAGACCATCGGGGTCAAATCCATGGTGGTCGGCCGCTACGTGAGCCAG
ATTAAAGAGAAGCTGGTGACCCGCATCTACCGCGGGGTCGAGCCGCAGCTTCCG
AACTGGTTCGCGGTGACCAAAACGCGAAATGGCGCCGGGGGCGGGAACAAGGT
GGTGGACGACTGCTACATCCCCAACTACCTGCTCCCCAAGACCCAGCCCGAGCT
CCAGTGGGCGTGGACTAACATGGACCAGTATTTAAGCGCCTGTTTGAATCTCGC
GGAGCGTAAACGGCTGGTGGCGCAGCATCTGACGCACGTGTCGCAGACGCAGG
AGCAGAACAAAGAGAATCAGAACCCCAATTCTGACGCGCCGGTCATCAGGTCAA
AAACCTCAGCCAGGTACATGGAGCTGGTCGGGTGGCTGGTGGACCGCGGGATCA
CGTCAGAAAAGCAATGGATTCAGGAGGACCAGGCCTCGTACATCTCCTTCAACG
CCGCCTCCAACTCGCGGTCCCAGATCAAGGCCGCGCTGGACAATGCCTCCAAGA
TCATGAGCCTGACAAAGACGGCTCCGGACTACCTGGTGGGCAGCAACCCGCCGG
AGGACATTACCAAAAATCGGATCTACCAAATCCTGGAGCTGAACGGGTACGATC
CGCAGTACGCGGCCTCCGTCTTCCTGGGCTGGGCGCAAAAGAAGTTCGGGAAGA
GGAACACCATCTGGCTCTTTGGGCCGGCCACGACGGGTAAAACCAACATCGCGG
AAGCCATCGCCCACGCCGTGCCCTTCTACGGCTGCGTAAACTGGACCAATGAGA
ACTTTCCCTTCAACGATTGCGTCGACAAGATGGTGATCTGGTGGGAGGAGGGCA
AGATGACGGCCAAGGTCGTGGAGAGCGCCAAGGCCATTCTGGGCGGAAGCAAG
GTGCGCGTGGACCAAAAGTGCAAGTCATCGGCCCAGATCGAACCCACTCCCGTG
ATCGTCACCTCCAACACCAACATGTGCGCCGTGATTGACGGGAACAGCACCACC
TTCGAGCATCAGCAGCCGCTGCAGGACCGGATGTTTGAATTTGAACTTACCCGCC
GTTTGGACCATGACTTTGGGAAGGTCACCAAACAGGAAGTAAAGGACTTTTTCC
GGTGGGCTTCCGATCACGTGACTGACGTGGCTCATGAGTTCTACGTCAGAAAGG
GTGGAGCTAAGAAACGCCCCGCCTCCAATGACGCGGATGTAAGCGAGCCAAAA
CGGGAGTGCACGTCACTTGCGCAGCCGACAACGTCAGACGCGGAAGCACCGGC
GGACTACGCGGACAGGTACCAAAACAAATGTTCTCGTCACGTGGGCATGAATCT
GATGCTTTTTCCCTGTAAAACATGCGAGAGAATGAATCAAATTTCCAATGTCTGT
TTTACGCATGGTCAAAGAGACTGTGGGGAATGCTTCCCTGGAATGTCAGAATCT
CAACCCGTTTCTGTCGTCAAAAAGAAGACTTATCAGAAACTGTGTCCAATTCATC
ATATCCTGGGAAGGGCACCCGAGATTGCCTGTTCGGCCTGCGATTTGGCCAATGT
GGACTTGGATGACTGTGTTTCTGAGCAATAAATGACTTAAACCAGGTATGGCTG
CTGACGGTTATCTTCCAGATTGGCTCGAGGACAACCTTTCTGAAGGCATTCGTGA
GTGGTGGGCTCTGAAACCTGGAGTCCCTCAACCCAAAGCGAACCAACAACACCA
GGACAACCGTCGGGGTCTTGTGCTTCCGGGTTACAAATACCTCGGACCCGGTAA
CGGACTCGACAAAGGAGAGCCGGTCAACGAGGCGGACGCGGCCAGCCCTCGAAC
ACGACAAAGCTTACGACCAGCAGCTCAAGGCCGGTGACAACCCGTACCTCAAGT
ACAACCACGCCGACGCCGAGTTTCAGGAGCGTCTTCAAGAAGATACGTCTTTTG
GGGGCAACCTTGGCAGAGCAGTCTTCCAGGCCAAAAAGAGGATCCTTGAGCCTC
TTGGTCTGGTTGAGGAAGCAGCTAAAACGGCTCCTGGAAAGAAGGGGGCTGTAG
ATCAGTCTCCTCAGGAACCGGACTCATCATCTGGTGTTGGCAAATCGGGCAAAC
AGCCTGCCAGAAAAGACTAAATTTCGGTCAGACTGGAGACTCAGAGTCAGTCC
CAGACCCTCAACCTCTCGGAGAACCACCAGCAGCCCCACAAGTTTGGGATCTA
ATACAATGGCTTCAGGCGGTGGCGCACCAATGGCAGACAATAACGAGGGTGCCG
ATGGAGTGGGTAATTCCTCAGGAAATTGGCATTGCGATTCCCAATGGCTGGGCG
ACAGAGTCATCACCACCAGCACCAGAACCTGGGCCCTGCCCACTTACAACAACC
ATCTCTACAAGCAAATCTCCAGCCAATCAGGAGCTTCAAACGACAACCACTACT
TTGGCTACAGCACCCCTTGGGGGTATTTTGACTTTAACAGATTCCACTGCCACTT
CTCACCACGTGACTGGCAGCGACTCATTAACAACAACTGGGGATTCCGGCCCAA
GAAACTCAGCTTCAAGCTCTTCAACATCCAAGTTAGAGGGGTCACGCAGAACGA
TGGCACGACGACTATTGCCAATAACCTTACCAGCACGGTTCAAGTGTTTACGGA
CTCGGAGTATCAGCTCCCGTACGTGCTCGGGTCGGCGCACCAAGGCTGTCTCCCG
CCGTTTCCAGCGGACGTCTTCATGGTCCCTCAGTATGGATACCTCACCCTGAACA
ACGGAAGTCAAGCGGTGGGACGCTCATCCTTTTACTGCCTGGAGTACTTCCCTTC
GCAGATGCTAAGGACTGGAAATAACTTCCAATTCAGCTATACCTTCGAGGATGT
ACCTTTTCACAGCAGCTACGCTCACAGCCAGAGTTTGGATCGCTTGATGAATCCT
CTTATTGATCAGTATCTGTACTACCTGAACAGAACGCAAGGACAACCTCTGGA
ACAACCAACCAATCACGGCTGCTTTTTAGCCAGGCTGGGCCTCAGTCTATGTCTT
TGCAGGCCAGAAATTGGCTACCTGGGCCCTGCTACCGGCAACAGAGACTTTCAA
AGACTGCTAACGACAACAACAACAGTAACTTTCCTTGGACAGCGGCCAGCAAAT
ATCATCTCAATGGCCGCGACTCGCTGGTGAATCCAGGACCAGCTATGGCCAGTC
ACAAGGACGATGAAGAAAATTTTTCCCTATGCACGGCAATCTAATATTTGGCA
AAGAAGGGACAACGGCAAGTAACGCAGAATTAGATAATGTAATGATTACGGAT
GAAGAAGAGATTCGTACCACCAATCCTGTGGCAACAGAGCAGTATGGAACTGTG
GCAAATAACTTGCAGAGCTCAAATACAGCTCCCACGACTGGAACTGTCAATCAT
CAGGGGGCCTTACCTGGCATGGTGTGGCAAGATCGTGACGTGTACCTTCAAGGA
CCTATCTGGGCAAAGATTCCTCACACGGATGGACACTTTCATCCTTCTCCTCTGA
TGGGAGGCTTTGGACTGAAACATCCGCCTCCTCAAATCATGATCAAAAATACTC
CGGTACCGGCAAATCCTCCGACGACTTTCAGCCCGGCCAAGTTTGCTTCATTTAT
CACTCAGTACTCCACTGGACAGGTCAGCGTGGAAATTGAGTGGGAGCTACAGAA
```

TABLE 7-continued

Nucleic Acid Sequences of Vectors

| SEQ ID NO | Sequence |
|---|---|
| | AGAAAACAGCAAACGTTGGAATCCAGAGATTCAGTACACTTCCAACTACAACAA
GTCTGTTAATGTGGACTTTACTGTAGACACTAATGGTGTTTATAGTGAACCTCGC
CCTATTGGAACCCGGTATCTCACACGAAACTTGTGAATCCTGGTTAATCAATAAA
CCGTTTAATTCGTTTCAGTTGAACTTTGGCTCTTGTGCACTTCTTTATCTTTATCTT
GTTTCCATGGCTACTGCGTAGATAAGCAGCGGCCTGCGGCGCTTGCGCTTCGCGG
TTTACAACTGCTGGTTAATATTTAACTCTCGCCATACCTCTAGTGATGGAGTTGG
CCACTCCCTCTATGCGCACTCGCTCGCTCGGTGGGGCCTGGCGACCAAAGGTCGC
CAGACGGACGTGCTTTGCACGTCCGGCCCCACCGAGCGAGCGAGTGCGCATAGA
GGGAGTGGCCAA |
| SEQ ID NO: 1408 | TTGGCCACTCCCTCTATGCGCACTCGCTCGCTCGGTGGGGCCTGGCGACCAAAGG
TCGCCAGACGGACGTGCTTTGCACGTCCGGCCCCACCGAGCGAGCGAGTGCGCA
TAGAGGGAGTGGCCAACTCCATCACTAGAGGTATGGCAGTGACGTAACGCGAAG
CGCGCGAAGCGAGACCACGCCTACCAGCTGCGTCAGCAGTCAGGTGACCCTTTT
GCGACAGTTTGCGACACCACGTGGCCGCTGAGGGTATATATTCTCGAGTGAGCG
AACCAGGAGCTCCATTTTGACCGCGAAATTTGAACGAGCAGCAGCCATGCCGGG
GTTCTACGAGATTGTCCTGAAGGTCCCGAGTGACCTGGACGAGCGCCTGCCGGG
CATTTCTAACTCGTTTGTTAACTGGGTGGCCGAGAAGGAATGGGACGTGCCGCC
GGATTCTGACATGGATCCGAATCTGATTGAGCAGGCACCCCTGACCGTGGCCGA
AAAGCTTCAGCGCGAGTTCCTGGTGGAGTGGCGCCGCGTGAGTAAGGCCCCGGA
GGCCCTCTTTTTTGTCCAGTTCGAAAAGGGGGAGACCTACTTCCACCTGCACGTG
CTGATTGAGACCATCGGGGTCAAATCCATGGTGGTCGGCCGCTACGTGAGCCAG
ATTAAAGAGAAGCTGGTGACCCGCATCTACCGCGGGGTCGAGCCGCAGCTTCCG
AACTGGTTCGCGGTGACCAAAACGCGAAATGGCGCCGGGGCGGGAACAAGGT
GGTGACGACTGCTACATCCCCAACTACCTGCTCCCCAAGACCCAGCCCGAGCT
CCAGTGGGCGTGGACTAACATGGACCAGTATTTAAGCGCCTGTTTGAATCTCGC
GGAGCGTAAACGGCTGGTGGCGCAGCATCTGACGCACGTGTCGCAGACGCAGG
AGCAGAACAAAGAGAATCAGAACCCCAATTCTGACGCGCCGGTCATCAGGTCAA
AAACCTCAGCCAGGTACATGGAGCTGGTCGGGTGGCTGGTGGACCGCGGGATCA
CGTCAGAAAAGCAATGGATTCAGGAGGACCAGGCCTCGTACATCTCCTTCAACG
CCGCCTCCAACTCGCGGTCCCAGATCAAGGCCGCGCTGGACAATGCCTCCAAGA
TCATGAGCCTGACAAAGACGGCTCCGGACTACCTGGTGGGCAGCAACCCGCCGG
AGGACATTACCAAAAATCGGATCTACCAAATCCTGGAGCTGAACGGGTACGATC
CGCAGTACGCGGCCTCCGTCTTCCTGGGCTGGGCGCAAAAGAAGTTCGGGAAGA
GGAACACCATCTGGCTCTTTGGGCCGGCCACGACGGGTAAAACCAACATCGCGG
AAGCCATCGCCCACGCCGTGCCCTTCTACGGCTGCGTAAACTGGACCAATGAGA
ACTTTCCCTTCAACGATTGCGTCGACAAGATGGTGATCTGGTGGGAGGAGGGCA
AGATGACGGCCAAGGTCGTGGAGAGCGCCAAGGCCATTCTGGGCGGAAGCAAG
GTGCGCGTGGACCAAAAGTGCAAGTCATCGGCCCAGATCGAACCCACTCCCGTG
ATCGTCACCTCCAACACCAACATGTGCGCCGTGATTGACGGGAACAGCACCACC
TTCGAGCATCAGCAGCCGCTGCAGGACCGGATGTTTGAATTTGAACTTACCCGCC
GTTTGGACCATGACTTTGGGAAGGTCACCAAACAGGAAGTAAAGGACTTTTTCC
GGTGGGCTTCCGATCACGTGACTGACGTGGCTCATGAGTTCTACGTCAGAAAGG
GTGGAGCTAAGAAACGCCCCGCCTCCAATGACGCGGATGTAAGCGAGCCAAAA
CGGGAGTGCACGTCACTTGCGCAGCCGACAACGTCAGACGCGGAAGCACCGGC
GGACTACGCGGACAGGTACCAAAACAAATGTTCTCGTCACGTGGGCATGAATCT
GATGCTTTTTCCCTGTAAAACATGCGAGAGAATGAATCAAATTTCCAATGTCTGT
TTTACGCATGGTCAAAGAGACTGTGGGGAATGCTTCCCTGGAATGTCAGAATCT
CAACCCGTTTCTGTCGTCAAAAAGAAGACTTATCAGAAACTGTGTCCAATTCATC
ATATCCTGGGAAGGGCACCCGAGATTGCCTGTTCGGCCTGCGATTTGGCCAATGT
GGACTTGGATGACTGTGTTTCTGAGCAATAAATGACTTAAACCAGGTATGGCTG
CTGACGGTTATCTTCCAGATTGGCTCGAGGACAACCTTTCTGAAGGCATTCGTGA
GTGGTGGGCTCTGAAACCTGGAGTCCCTCAACCCAAAGCGAACCAACAACACCA
GGACAACCGTCGGGGTCTTGTGCTTCCGGGTTACAAATACCTCGGACCCGGTAA
CGGACTCGACAAAGGAGAGCCGGTCAACGAGGCGGACGCGGCAGCCCTCGAAC
ACGACAAAGCTTACGACCAGCAGCTCAAGGCCGGTGACAACCCGTACCTCAAGT
ACAACCACGCCGACGCCGAGTTTCAGGAGCGTCTTCAAGAAGATACGTCTTTTG
GGGGCAACCTTGGCAGAGCAGTCTTCCAGGCCAAAAAGAGGATCCTTGAGCCTC
TTGGTCTGGTTGAGGAAGCAGCTAAAACGGCTCCTGGAAAGAAGGGGGCTGTAG
ATCAGTCTCCTCAGGAACCGGACTCATCATCTGGTGTTGGCAAATCGGGCAAAC
AGCCTGCCAGAAAAGACTAAATTTCGGTCAGACTGGAGACTCAGAGTCAGTCC
CAGACCCTCAACCTCTCGGAGAACCACCAGCAGCCCCACAAGTTTGGGATCTA
ATACAATGGCTTCAGGCGGTGGCGCACCAATGGCAGACAATAACGAGGGTGCCG
ATGGAGTGGGTAATTCCTCAGGAAATTGGCATTGCGATTCCCAATGGCTGGGCG
ACAGAGTCATCACCACCAGCACCAGAACCTGGGCCCTGCCCACTTACAACAACC
ATCTCTACAAGCAAATCTCCAGCCAATCAGGAGCTTCAAACGACAACCACTACT
TTGGCTACAGCACCCCTTGGGGGTATTTTGACTTTAACAGATTCCACTGCCACTT
CTCACCACGTGACTGGCAGCGACTCATTAACAACAACTGGGGATTCCGGCCCAA
GAAACTCAGCTTCAAGCTCTTCAACATCCAAGTTAGAGGGGTCACGCAGAACGA
TGGCACGACGACTATTGCCAATAACCTTACCAGCACGGTTCAAGTGTTTACGGA
CTCGGAGTATCAGCTCCCGTACGTGCTCGGGTCGGCGCACCAAGGCTGTCTCCCG
CCGTTTCCAGCGGACGTCTTCATGGTCCCTCAGTATGGATACCTCACCCTGAACA
ACGGAAGTCAAGCGGTGGGACGCTCATCCTTTTACTGCCTGGAGTACTTCCCTTC
GCAGATGCTAAGGACTGGAAATAACTTCCAATTCAGCTATACCTTCGAGGATGT
ACCTTTTCACAGCAGCTACGCTCACAGCCAGAGTTTGGATCGCTTGATGAATCCT
CTTATTGATCAGTATCTGTACTACCTGAACAGAACGCAAGGAACAACCTCTGGA |

TABLE 7-continued

Nucleic Acid Sequences of Vectors

| SEQ ID NO | Sequence |
|---|---|
| | ACAACCAACCAATCACGGCTGCTTTTTAGCCAGGCTGGGCCTCAGTCTATGTCTT<br>TGCAGGCCAGAAATTGGCTACCTGGGCCCTGCTACCGGCAACAGAGACTTTCAA<br>AGACTGCTAACGACAACAACAACAGTAACTTTCCTTGGACAGCGGCCAGCAAAT<br>ATCATCTCAATGGCCGCGACTCGCTGGTGAATCCAGGACCAGCTATGGCCAGTC<br>ACAAGGACGATGAAGAAAAATTTTTCCCTATGCACGGCAATCTAATATTTGGCA<br>AAGAAGGGACAACGGCAAGTAACGCAGAATTAGATAATGTAATGATTACGGAT<br>GAAGAAGAGATTCGTACCACCAATCCTGTGGCAACAGAGCAGTATGGAACTGTG<br>GCAAATAACTTGCAGAGCTCAAATACAGCTCCCACGACTGGAACTGTCAATCAT<br>CAGGGGGCCTTACCTGGCATGGTGTGGCAAGATCGTGACGTGTACCTTCAAGGA<br>CCTATCTGGGCAAAGATTCCTCACACGGATGGACACTTTCATCCTTCTCCTCTGA<br>TGGGAGGCTTTGGACTGAAACATCCGCCTCCTCAAATCATGATCAAAATACTC<br>CGGTACCGGCAAATCCTCCGACGACTTTCAGCCCGGCCAAGTTTGCTTCATTTAT<br>CACTCAGTACTCCACTGGACAGGTCAGCGTGGAAATTGAGTGGGAGCTACAGAA<br>AGAAAACAGCAAACGTTGGAATCCAGAGATTCAGTACACTTCCAACTACAACAA<br>GTCTGTTAATGTGGACTTTACTGTAGACACTAATGGTGTTTATAGTGAACCTCGC<br>CCTATTGGAACCCGGTATCTCACACGAAACTTGTGAATCCTGGTTAATCAATAAA<br>CCGTTTAATTCGTTTCAGTTGAACTTTGGCTCTTGTGCACTTCTTTATCTTTATCTT<br>GTTTCCATGGCTACTGCGTAGATAAGCAGCGGCCTGCGGCGCTTGCGCTTCGCGG<br>TTTACAACTGCTGGTTAATATTTAACTCTCGCCATACCTCTAGTGATGGAGTTGG<br>CCACTCCCTCTATGCGCACTCGCTCGTCGGTGGGGCCTGGCGACCAAAGGTCGC<br>CAGACGGACGTGCTTTGCACGTCCGGCCCCACCGAGCGAGCGAGTGCGCATAGA<br>GGGAGTGGCCAA |
| SEQ ID<br>NO: 1409 | TTGGCCACTCCCTCTATGCGCGCTCGCTCACTCACTCGGCCCTGGAGACCAAAGG<br>TCTCCAGACTGCCGGCCTCTGGCCGGCAGGGCCGAGTGAGTGAGCGAGCGCGCA<br>TAGAGGGAGTGGCCAACTCCATCATCTAGGTTTGCCCACTGACGTCAATGTGAC<br>GTCCTAGGGTTAGGGAGGTCCCTGTATTAGCAGTCACGTGAGTGTCGTATTTCGC<br>GGGAGCGTAGCGGAGCGCATACCAAGCTGCCACGTCACAGCCACGTGGTCCGTTT<br>GCGACAGTTTGCGACACCATGTGGTCAGGAGGGTATATAACCGCGAGTGAGCCA<br>GCGAGGAGCTCCATTTTGCCCGCGAATTTTGAACGAGCAGCAGCCATGCCGGGG<br>TTCTACGAGATCGTGCTGAAGGTGCCCAGCGACCTGGACGAGCACCTGCCCGGC<br>ATTTCTGACTCTTTTGTGAGCTGGGTGGCCGAGAAGGAATGGGAGCTGCCGCCG<br>GATTCTGACATGGACTTGAATCTGATTGAGCAGGCACCCCTGACCGTGGCCGAA<br>AAGCTGCAACGCGAGTTCCTGGTCGAGTGGCGCCGCGTGAGTAAGGCCCCGGAG<br>GCCCTCTTCTTTGTCCAGTTCGAGAAGGGGGACAGCTACTTCCACCTGCACATCC<br>TGGTGGAGACCGTGGGCGTCAAATCCATGGTGGTGGGCCGCTACGTGAGCCAGA<br>TTAAAGAGAAGCTGGTGACCCGCATCTACCGCGGGGTCGAGCCGCAGCTTCCGA<br>ACTGGTTCGCGGTGACCAAGACGCGTAATGGCGCCGGAGGCGGGAACAAGGTG<br>GTGGACGACTGCTACATCCCCAACTACCTGCTCCCCAAGACCCAGCCCGAGCTC<br>CAGTGGGCGTGGACTAACATGGACCAGTATATAAGCGCCTGTTTGAATCTCGCG<br>GAGCGTAAACGGCTGGTGGCGCAGCATCTGACGCACGTGTCGCAGACGCAGGA<br>GCAGAACAAGGAAAACCAGAACCCCAATTCTGACGCGCCGGTCATCAGGTCAA<br>AAACCTCCGCCAGGTACATGGAGCTGGTCGGGTGGCTGGTGGACCGCGGGATCA<br>CGTCAGAAAAGCAATGGATCCAGGAGGACCAGGCGTCCTACATCTCCTTCAACG<br>CCGCCTCCAACTCGCGGTCACAAATCAAGGCCGCGCTGGACAATGCCTCCAAAA<br>TCATGAGCCTGACAAAGACGGCTCCGGACTACCTGGTGGGCCAGAACCCGCCGG<br>AGGACATTTCCAGCAACCGCATCTACCGAATCCTCGAGATGAACGGGTACGATC<br>CGCAGTACGCGGCCTCCGTCTTCCTGGGCTGGGCGCAAAAGAAGTTCGGGAAGA<br>GGAACACCATCTGGCTCTTTGGGCCGGCCACGACGGGTAAAACCAACATCGCGG<br>AAGCCATCGCCCACGCCGTGCCCTTCTACGGCTGCGTGAACTGGACCAATGAGA<br>ACTTTCCGTTCAACGATTGCGTCGACAAGATGGTGATCTGGTGGGAGGAGGGCA<br>AGATGACGGCCAAGGTCGTAGAGAGCGCCAAGGCCATCCTGGGCGGAAGCAAG<br>GTGCGCGTGGACCAAAAGTGCAAGTCATCGGCCCAGATCGACCCAACTCCCGTG<br>ATCGTCACCTCCAACACCAACATGTGCGCGGTCATCGACGGAAACTCGACCACC<br>TTCGAGCACCAACAACCACTCCAGGACCGGATGTTCAAGTTCGAGCTCACCAAG<br>CGCCTGGAGCACGACTTTGGCAAGGTCACCAAGCAGGAAGTCAAAGACTTTTTC<br>CGGTGGGCGTCAGATCACGTGACCGAGGTGACTCACGAGTTTTACGTCAGAAAG<br>GGTGGAGCTAGAAAGAGGCCCGCCCCCAATGACGCAGATATAAGTGAGCCCAA<br>GCGGGCCTGTCCGTCAGTTGCGCAGCCATCGACGTCAGACGCGGAAGCTCCGGT<br>GGACTACGCGGACAGGTACCAAAACAAATGTTCTCGTCACGTGGGTATGAATCT<br>GATGCTTTTTCCCTGCCGGCAATGCGAGAGAATGAATCAGAATGTGGACATTTG<br>CTTCACGCACGGGTCATGGACTGTGCCGAGTGCTTCCCCGTGTCAGAATCTCAA<br>CCCGTGTCTGTCGTCAGAAAGCGGACGTATCAGAAACTGTGTCCGATTCATCAC<br>ATCATGGGGAGGGCGCCCGAGGTGGCCTGCTCGGCCTGCGAACTGGCCAATGTG<br>GACTTGGATGACTGTGACATGGAACAATAAATGACTCAAACCAGATATGACTGA<br>CGGTTACCTTCCAGATTGGCTAGAGGACAACCTCTCTGAAGGCGTTCAGAGTG<br>GTGGGCGCTGCAACCTGGAGCCCCTAAACCCAAGGCAAATCAACAACATCAGGA<br>CAACGCTCGGGGTCTTGTGCTTCCGGGTTACAAATACCTCGGACCCGGCAACGG<br>ACTCGACAAGGGGGAACCCGTCAACGCAGCGGACGCGGCAGCCCTCGAGCACG<br>ACAAGGCCTACGACCAGCAGCTCAAGGCCGGTGACAACCCCTACCTCAAGTACA<br>ACCACGCCGACGCGGAGTTCCAGCAGCGGCTTCAGGGCGACACATCGTTTGGG<br>GCAACCTCGGCAGAGCAGTCTTCCAGGCCAAAAAGAGGGTTCTTGAACCTCTTG<br>GTCTGGTTGAGCAAGCGGGTGAGACGGCTCCTGGAAAGAAGAGACCGTTGATTG<br>AATCCCCCCAGCAGCCCGACTCCTCCACGGGTATCGGCAAAAAGGCAAGCAGC<br>CGGCTAAAAAGAAGCTCGTTTTCGAAGACGAAACTGGAGCAGGCGACGGACCC<br>CCTGAGGGATCAACTTCCGGAGCCATGTCTGATGACAGTGAGATGCGTGCAGCA |

TABLE 7-continued

Nucleic Acid Sequences of Vectors

| SEQ ID NO | Sequence |
|---|---|
| | GCTGGCGGAGCTGCAGTCGAGGGCGGACAAGGTGCCGATGGAGTGGGTAATGC<br>CTCGGGTGATTGGCATTGCGATTCCACCTGGTCTGAGGGCCACGTCACGACCACC<br>AGCACCAGAACCTGGGTCTTGCCCACCTACAACAACCACCTCTACAAGCGACTC<br>GGAGAGAGCCTGCAGTCCAACACCTACAACGGATTCTCCACCCCCTGGGGATAC<br>TTTGACTTCAACCGCTTCCACTGCCACTTCTCACCACGTGACTGGCAGCGACTCA<br>TCAACAACAACTGGGGCATGCGACCCAAAGCCATGCGGGTCAAAATCTTCAACA<br>TCCAGGTCAAGGAGGTCACGACGTCGAACGGCGAGACAACGGTGGCTAATAAC<br>CTTACCAGCACGGTTCAGATCTTTGCGGACTCGTCGTACGAACTGCCGTACGTGA<br>TGGATGCGGGTCAAGAGGGCAGCCTGCCTCCTTTTCCCAACGACGTCTTTATGGT<br>GCCCCAGTACGGCTACTGTGGACTGGTGACCGGCAACACTTCGCAGCAACAGAC<br>TGACAGAAATGCCTTCTACTGCCTGGAGTACTTTCCTTCGCAGATGCTGCGGACT<br>GGCAACAACTTTGAAATTACGTACAGTTTTGAGAAGGTGCCTTTCCACTCGATGT<br>ACGCGCACAGCCAGAGCCTGGACCGGCTGATGAACCCTCTCATCGACCAGTACC<br>TGTGGGGACTGCAATCGACCACCACCGGAACCACCCTGAATGCCGGGACTGCCA<br>CCACCAACTTTACCAAGCTGCGGCCTACCAACTTTTCCAACTTTAAAAGAACTG<br>GCTGCCCGGGCCTTCAATCAAGCAGCAGGGCTTCTCAAAGACTGCCAATCAAAA<br>CTACAAGATCCCTGCCACCGGGTCAGACAGTCTCATCAAATACGAGACGCACAG<br>CACTCTGGACGAAGATGGAGTGCCCTGACCCCCGGACCTCCAATGGCCACGGC<br>TGGACCTGCGGACAGCAAGTTCAGCAACAGCCAGCTCATCTTTGCGGGGCCTAA<br>ACAGAACGGCAACACGGCCACCGTACCCGGGACTCTGATCTTCACCTCTGAGGA<br>GGAGCTGGCAGCCACCAACGCCACCGATACGGACATGTGGGGCAACCTACCTGG<br>CGGTGACCAGAGCAACAGCAACCTGCCGACCGTGGACAGACTGACAGCCTTGGG<br>AGCCGTGCCTGGAATGGTCTGGCAAAACAGAGACATTTACTACCAGGGTCCCAT<br>TTGGGCCAAGATTCCTCATACCGATGGACACTTTCACCCCTCACCGCTGATTGGT<br>GGGTTTGGGCTGAAACACCCGCCTCCTCAAATTTTTATCAAGAACACCCCGGTAC<br>CTGCGAATCCTGCAACGACCTTCAGCTCTACTCCGGTAAACTCCTTCATTACTCA<br>GTACAGCACTGGCCAGGTGTCGGTGCAGATTGACTGGGAGATCCAGAAGGAGCG<br>GTCCAAACGCTGGAACCCCGAGGTCCAGTTTACCTCCAACTACGGACAGCAAAA<br>CTCTCTGTTGTGGGCTCCCGATGCGGCTGGGAAATACACTGAGCCTAGGGCTATC<br>GGTACCCGCTACCTCACCCACCACCTGTAATAACCTGTTAATCAATAAACCGGTT<br>TATTCGTTTCAGTTGAACTTTGGTCTCCGTGTCCTTCTTATCTTATCTCGTTTCCAT<br>GGCTACTGCGTACATAAGCAGCGGCCTGCGGCGCTTGCGCTTCGCGGTTTACAA<br>CTGCCGGTTAATCAGTAACTTCTGGCAAACCAGATGATGGAGTTGGCCACATTA<br>GCTATGCGCGCTCGCTCACTCACTCGGCCCTGGAGACCAAAGGTCTCCAGACTG<br>CCGGCCTCTGGCCGGCAGGGCCGAGTGAGTGAGCGAGCGCGCATAGAGGGAGT<br>GGCCAA |
| SEQ ID<br>NO: 1410 | CTCTCCCCCCTGTCGCGTTCGCTCGCTCGCTGGCTCGTTTGGGGGGGTGGCAGCT<br>CAAAGAGCTGCCAGACGACGGCCCTCTGGCCGTCGCCCCCCAAACGAGCCAGC<br>GAGCGAGCGAACGCGACAGGGGGGAGAGTGCCACACTCTCAAGCAAGGGGGTT<br>TTGTAAGCAGTGATGTCATAATGATGTAATGCTTATTGTCACGCGATAGTTAATG<br>ATTAACAGTCATGTGATGTGTTTTATCCAATAGGAAGAAAGCGCGTATGAGT<br>TCTCGCGAGACTTCCGGGGTATAAAAGACCGAGTGAACGAGCCCGCCGCCATTC<br>TTTGCTCTGGACTGCTAGAGGACCCTGCTGCCATGGCTACCTTCTATGAAGTCA<br>TTGTTCGCGTCCCATTTGACGTGGAGGAACATCTGCCTGGAATTTCTGACAGCTT<br>TGTGGACTGGGTAACTGGTCAAATTTGGGAGCTGCCTCCAGAGTCAGATTTAAA<br>TTTGACTCTGGTTGAACAGCCTCAGTTGACGGTGGCTGATAGAATTCGCCGCGTG<br>TTCCTGTACGAGTGGAACAAATTTTCCAAGCAGGAGTCCAAATTCTTTGTGCAGT<br>TTGAAAAGGGATCTGAATATTTTCATCTGCACACGCTTGTGGAGACCTCCGGCAT<br>CTCTTCCATGGTCCTCGGCCGCTACGTGAGTCAGATTCGCGCCCAGCTGGTGAAA<br>GTGGTCTTCCAGGGAATTGAACCCCAGATCAACGACTGGGTCGCCATCACCAAG<br>GTAAAGAAGGGCGGAGCCAATAAGGTGGTGGATTCTGGGTATATTCCCGCCTAC<br>CTGCTGCCGAAGGTCCAACCGGAGCTTCAGTGGGCGTGGACAAACCTGGACGAG<br>TATAAATTGGCCGCCCTGAATCTGGAGGAGCGCAAACGGCTCGTCGCGCAGTTT<br>CTGGCAGAATCCTCGCAGCGCTCGCAGGAGGCGGCTTCGCAGCGTGAGTTCTCG<br>GCTGACCCGGTCATCAAAAGCAAGACTTCCCAGAAATACATGGCGCTCGTCAAC<br>TGGCTCGTGGAGCACGGCATCACTTCCGAGAAGCAGTGGATCCAGGAAAATCAG<br>GAGAGCTACCTCTCCTTCAACTCCACCGGCAACTCTCGGAGCCAGATCAAGGCC<br>GCGCTCGACAACGCGACCAAAATTATGAGTCTGACAAAAAGCGCGGTGGACTAC<br>CTCGTGGGGAGCTCCGTTCCCGAGGACATTTCAAAAAACAGAATCTGGCAAATT<br>TTTGAGATGAATGGCTACGACCCGGCCTACGCGGGATCCATCCTCTACGGCTGGT<br>GTCAGCGCTCCTTCAACAAGAGGAACACCGTCTGGCTCTACGGACCCGCCACGA<br>CCGGCAAGACCAACATCGCGGAGGCCATCGCCCACACTGTGCCCTTTTACGGCT<br>GCGTGAACTGGACCAATGAAAACTTTCCCTTTAATGACTGTGTGGACAAAATGC<br>TCATTTGGTGGAGGAGGGAAAGATGACCAACAAGGTGGTTGAATCGCCAAG<br>GCCATCCTGGGGGGCTCAAAGGTGCGGGTCGATCAGAAATGTAAATCCTCTGTT<br>CAAATTGATTCTACCCCTGTCATTGTAACTTCCAATACAAACATGTGTGTGGTGG<br>TGGATGGGAATTCCACGACCTTTGAACACCAGCAGCCGCTGGAGGACCGCATGT<br>TCAAATTTGAACTGACTAAGCGGCTCCCGCCAGATTTTGGCAAGATTACTAAGC<br>AGGAAGTCAAGGACTTTTTTGCTTGGGCAAAGGTCAATCAGGTGCCGGTGACTC<br>ACGAGTTTAAAGTTCCCAGGGAATTGGCGGGAACTAAAGGGGCGGAGAAATCTC<br>TAAAACGCCCACTGGGTGACGTCACCAATACTAGCTATAAAAGTCTGGAGAAGC<br>GGGCCAGGCTCTCATTTGTTCCCGAGACGCCTCGCAGTTCAGACGTGACTGTTGA<br>TCCCGCTCCTCTGCGACCGCTCAATTGGAATTCAAGGTATGATTGCAAATGTGAC<br>TATCATGCTCAATTTGACAACATTTCTAACAAATGTGATGAATGTGAATATTTGA<br>ATCGGGGCAAAAATGGATGTATCTGTCACAATGTAACTCACTGTCAAATTTGTCA |

TABLE 7-continued

Nucleic Acid Sequences of Vectors

| SEQ ID NO | Sequence |
|---|---|
| | TGGGATTCCCCCCTGGGAAAAGGAAAACTTGTCAGATTTTGGGGATTTTGACGA<br>TGCCAATAAAGAACAGTAAATAAAGCGAGTAGTCATGTCTTTTGTTGATCACCCT<br>CCAGATTGGTTGGAAGAAGTTGGTGAAGGTCTTCGCGAGTTTTTGGGCCTTGAA<br>GCGGGCCCACCGAAACCAAAACCCAATCAGCAGCATCAAGATCAAGCCCGTGGT<br>CTTGTGCTGCCTGGTTATAACTATCTCGGACCCGGAAACGGTCTCGATCGAGGAG<br>AGCCTGTCAACAGGGCAGACGAGGTCGCGCGAGAGCACGACATCTCGTACAAC<br>GAGCAGCTTGAGGCGGGAGACAACCCCTACCTCAAGTACAACCACGCGGACGCC<br>GAGTTTCAGGAGAAGCTCGCCGACGACACATCCTTCGGGGGAAACCTCGGAAAG<br>GCAGTCTTTCAGGCCAAGAAAAGGGTTCTCGAACCTTTTGGCCTGGTTGAAGAG<br>GGTGCTAAGACGGCCCCTACCGGAAAGCGGATAGACGACCACTTTCCAAAAAGA<br>AAGAAGGCTCGGACCGAAGAGGACTCCAAGCCTTCCACCTCGTCAGACGCCGAA<br>GCTGGACCCAGCGGATCCCAGCAGCTGCAAATCCCAGCCCAACCAGCCTCAAGT<br>TTGGGAGCTGATACAATGTCTGCGGGAGGTGGCGGCCCATTGGGCGACAATAAC<br>CAAGGTGCCGATGGAGTGGGCAATGCCTCGGGAGATTGGCATTGCGATTCCACG<br>TGGATGGGGACAGAGTCGTCACCAAGTCCACCCGAACCTGGGTGCTGCCCAGC<br>TACAACAACCACCAGTACCGAGAGATCAAAAGCGGCTCCGTCGACGGAAGCAA<br>CGCCAACGCCTACTTTGGATACAGCACCCCCTGGGGGTACTTTGACTTTAACCGC<br>TTCCACAGCCACTGGAGCCCCCGAGACTGGCAAAGACTCATCAACAACTACTGG<br>GGCTTCAGACCCCGGTCCCTCAGAGTCAAAATCTTCAACATTCAAGTCAAAGAG<br>GTCACGGTGCAGGACTCCACCACCACCATCGCCAACAACCTCACCTCCACCGTC<br>CAAGTGTTTACGGACGACGACTACCAGCTGCCCTACGTCGTCGGCAACGGGACC<br>GAGGGATGCCTGCCGGCCTTCCCTCCGCAGGTCTTTACGCTGCCGCAGTACGGTT<br>ACGCGACGCTGAACCGCGACAACACAGAAAATCCCACCGAGAGGAGCAGCTTC<br>TTCTGCCTAGAGTACTTTCCCAGCAAGATGCTGAGAACGGGCAACAACTTTGAG<br>TTTACCTACAACTTTGAGGAGGTGCCCTTCCACTCCAGCTTCGCTCCCAGTCAGA<br>ACCTGTTCAAGCTGGCCAACCCGCTGGTGGACCAGTACTTGTACCGCTTCGTGAG<br>CACAAATAACACTGGCGGAGTCCAGTTCAACAAGAACCTGGCCGGGAGATACGC<br>CAACACCTACAAAAACTGGTTCCCGGGGCCCATGGGCCGAACCCAGGGCTGGAA<br>CCTGGGCTCCGGGGTCAACCGCGCCAGTGTCAGCGCCTTCGCCACGACCAATAG<br>GATGGAGCTCGAGGGCGCGAGTTACCAGGTGCCCCCGCAGCCGAACGGCATGAC<br>CAACAACCTCCAGGGCAGCAACACCTATGCCCTGGAGAACACTATGATCTTCAA<br>CAGCCAGCCGGCGAACCCGGGCACCACCGCCACGTACCTCGAGGGCAACATGCT<br>CATCACCAGCGAGAGCGAGACGCAGCCGGTGAACCGCGTGGCGTACAACGTCG<br>GCGGGCAGATGGCCACCAACAACCAGAGCTCCACCACTGCCCCCGCGACCGGCA<br>CGTACAACCTCCAGGAAATCGTGCCCGGCAGCGTGTGGATGGAGAGGGACGTGT<br>ACCTCCAAGGACCCATCTGGGCCAAGATCCCAGAGACGGGGGCGCACTTTCACC<br>CCTCTCCGGCCATGGGCGGATTCGGACTCAAACACCCACCGCCCATGATGCTCAT<br>CAAGAACACGCCTGTGCCCGGAAATATCACCAGCTTCTCGGACGTGCCCGTCAG<br>CAGCTTCATCACCCAGTACAGCACCGGGCAGGTCACCGTGGAGATGGAGTGGGA<br>GCTCAAGAAGGAAAACTCCAAGAGGTGGAACCCAGAGATCCAGTACACAAACA<br>ACTACAACGACCCCCAGTTTGTGGACTTTGCCCCGGACAGCACCGGGGAATACA<br>GAACCACCAGACCTATCGGAACCCGATACCTTACCCGACCCCTTTAACCCATTCA<br>TGTCGCATACCCTCAATAAACCGTGTATTCGTGTCAGTAAAATACTGCCTCTTGT<br>GGTCATTCAATGAATAACAGCTTACAACATCTACAAAACCTCCTTGCTTGAGAGT<br>GTGGCACTCTCCCCCCTGTCGCGTTCGCTCGCTCGCTGGCTCGTTTGGGGGGTG<br>GCAGCTCAAAGAGCTGCCAGACGACGGCCCTCTGGCCGTCGCCCCCCCAAACGA<br>GCCAGCGAGCGAGCGAACGCGACAGGGGGGAGAG |
| SEQ ID<br>NO: 1411 | TTGGCCACTCCCTCTCTGCGCGCTCGCTCGCTCACTGAGGCCGGGCGACCAAAGG<br>TCGCCCGACGCCCGGGCTTTGCCCGGGCGGCCTCAGTGAGCGAGCGAGCGCGCA<br>GAGAGGGAGTGGCCAACTCCATCACTAGGGGTTCCTGGAGGGGTGGAGTCGTGA<br>CGTGAATTACGTCATAGGGTTAGGGAGGTCCTGTATTAGAGGTCACGTGAGTGT<br>TTTGCGACATTTTGCGACACCATGTGGTCACGCTGGGTATTTAAGCCCGAGTGAG<br>CACGCAGGGTCTCCATTTTGAAGCGGGAGGTTTGAACGCGCAGCGCCATGCCGG<br>GGTTTTACGAGATTGTGATTAAGGTCCCCAGCGACCTTGACGAGCATCTGCCCGG<br>CATTTCTGACAGCTTTGTGAACTGGGTGGCCGAGAAGGAATGGGAGTTGCCGCC<br>AGATTCTGACATGGATCTGAATCTGATTGAGCAGGCACCCCTGACCGTGGCCGA<br>GAAGCTGCAGCGCGACTTCCTGGTCCAGTGGCGCCGCGTGAGTAAGGCCCCGGA<br>GGCCCTCTTCTTTGTTCAGTTCGAGAAGGGCGAGTCCTACTTCCACCTCCATATT<br>CTGGTGGAGACCACGGGGGTCAAATCCATGGTGCTGGGCCGCTTCCTGAGTCAG<br>ATTAGGGACAAGCTGGTGCAGACCATCTACCGCGGGATCGAGCCGACCCTGCCC<br>AACTGGTTCGCGGTGACCAAGACGCGTAATGGCGCCGGAGGGGGAACAAGGT<br>GGTGGACGAGTGCTACATCCCCAACTACCTCCTGCCCAAGACTCAGCCCGAGCT<br>GCAGTGGGCGTGGACTAACATGGAGGAGTATATAAGCGCGTGTTTAAACCTGGC<br>CGAGCGCAAACGGCTCGTGGCGCACGACCTGACCCACGTCAGCCAGACCCAGGA<br>GCAGAACAAGGAGAATCTGAACCCCAATTCTGACGCGCCTGTCATCCGGTCAAA<br>AACCTCCGCACGCTACATGGAGCTGGTCGGGTGGCTGGTGGACCGGGGCATCAC<br>CTCCGAGAAGCAGTGGATCCAGGAGGACCAGGCCTCGTACATCTCCTTCAACGC<br>CGCCTCCAACTCGCGGTCCCAGATCAAGGCCGCTCTGGACAATGCCGGCAAGAT<br>CATGGCGCTGACCAAATCCGCGCCCGACTACCTGGTAGGCCCCGCTCCGCCCGC<br>CGACATTAAAACCAACCGCATTTACCGCATCCTGGAGCTGAACGGCTACGACCC<br>TGCCTACGCCGGCTCCGTCTTTCTCGGCTGGGCCCAGAAAAGGTTCGGAAAACG<br>CAACACCATCTGGCTGTTTGGGCCGGCCACCACGGGCAAGACCAACATCGCGGA<br>AGCCATCGCCCACGCCGTGCCCTTCTACGGCTGCGTCAACTGGACCAATGAGAA<br>CTTTCCCTTCAACGATTGCGTCGACAAGATGGTGATCTGGTGGGAGGAGGGCAA<br>GATGACGGCCAAGGTCGTGGAGTCCGCCAAGGCCATTCTCGGCGGCAGCAAGGT |

TABLE 7-continued

Nucleic Acid Sequences of Vectors

| SEQ ID NO | Sequence |
|---|---|
| | GCGCGTGGACCAAAAGTGCAAGTCGTCCGCCCAGATCGATCCCACCCCCGTGAT<br>CGTCACCTCCAACACCAACATGTGCGCCGTGATTGACGGGAACAGCACCACCTT<br>CGAGCACCAGCAGCCGTTGCAGGACCGGATGTTCAAATTTGAACTCACCCGCCG<br>TCTGGAGCATGACTTTGGCAAGGTGACAAAGCAGGAAGTCAAAGAGTTCTTCCG<br>CTGGGCGCAGGATCACGTGACCGAGGTGGCGCATGAGTTCTACGTCAGAAAGGG<br>TGGAGCAACAAGAGACCCGCCCCCGATGACGCGGATAAAAGCGAGCCCAAGC<br>GGGCCTGCCCCTCAGTCGCGGATCCATCGACGTCAGACGCGGAAGGAGCTCCGG<br>TGGACTTTGCCGACAGGTACCAAAACAAATGTTCTCGTCACGCGGGCATGCTTC<br>AGATGCTGTTTCCCTGCAAAACATGCGAGAGAATGAATCAGAATTTCAACATTT<br>GCTTCACGCACGGGACCAGAGACTGTTCAGAATGTTTCCCCGGCGTGTCAGAAT<br>CTCAACCGGTCGTCAGAAAGAGGACGTATCGGAAACTCTGTGCCATTCATCATC<br>TGCTGGGGCGGGCTCCCGAGATTGCTTGCTCGGCCTGCGATCTGGTCAACGTGG<br>ATCTGGATGACTGTGTTTCTGAGCAATAAATGACTTAAACCAGGTATGGCTGCCG<br>ATGGTTATCTTCCAGATTGGCTCGAGGACAACCTCTCTGAGGGCATTCGCGAGTG<br>GTGGGACTTGAAACCTGGAGCCCCGAAACCCAAAGCCAACCAGCAAAAGCAGG<br>ACGACGGCCGGGGTCTGGTGCTTCCTGGCTACAAGTACCTCGGACCCTTCAACG<br>GACTCGACAAGGGGGAGCCCGTCAACGCGGCGGATGCAGCGGCCCTCGAGCAC<br>GACAAGGCCTACGACCAGCAGCTCAAAGCGGGTGACAATCCGTACCTGCGGTAT<br>AACCCACGCCGACGCCGAGTTTCAGGAGCGTCTGCAAGAAGATACGTCTTTTGGG<br>GGCAACCTCGGGCGAGCAGTCTTCCAGGCCAAGAAGAGGGTTCTCGAACCTTTT<br>GGTCTGGTTGAGGAAGGTGCTAAGACGGCTCCTGGAAAGAAACGTCCGGTAGAG<br>CAGTCGCCACAAGAGCCAGACTCCTCCTCGGGCATTGGCAAGACAGGCCAGCAG<br>CCCGCTAAAAAGAGACTCAATTTTGGTCAGACTGGCGACTCAGAGTCAGTCCCC<br>GACCCACAACCTCTCGGAGAACCTCCAGCAACCCCCGCTGCTGTGGGACCTACT<br>ACAATGGCTTCAGGCGGTGGCGCACCAATGGCAGACAATAACGAAGGCGCCGA<br>CGGAGTGGGTAATGCCTCAGGAAATTGGCATTGCGATTCCACATGGCTGGGCGA<br>CAGAGTCATCACCACCAGCACCCGAACATGGGCCTTGCCCACCTATAACAACCA<br>CCTCTACAAGCAAATCTCCAGTGCTTCAACGGGGGCCAGCAACGACAACCACTA<br>CTTCGGCTACAGCACCCCCTGGGGGTATTTTGATTTCAACAGATTCCACTGCCAT<br>TTCTCACCACGTGACTGGCAGCGACTCATCAACAACAATTGGGGATTCCGGCCC<br>AAGAGACTCAACTTCAAGCTCTTCAACATCCAAGTCAAGGAGGTCACGACGAAT<br>GATGGCGTCACGACCATCGCTAATAACCTTACCAGCACGGTTCAAGTCTTCTCGG<br>ACTCGGAGTACCAGTTGCCGTACGTCCTCGGCTCTGCGCACCAGGGCTGCCTCCC<br>TCCGTTCCCGGCGGACGTGTTCATGATTCCGCAGTACGGCTACCTAACGCTCAAC<br>AATGGCAGCCAGGCAGTGGGACGGTCATCCTTTTACTGCCTGGAATATTTCCCAT<br>CGCAGATGCTGAGAACGGGCAATAACTTTACCTTCAGCTACACCTTCGAGGACG<br>TGCCTTTCCACAGCAGCTACGCGCACAGCCAGAGCCTGGACCGGCTGATGAATC<br>CTCTCATCGACCAGTACCTGTATTACCTGAACAGAACTCAGAATCAGTCCGGAA<br>GTGCCCAAAACAAGGACTTGCTGTTTAGCCGGGGGTCTCCAGCTGGCATGTCTGT<br>TCAGCCCAAAAACTGGCTACCTGGACCCTGTTACCGGCAGCAGCGCGTTTCTAA<br>AACAAAAACAGACAACAACAACAGCAACTTTACCTGGACTGGTGCTTCAAAATA<br>TAACCTTAATGGGCGTGAATCTATAATCAACCCTGGCACTGCTATGGCCTCACAC<br>AAAGACGACAAAGACAAGTTCTTTCCCATGAGCGGTGTCATGATTTTTGGAAAG<br>GAGAGCGCCGGAGCTTCAAACACTGCATTGGACAATGTCATGATCACAGACGAA<br>GAGGAAATCAAAGCCACTAACCCCGTGGCCACCGAAAGATTTGGGACTGTGGCA<br>GTCAATCTCCAGAGCAGCAGCACAGACCCTGCGACCGGAGATGCATGTTATG<br>GGAGCCTTACCTGGAATGGTGTGGCAAGACAGAGACGTATACCTGCAGGGTCCT<br>ATTTGGGCCAAAATTCCTCACACGGATGGACACTTTCACCCGTCTCCTCTCATGG<br>GCGGCTTTGGACTTAAGCACCCGCCTCCTCAGATCCTCATCAAAAACACGCCTGT<br>TCCTGCGAATCCTCCGGCAGAGTTTTCGGCTACAAAGTTTGCTTCATTCATCACC<br>CAGTATTCCACAGGACAAGTGAGCGTGGAGATTGAATGGGAGCTGCAGAAAGA<br>AAACAGCAAACGCTGGAATCCCGAAGTGCAGTATACATCTAACTATGCAAAATC<br>TGCCAACGTTGATTTCACTGTGGACAACAATGGACTTTATACTGAGCCTCGCCCC<br>ATTGGCACCCGTTACCTCACCCGTCCCCTGTAATTGTGTGTTAATCAATAAACCG<br>GTTAATTCGTGTCAGTTGAACTTTGGTCTCATGTCGTTATTATCTTATCTGGTCAC<br>CATAGCAACCGGTTACACATTAACTGCTTAGTTGCGCTTCGCGAATACCCCTAGT<br>GATGGAGTTGCCCACTCCCTCTATGCGCGCTCGCTCGCTCGGTGGGCCGGCAG<br>AGCAGAGCTCTGCCGTCTGCGGACCTTTGGTCCGCAGGCCCCACCGAGCGAGCG<br>AGCGCGCATAGAGGGAGTGGGCAA |
| SEQ ID<br>NO: 1412 | TTGGCCACTCCCTCTATGCGCGCTCGCTCGCTCGGTGGGCCTGCGACCAAAGG<br>TCCGCAGACGGCAGAGCTCTGCTCTGCCGGCCCCACCGAGCGAGCGAGCGCGCA<br>TAGAGGGAGTGGCCAACTCCATCACTAGGGGTACCGCGAAGCGCCTCCCACGCT<br>GCCGCGTCAGCGCTGACGTAAATCACGTCATAGGGGAGTGGTCCTGTATTAGCT<br>GTCACGTGAGTGCTTTTGCGACATTTTGCGACACCACGTGGCCATTTGAGGTATA<br>TATGGCCGAGTGAGCGAGCAGGATCTCCATTTTGACCGCGAAATTTGAACGAGC<br>AGCAGCCATGCCGGGTTTCTACGAGATCGTGATCAAGGTGCCGAGCGACCTGGA<br>CGAGCACCTGCCGGGCATTTCTGACTCGTTTGTGAACTGGGTGGCCGAGAAGGA<br>ATGGGAGCTGCCCCCGGATTCTGACATGGATCTGAATCTGATCGAGCAGGCACC<br>CCTGACCGTGGCCGAGAAGCTGCAGCGCGACTTCCTGGTCCAATGGCGCCGCGT<br>GAGTAAGGCCCCGGAGGCCCTGTTCTTTGTTCAGTTCGAGAAGGGCGAGAGCTA<br>CTTCCACCTTCACGTTCTGGTGGAGACCACGGGGGTCAAGTCCATGGTGCTAGGC<br>CGCTTCCTGAGTCAGATTCGGGAGAAGCTGGTCCAGACCATCTACCGCGGGGTC<br>GAGCCCACGCTGCCCAACTGGTTCGCGGTGACCAAGACGCGTAATGGCGCCGGC<br>GGGGGGAACAAGGTGGTGGACAGTGCTACATCCCCAACTACCTCCTGCCCAAG<br>ACCCAGCCCGAGCTGCAGTGGGCGTGGACTAACATGGAGGAGTATATAAGCGCG |

TABLE 7-continued

Nucleic Acid Sequences of Vectors

| SEQ ID NO | Sequence |
|---|---|
| | TGTTTGAACCTGGCCGAACGCAAACGGCTCGTGGCGCAGCACCTGACCCACGTC<br>AGCCAGACGCAGGAGCAGAACAAGGAGAATCTGAACCCCAATTCTGACGCGCC<br>CGTGATCAGGTCAAAAACCTCCGCGCGCTACATGGAGCTGGTCGGGTGGCTGGT<br>GGACCGGGGCATCACCTCCGAGAAGCAGTGGATCCAGGAGGACCAGGCCTCGT<br>ACATCTCCTTCAACGCCGCCTCCAACTCGCGGTCCCAGATCAAGGCCGCGCTGG<br>ACAATGCCGGCAAGATCATGGCGCTGACCAAATCCGCGCCCGACTACCTGGTGG<br>GGCCCTCGCTGCCCGCGGACATTAAAACCAACCGCATCTACCGCATCCTGGAGC<br>TGAACGGGTACGATCCTGCCTACGCCGGCTCCGTCTTTCTCGGCTGGGCCCAGAA<br>AAAGTTCGGGAAGCGCAACACCATCTGGCTGTTTGGGCCCGCCACCACCGGCAA<br>GACCAACATTGCGGAAGCCATCGCCCACGCCGTGCCCTTCTACGGCTGCGTCAA<br>CTGGACCAATGAGAACTTTCCCTTCAACGATTGCGTCGACAAGATGGTGATCTG<br>GTGGGAGGAGGGCAAGATGACGGCCAAGGTCGTGGAGTCCGCCAAGGCCATTC<br>TCGGCGGCAGCAAGGTGCGCGTGGACCAAAAGTGCAAGTCGTCCGCCCAGATCG<br>ACCCCACCCCCGTGATCGTCACCTCCAACACCAACATGTGCGCCGTGATTGACG<br>GGAACAGCACCACCTTCGAGCACCAGCAGCCGTTGCAGGACCGGATGTTCAAAT<br>TTGAACTCACCCGCCGTCTGGAGCACGACTTTGGCAAGGTGACGAAGCAGGAAG<br>TCAAAGAGTTCTTCCGCTGGGCCAGTGATCACGTGACCGAGGTGGCGCATGAGT<br>TCTACGTCAGAAAGGGCGGAGCCAGCAAAAGACCCGCCCCCGATGACGCGGAT<br>ATAAGCGAGCCCAAGCGGGCCTGCCCCTCAGTCGCGGATCCATCGACGTCAGAC<br>GCGGAAGGAGCTCCGGTGGACTTTGCCGACAGGTACCAAAACAAATGTTCTCGT<br>CACGCGGGCATGATTCAGATGCTGTTTCCCTGCAAAACGTGCGAGAGAATGATT<br>CAGAATTTCAACATTTGCTTCACACACGGGGTCAGAGACTGTTTAGAGTGTTTCC<br>CCGGCGTGTCAGAATCTCAACCGGTCGTCAGAAAAAAGACGTATCGGAAACTCT<br>GCGCGATTCATCATCTGCTGGGGCGGGCGCCCGAGATTGCTTGCTCGGCCTGCG<br>ACCTGGTCAACGTGGACCTGGACGACTGCGTTTCTGAGCAATAAATGACTTAAA<br>CCAGGTATGGCTGCCGATGGTTATCTTCCAGATTGGCTCGAGGACAACCTCTCTG<br>AGGGCATTCGCGAGTGGTGGGACCTGAAACCTGGAGCCCCGAAACCCAAAGCC<br>AACCAGCAAAAGCAGGACAACGGCCGGGGTCTGGTGCTTCCTGGCTACAAGTAC<br>CTCGGACCCTTCAACGGACTCGACAAGGGGGAGCCCGTCAACGCGGCGGACGCA<br>GCGGCCCTCGAGCACGACAAGGCCTACGACCAGCAGCTCAAAGCGGGTGACAA<br>TCCGTACCTGCGGTATAACCACGCCGACGCCGAGTTTCAGGAGCGTCTGCAAGA<br>AGATACGTCATTTGGGGGCAACCTCGGCGAGCAGTCTTCCAGGCCAAGAAGCG<br>GGTTCTCGAACCTCTCGGTCTGGTTGAGGAAGGCGCTAAGACGGCTCCTGCAAA<br>GAAGAGACCGGTAGAGCCGTCACCTCAGCGTTCCCCCGACTCCTCCACGGGCAT<br>CGGCAAGAAAGGCCAGCAGCCCGCCAGAAAGAGACTCAATTTCGGTCAGACTG<br>GCGACTCAGAGTCAGTCCCCGACCCTCAACCTCTCGGAGAACCTCCAGCAGCGC<br>CCTCTAGTGTGGGATCTGGTACAGTGGCTGCAGGCGGTGGCGCACCAATGGCAG<br>ACAATAACGAAGGTGCCGACGGAGTGGGTAATGCCTCAGGAAATTGGCATTGCG<br>ATTCCACATGGCTGGGCGACAGAGTCATTACCACCAGCACCCGAACCTGGGCCC<br>TGCCCACCTACAACAACCACCTCTACAAGCAAATCTCCAGTGAAACTGCAGGTA<br>GTACCAACGACAACACCTACTTCGGCTACAGCACCCCCTGGGGGTATTTTGACTT<br>TAACAGATTCCACTGCCACTTCTCACCACGTGACTGGCAGCGACTCATCAACAAC<br>AACTGGGGATTCCGGCCCAAGAAGCTGCGGTTCAAGCTCTTCAACATCCAGGTC<br>AAGGAGGTCACGACGAATGACGGCGTTACGACCATCGCTAATAACCTTACCAGC<br>ACGATTCAGGTATTCTCGGACTCGGAATACCAGCTGCCGTACGTCCTCGGCTCTG<br>CGCACCAGGGCTGCCTGCCTCCGTTCCCGGCGGACGTCTTCATGATTCCTCAGTA<br>CGGCTACCTGACTCTCAACAATGGCAGTCAGTCTGTGGGACGTTCCTCCTTCTAC<br>TGCCTGGAGTACTTCCCCTCTCAGATGCTGAGAACGGGCAACAACTTTGAGTTCA<br>GCTACAGCTTCGAGGACGTGCCTTTCCACAGCAGCTACGCACACAGCCAGAGCC<br>TGGACCGGCTGATGAATCCCCTCATCGACCAGTACTTGTACTACCTGGCCAGAAC<br>ACAGAGTAACCCAGGAGGCACAGCTGGCAATCGGGAACTGCAGTTTTACCAGGG<br>CGGGCCTTCAACTATGGCCGAACAAGCCAAGAATTGGTTACCTGGACCTTGCTTC<br>CGGCAACAAAGAGTCTCCAAAACGCTGGATCAAAACAACAACAGCAACTTTGCT<br>TGGACTGGTGCCACCAAATATCACCTGAACGGCAGAAACTCGTTGGTTAATCCC<br>GGCGTCGCCATGGCAACTCACAAGGACGACGAGGACCGCTTTTTCCCATCCAGC<br>GGAGTCCTGATTTTTGGAAAAACTGGAGCAACTAACAAAACTACATTGGAAAAT<br>GTGTTAATGACAAATGAAGAAGAAATTCGTCCTACTAATCCTGTAGCCACGGAA<br>GAATACGGGATAGTCAGCAGCAACTTACAAGCGGCTAATACTGCAGCCCAGACA<br>CAAGTTGTCAACAACCAGGGAGCCTTACCTGGCATGGTCTGGCAGAACCGGGAC<br>GTGTACCTGCAGGGTCCCATCTGGGCCAAGATTCCTCACACGGATGGCAACTTTC<br>ACCCGTCTCCTTTGATGGGCGGCTTTGGACTTAAACATCCGCCTCCTCAGATCCT<br>GATCAAGAACACTCCCGTTCCCGCTAATCCTCCGGAGGTGTTTACTCCTGCCAAG<br>TTTGCTTCGTTCATCACACAGTACAGCACCGGACAAGTCGATGTGGAAATCGAG<br>TGGGAGCTGCAGAAGGAAAACAGCAAGCGCTGGAACCCGGAGATTCAGTACAC<br>CTCCAACTTTGAAAAGCAGACTGGTGTGGACTTTGCCGTTGACAGCCAGGGTGTT<br>TACTCTGAGCCTCGCCCTATTGGCACTCGTTACCTCACCCGTAATCTGTAATTGC<br>ATGTTAATCAATAAACCGGTTGATTCGTTTCAGTTGAACTTTGGTCTCCTGTGCTT<br>CTTATCTTATCGGTTTCCATAGCAACTGGTTACACATTAACTGCTTGGGTGCGCTT<br>CACGATAAGAACACTGACGTCACCGCGGTACCCCTAGTGATGGAGTTGGCCACT<br>CCCTCTATGCGCGCTCGCTCGGTGGGCCTGCGGACCAAAGGTCCGCAGA<br>CGGCAGAGCTCTGCTCTGCCGGCCCCACCGAGCGAGCGAGCGCGCATAGAGGGA<br>GTGGCCAA |
| SEQ ID<br>NO: 1413 | CAGAGAGGGAGTGGCCAACTCCATCACTAGGGGTAGCGCGAAGCGCCTCCCACG<br>CTGCCGCGTCAGCGCTGACGTAAATTACGTCATAGGGGAGTGGTCCTGTATTAG<br>CTGTCACGTGAGTGCTTTTGCGGCATTTTGCGACACCACGTGGCCATTTGAGGTA |

TABLE 7-continued

Nucleic Acid Sequences of Vectors

SEQ ID NO Sequence

```
TATATGGCCGAGTGAGCGAGCAGGATCTCCATTTTGACCGCGAAATTTGAACGA
GCAGCAGCCATGCCGGGCTTCTACGAGATCGTGATCAAGGTGCCGAGCGACCTG
GACGAGCACCTGCCGGGCATTTCTGACTCGTTTGTGAACTGGGTGGCCGAGAAG
GAATGGGAGCTGCCCCCGGATTCTGACATGGATCGGAATCTGATCGAGCAGGCA
CCCCTGACCGTGGCCGAGAAGCTGCAGCGCGACTTCCTGGTCCAATGGCGCCGC
GTGAGTAAGGCCCCGGAGGCCCTCTTCTTTGTTCAGTTCGAGAAGGGCGAGAGC
TACTTTCACCTGCACGTTCTGGTCGAGACCACGGGGGTCAAGTCCATGGTGCTAG
GCCGCTTCCTGAGTCAGATTCGGGAAAAGCTTGGTCCAGACCATCTACCCGCGG
GGTCGAGCCCCACCTTGCCCAACTGGTTCGCGGTGACCAAAGACGCGGTAATGG
CGCCGGCGGGGGGGAACAAGGTGGTGGACGAGTGCTACATCCCCAACTACCTCC
TGCCCAAGACTCAGCCCGAGCTGCAGTGGGCGTGGACTAACATGGAGGAGTATA
TAAGCGCGTGCTTGAACCTGGCCGAGCGCAAACGGCTCGTGGCGCAGCACCTGA
CCCACGTCAGCCAGACGCAGGAGCAGAACAAGGAGAATCTGAACCCCAATTCTG
ACGCGCCCGTGATCAGGTCAAAAACCTCCGCGCGCTATATGGAGCTGGTCGGGT
GGCTGGTGGACCGGGGCATCACCTCCGAGAAGCAGTGGATCCAGGAGGACCAG
GCCTCGTACATCTCCTTCAACGCCGCCTCCAACTCGCGGTCCCAGATCAAGGCCG
CGCTGGACAATGCCGGCAAGATCATGGCGCTGACCAAATCCGCGCCCGACTACC
TGGTGGGGCCCTCGCTGCCCGCGGACATTACCCAGAACCGCATCTACCGCATCCT
CGCTCTCAACGGCTACGACCCTGCCTACGCCGGCTCCGTCTTTCTCGGCTGGGCT
CAGAAAAAGTTCGGGAAACGCAACACCATCTGGCTGTTTGGACCCGCCACCACC
GGCAAGACCAACATTGCGGAAGCCATCGCCCACGCCGTGCCCTTCTACGGCTGC
GTCAACTGGACCAATGAGAACTTTCCCTTCAATGATTGCGTCGACAAGATGGTG
ATCTGGTGGGAGGAGGGCAAGATGACGGCCAAGGTCGTGGAGTCCGCCAAGGC
CATTCTCGGCGGCAGCAAGGTGCGCGTGGACCAAAAGTGCAAGTCGTCCGCCCA
GATCGACCCCACCCCCGTGATCGTCACCTCCAACACCAACATGTGCGCCGTGATT
GACGGGAACAGCACCACCTTCGAGCACCAGCAGCCTCTCCAGGACCGGATGTTT
AAGTTCGAACTCACCCGCCGTCTGGAGCACGACTTTGGCAAGGTGACAAAGCAG
GAAGTCAAAGAGTTCTTCCGCTGGGCCAGTGATCACGTGACCGAGGTGGCGCAT
GAGTTTTACGTCAGAAAGGGCGGAGCCAGCAAAAGACCCGCCCCCGATGACGC
GGATAAAAGCGAGCCCAAGCGGGCCTGCCCCTCAGTCGCGGATCCATCGACGTC
AGACGCGGAAGGAGCTCCGGTGGACTTTGCCGACAGGTACCAAAACAAATGTTC
TCGTCACGCGGGCATGCTTCAGATGCTGTTTCCCTGCAAAACGTGCGAGAGAAT
GAATCAGAATTTCAACATTTGCTTCACACACGGGGTCAGAGACTGCTCAGAGTG
TTTCCCCGGCGTGTCAGAATCTCAACCGGTCGTCAGAAAGAGGACGTATCGGAA
ACTCTGTGCGATTCATCATCTGCTGGGGCGGGCTCCCGAGATTGCTTGCTCGGCC
TGCGATCTGGTCAACGTGGACCTGGATGACTGTGTTTCTGAGCAATAAATGACTT
AAACCAGGTATGGCTGCCGATGGTTATCTTCCAGATTGGCTCGAGGACAACCTCT
CTGAGGGCATTCGCGAGTGGTGGGCGCTGAAACCTGGAGCCCCGAAGCCCAAAG
CCAACCAGCAAAAGCAGGACGACGGCCGGGGTCTGGTGCTTCCTGGCTACAAGT
ACCTCGGACCCTTCAACGGACTCGACAAGGGGGAGCCCGTCAACGCGGCGGACG
CAGCGGCCCTCGAGCACGACAAGGCCTACGACCAGCAGCTGCAGGCGGGTGAC
AATCCGTACCTGCGGTATAACCACGCCGACGCCGAGTTTCAGGAGCGTCTGCAA
GAAGATACGTCTTTTGGGGGCAACCTCGGGCGAGCAGTCTTCCAGGCCAAGAAG
CGGGTTCTCGAACCTCTCGGTCTGGTTGAGGAAGGCGCTAAGACGGCTCCTGGA
AAGAAGAGACCGGTAGAGCCATCACCCCAGCGTTCTCCAGATCCTCTACGGGC
ATCGGCAAGAAAGGCCAACAGCCCGCCAGAAAAAGACTCAATTTTGGTCAGACT
GGCGACTCAGAGTCAGTTCCAGACCCTCAACCTCTCGGAGAACCTCCAGCAGCG
CCCTCTGGTGTGGGACCTAATACAATGGCTGCAGGCGGTGGCGCACCAATGGCA
GACAATAACGAAGGCGCCGACGGAGTGGGTAGTTCCTCGGGAAATTGGCATTGC
GATTCCACATGGCTGGGCGACAGAGTCATCACCACCAGCACCCGAACCTGGGCC
CTGCCCACCTACAACAACCACCTCTACAAGCAAATCTCCAACGGGACATCGGGA
GGAGCCACCAACGACAACACCTACTTCGGCTACAGCACCCCCTGGGGGTATTTT
GACTTTAACAGATTCCACTGCCACTTTTCACCACGTGACTGGCAGCGACTCATCA
ACAACAACTGGGGATTCCGGCCCAAGAGACTCAGCTTCAAGCTCTTCAACATCC
AGGTCAAGGAGGTCACGCAGAATGAAGGCACCAAGACCATCGCCAATAACCTC
ACCAGCACCATCCAGGTGTTTACGGACTCGGAGTACCAGCTGCCGTACGTTCTCG
GCTCTGCCCACCAGGGCTGCCTGCCTCCGTTCCCGGCGGACGTGTTCATGATTCC
CCAGTACGGCTACCTAACACTCAACAACGGTAGTCAGGCCGTGGGACGCTCCTC
CTTCTACTGCCTGGAATACTTTCCTTCGCAGATGCTGAGAACCGGCAACAACTTC
CAGTTTACTTACACCTTCGAGGACGTGCCTTTCCACAGCAGCTACGCCCACAGCC
AGAGCTTGGACCGGCTGATGAATCCTCTGATTGACCAGTACCTGTACTACTTGTC
TCGGACTCAAACAACAGGAGGCACGGCAAATACGCAGACTCTGGGCTTCAGCCA
AGGTGGGCCTAATACAATGGCCAATCAGGCAAAGAACTGGCTGCCAGGACCCTG
TTACCGCCAACAACGCGTCTCAACGACAACCGGGCAAAACAACAATAGCAACTT
TGCCTGGACTGCTGGGACCAAATACCATCTGAATGGAAGAATTCATTGGCTAA
TCCTGGCATCGCTATGGCAACACACAAAGACGACGAGGAGCGTTTTTTTCCCAG
TAACGGGATCCTGATTTTTGGCAAACAAAATGCTGCCAGAGACAATGCGGATTA
CAGCGATGTCATGCTCACCAGCGAGGAAGAAATCAAAACCACTAACCCTGTGGC
TACAGAGGAATACGGTATCGTGGCAGATAACTTGCAGCAGCAAAACACGGCTCC
TCAAATTGGAACTGTCAACAGCCAGGGGGCCTTACCCGGTATGGTCTGGCAGAA
CCGGGACGTGTACCTGCAGGGTCCCATCTGGGCCAAGATTCCTCACACGGACGG
CAACTTCCACCCGTCTCCGCTGATGGGCGGCTTTGGCCTGAAACATCCTCCGCCT
CAGATCCTGATCAAGAACACGCCTGTACCTGCGGATCCTCCGACCACCTTCAACC
AGTCAAAGCTGAACTCTTTCATCACGCAATACAGCACCGGACAGGTCAGCGTGG
AAATTGAATGGGAGCTGCAGAAGGAAAACAGCAAGCGCTGGAACCCCGAGATC
CAGTACACCTCCAACTACTACAAATCTACAAGTGTGGACTTTGCTGTTAATACAG
```

TABLE 7-continued

Nucleic Acid Sequences of Vectors

| SEQ ID NO | Sequence |
|---|---|
| | AAGGCGTGTACTCTGAACCCCGCCCCATTGGCACCCGTTACCTCACCCGTAATCT<br>GTAATTGCCTGTTAATCAATAAACCGGTTGATTCGTTTCAGTTGAACTTTGGTCT<br>CTGCG |
| SEQ ID<br>NO: 1414 | ATGGCTGCCGATGGTTATCTTCCAGATTGGCTCGAGGACAACCTTAGTGAAGGA<br>ATTCGCGAGTGGTGGGCTTTGAAACCTGGAGCCCCTCAACCCAAGGCAAATCAA<br>CAACATCAAGACAACGCTCGAGGTCTTGTGCTTCCGGGTTACAAATACCTTGGA<br>CCCGGCAACGGACTCGACAAGGGGGAGCCGGTCAACGCAGCAGACGCGGCGGC<br>CCTCGAGCACGACAAGGCCTACGACCAGCAGCTCAAGGCCGGAGACAACCCGT<br>ACCTCAAGTACAACCACGCCGACGCCGAGTTCCAGGAGCGGCTCAAAGAAGATA<br>CGTCTTTTGGGGGCAACCTCGGGCGAGCAGTCTTCCAGGCCAAAAAGAGGCTTC<br>TTGAACCTCTTGGTCTGGTTGAGGAAGCGGCTAAGACGGCTCCTGGAAAGAAGA<br>GGCCTGTAGAGCAGTCTCCTCAGGAACCGGACTCCTCCGCGGGTATTGGCAAAT<br>CGGGTGCACAGCCCGCTAAAAAGAGACTCAATTTCGGTCAGACTGGCGACACAG<br>AGTCAGTCCCAGACCCTCAACCAATCGGAGAACCTCCCGCAGCCCCCTCAGGTG<br>TGGGATCTCTTACAATGGCTTCAGGTGGTGGCGCACCAGTGGCAGACAATAACG<br>AAGGTGCCGATGGAGTGGGTAGTTCCTCGGGAAATTGGCATTGCGATTCCCAAT<br>GGCTGGGGGACAGAGTCATCACCACCAGCACCCGAACCTGGGCCCTGCCCACCT<br>ACAACAATCACCTCTACAAGCAAATCTCCAACAGCACATCTGGAGGATCTTCAA<br>ATGACAACGCCTACTTCGGCTACAGCACCCCCTGGGGGTATTTTGACTTCAACAG<br>ATTCCACTGCCACTTCTCACCACGTGACTGGCAGCGACTCATCAACAACAACTGG<br>GGATTCCGGCCTAAGCGACTCAACTTCAAGCTCTTCAACATTCAGGTCAAAGAG<br>GTTACGGACAACAATGGAGTCAAGACCATCGCCAATAACCTTACCAGCACGGTC<br>CAGGTCTTCACGGACTCAGACTATCAGCTCCCGTACGTGCTCGGGTCGGCTCACG<br>AGGGCTGCCTCCCGCGTTCCCAGCGGACGTTTTCATGATTCCTCAGTACGGGTA<br>TCTGACGCTTAATGATGGAAGCCAGGCCGTGGGTCGTTCGTCCTTTTACTGCCTG<br>GAATATTTCCCGTCGCAAATGCTAAGAACGGGTAACAACTTCCAGTTCAGCTAC<br>GAGTTTGAGAACGTACCTTTCCATAGCAGCTACGCTCACAGCCAAAGCCTGGAC<br>CGACTAATGAATCCACTCATCGACCAATACTTGTACTATCTCTCAAAGACTATTA<br>ACGGTTCTGGACAGAATCAACAAACGCTAAAATTCAGTGTGGCCGGACCCAGCA<br>ACATGGCTGTCCAGGGAAGAAACTACATACCTGGACCCAGCTACCGACAACAAC<br>GTGTCTCAACCACTGTGACTCAAAACAACAACAGCGAATTTGCTTGGCCTGGAG<br>CTTCTTCTTGGGCTCTCAATGGACGTAATAGCTTGATGAATCCTGGACCTGCTAT<br>GGCCAGCCACAAAGAAGGAGAGGACCGTTTCTTTCCTTTGTCTGGATCTTTAATT<br>TTTGGCAAACAAGGAACTGGAAGAGACAACGTGGATGCGGACAAAGTCATGAT<br>AACCAACGAAGAAGAAATTAAAACTACTAACCCGGTAGCAACGGAGTCCTATG<br>GACAAGTGGCCACAAACCACCAGAGTGCCCAAGCACAGGCGCAGACCGGCTGG<br>GTTCAAAACCAAGGAATACTTCCGGGTATGGTTTGGCAGGACAGAGATGTGTAC<br>CTGCAAGGACCCATTTGGGCCAAAATTCCTCACACGGACGGCAACTTTCACCCTT<br>CTCCGCTGATGGGAGGGTTTGGAATGAAGCACCCGCCTCCTCAGATCCTCATCA<br>AAAACACACCTGTACCTGCGGATCCTCCAACGGCCTTCAACAAGGACAAGCTGA<br>ACTCTTTCATCACCCAGTATTCTACTGGCCAAGTCAGCGTGGAGATCGAGTGGGA<br>GCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAG<br>TGAACCCCGCCCCATTGGCACCAGATACCTGACTCGTAATCTGTAA |
| SEQ ID<br>NO: 1415 | ATGCCGGGCTTCTACGAGATCGTGATCAAGGTGCCGAGCGACCTGGACGAGCAC<br>CTGCCGGGCATTTCTGACTCGTTTGTGAACTGGGTGGCCGAGAAGGAATGGGAG<br>CTGCCCCCGGATTCTGACATGGATCGGAATCTGATCGAGCAGGCACCCCTGACC<br>GTGGCCGAGAAGCTGCAGCGCGACTTCCTGGTCCACTGGCGCCGCGTGAGTAAG<br>GCCCCGGAGGCCCTCTTCTTTGTTCAGTTCGAGAAGGGCGAGTCCTACTTTCACC<br>TGCACGTTCTGGTCGAGACCACGGGGGTCAAGTCCATGGTCCTGGGCCGCTTCCT<br>GAGTCAGATCAGAGACAGGCTGGTGCAGACCATCTACCGCGGGGTAGAGCCCAC<br>GCTGCCCAACTGGTTCGCGGTGACCAAGACGCGAAATGGCGCCGGCGGGGGGA<br>ACAAGGTGGTGGACGAGTGCTACATCCCCAACTACCTCCTGCCCAAGACGCAGC<br>CCGAGCTGCAGTGGGCGTGGACTAACATGGAGGAGTATATAAGCGCGTGTCTGA<br>ACCTCGCGGAGCGTAAACGGCTCGTGGCGCAGCACCTGACCCACGTCAGCCAGA<br>CGCAGGAGCAGAACAAGGAGAATCTGAACCCGAATTCTGACGCGCCCGTGATCA<br>GGTCAAAAACCTCCGCGCGCTACATGGAGCTGGTCGGGTGGCTGGTGGACCGGG<br>GCATCACCTCCGAGAAGCAGTGGATCCAGGAGGACCAGGCCTCGTACATCTCCT<br>TCAACGCCGCCTCCAACTCGCGGTCCCAGATCAAGGCCGCGCTGGACAATGCCG<br>GAAAGATCATGGCGCTGACCAAATCCGCGCCCGACTACCTGGTAGGCCCGTCCT<br>TACCCGCGGACATTAAGGCCAACCGCATCTACCGCATCCTGGAGCTCAACGCT<br>ACGACCCCGCCTACGCCGGCTCCGTCTTCCTGGGCTGGGCGCAGAAAAAGTTCG<br>GTAAAAGGAATACAATTTGGCTGTTCGGGCCGCCACCACCGGCAAGACCAACA<br>TCGCGGAAGCCATCGCCCACGCCGTGCCCTTCTACGGCTGCGTCAACTGGACCA<br>ATGAGAACTTTCCCTTCAACGATTGCGTCGACAAGATGGTGATCTGGTGGGAGG<br>AGGGCAAGATGACCGCCAAGGTCGTGGAGTCCGCCAAGGCCATTCTGGGCGGA<br>AGCAAGGTGCGCGTCGACCAAAAGTGCAAGTCCTCGGCCCAGATCGACCCCACG<br>CCCGTGATCGTCACCTCCAACACCAACATGTGCGCCGTGATCGACGGGAACAGC<br>ACCACCTTCGAGCACCAGCAGCCCCTGCAGGACCGCATGTTCAAGTTCGAGCTC<br>ACCCGCCGTCTGGAGCACGACTTTGGCAAGGTGACCAAGCAGGAAGTCAAAGA<br>GTTCTTCCGCTGGGCTCAGGATCACGTGACTGAGGTGACGCATGAGTTCTACGTC<br>AGAAAGGGCGGAGCCACCAAAAGACCCGCCCCAGTGACGCGGATATAAGCGA<br>GCCCAAGCGGGCCTGCCCCTCAGTTGCGGAGCCATCGACGTCAGACGCGGAAGC<br>ACCGGTGGACTTTGCGGACAGGTACCAAAACAAATGTTCTCGTCACGCGGGCAT |

TABLE 7-continued

Nucleic Acid Sequences of Vectors

| SEQ ID NO | Sequence |
|---|---|
| | GCTTCAGATGCTGTTTCCCTGCAAGACATGCGAGAGAATGAATCAGAATTTCAA
CGTCTGCTTCACGCACGGGGTCAGAGACTGCTCAGAGTGCTTCCCCGGCGCGTC
AGAATCTCAACCTGTCGTCAGAAAAAAGACGTATCAGAAACTGTGCGCGATTCA
TCATCTGCTGGGGCGGGCACCCGAGATTGCGTGTTCGGCCTGCGATCTCGTCAAC
GTGGACTTGGATGACTGTGTTTCTGAGCAATAAATGACTTAAACCAGGTATGGCT
GCTGACGGTTATCTTCCAGATTGGCTCGAGGACAACCTCTCTGAGGGCATTCGCG
AGTGGTGGGACCTGAAACCTGGAGCCCCAAGCCCAAGGCCAACCAGCAGAAG
CAGGACGACGGCCGGGGTCTGGTGCTTCCTGGCTACAAGTACCTCGGACCCTTC
AACGGACTCGACAAGGGGGAGCCCGTCAACGCGGCGGACGCGCAGCGGCCCTCGA
GCACGACAAGGCCTACGACCAGCAGCTCAAAGCGGGTGACAATCCGTACCTGCG
GTATAACCACGCCGACGCCGAGTTTCAGGAGCGTCTGCAAGAAGATACGTCTTT
TGGGGGCAACCTCGGGCGAGCAGTCTTCCAGGCCAAGAAGCGGGTTCTCGAACC
TCTCGGTCTGGTTGAGGAAGCTGCTAAGACGGCTCCTGGAAAGAAGAGACCGGT
AGAACCGTCACCTCAGCGTTCCCCCGACTCCTCCACGGGCATCGGCAAGAAAGG
CCAGCAGCCCGCTAAAAAGAGACTGAACTTTGGGCAGACTGGCGAGTCAGAGTC
AGTCCCCGACCCTCAACCAATCGGAGAACCACCAGCAGGCCCCTCTGGTCTGGG
ATCTGGTACAATGGCTGCAGGCGGTGGCGCTCCAATGGCAGACAATAACGAAGG
CGCCGACGGAGTGGGTAGTTCCTCAGGAAATTGGCATTGCGATTCCACATGGCT
GGGCGACAGAGTCATCACCACCAGCACCCGAACCTGGGCCCTGCCCACCTACAA
CAACCACCTCTACAAGCAAATCTCCAACGGGACATCGGGAGGAAGCACCAACG
ACAACACCTACTTCGGCTACAGCACCCCCTGGGGGTATTTTGACTTCAACGATT
CCACTGCCACTTCTCACCACGTGACTGGCAGCGACTCATCAACAACAACTGGGG
ATTCCGGCCAAAAAGACTCAGCTTCAAGCTCTTCAACATCCAGGTCAAGGAGGT
CACGCAGAATGAAGGCACCAAGACCATCGCCAATAACCTTACCAGCACGATTCA
GGTATTTACGGACTCGGAATACCAGCTGCCGTACGTCCTCGGCTCCGCGCACCA
GGGCTGCCTGCCTCCGTTCCCGGCGGATGTCTTCATGATTCCCCAGTACGGCTAC
CTGACACTGAACAATGGAAGTCAAGCCGTAGGCCGTTCCTCCTTCTACTGCCTGG
AATATTTTCCATCTCAAATGCTGCGAACTGGAAACAATTTTGAATTCAGCTACAC
CTTCGAGGACGTGCCTTTCCACAGCAGCTACGCACACAGCCAGAGCTTGGACCG
ACTGATGAATCCTCTCATTGACCAGTACCTGTACTACTTATCCAGAACTCAGTCC
ACAGGAGGAACTCAAGGTACCCAGCAATTGTTATTTTCTCAAGCTGGGCCTGCA
AACATGTCGGCTCAGGCCAAGAACTGGCTGCCTGGACCTTGCTACCGGCAGCAG
CGAGTCTCCACGACACTGTCGCAAAACAACAACAGCAACTTTGCTTGGACTGGT
GCCACCAAATATCACCTGAACGGAAGAGACTCTCTGGTGAATCCCGGTGTCGCC
ATGGCAACCCACAAGGACGACGAGGAACGCTTCTTCCCGTCGAGCGGAGTCCTG
ATGTTTGGAAAACAGGGTGCTGGAAGAGACAATGTGGACTACAGCAGCGTTATG
CTAACAAGCGAAGAAGAAATTAAAACCACTAACCCTGTAGCCACAGAACAATA
CGGCGTGGTGGCTGACAACTTGCAGCAAGCCAATACAGGGCCTATTGTGGGAAA
TGTCAACAGCCAAGGAGCCTTACCTGGCATGGTCTGGCAGAACCGAGACGTGTA
CCTGCAGGGTCCCATCTGGGCCAAGATTCCTCACACGGACGGCAACTTTCACCC
GTCTCCTCTGATGGGCGGCTTTGGACTTAAACACCCGCCTCCACAGATCCTGATC
AAGAACACGCCGGTACCTGCGGATCCTCCAACAACGTTCAGCCAGGCGAAATTG
GCTTCCTTCATCACGCAGTACAGCACCGGACAGGTCAGCGTGGAAATCGAGTGG
GAGCTGCAGAAGGAGAACAGCAAACGCTGGAACCCAGAGATTCAGTACACTTC
AAACTACTACAAATCTACAAATGTGGACTTTGCTGTCAATACAGAGGGAACTTA
TTCTGAGCCTCGCCCCATTGGTACTCGTTATCTGACACGTAATCTGTAA |
| SEQ ID NO: 1416 | ATGCCGGGCTTCTACGAGATCGTGATCAAGGTGCCGAGCGACCTGGACGAGCAC
CTGCCGGGCATTTCTGACTCGTTTGTGAACTGGGTGGCCGAGAAGGAATGGGAG
CTGCCCCCGGATTCTGACATGGATCGGAATCTGATCGAGCAGGCACCCCTGACC
GTGGCCGAGAAGCTGCAGCGCGACTTCCTGGTCCACTGGCGCCGCGTGAGTAAG
GCCCCGGAGGCCCTCTTCTTTGTTCAGTTCGAGAAGGGCGAGTCCTACTTCCACC
TCCACGTTCTCGTCGAGACCACGGGGGTCAAGTCCATGGTCCTGGGCCGCTTCCT
GAGTCAGATCAGAGACAGGCTGGTGCAGACCATCTACCGCGGGGTCGAGCCCAC
GCTGCCCAACTGGTTCGCGGTGACCAAGACGCGAAATGGCGCCGGCGGGGGA
ACAAGGTGGTGGACGAGTGCTACATCCCCAACTACCTCCTGCCCAAGACCCAGC
CCGAGCTGCAGTGGGCGTGGACTAACATGGAGGAGTATATAAGCGCGTGTCTAA
ACCTCGCGGAGCGTAAACGGCTCGTGGCGCAGCACCTGACCCACGTCAGCCAGA
CGCAGGAGCAGAACAAGGAGAATCTGAACCCGAATTCTGACGCGCCCGTGATCA
GGTCAAAAACCTCCGCGCGCTACATGGAGCTGGTCGGGTGGCTGGTGGACCGGG
GCATCACCTCCGAGAAGCAGTGGATCCAGGAGGACCAGGCCTCGTACATCTCCT
TCAACGCCGCCTCCAACTCGCGGTCCCAGATCAAGGCCGCGCTGGACAATGCCG
GAAAGATCATGGCGCTGACCAAATCCGCGCCCGACTACCTGGTAGGCCCGTCCT
TACCCGCGGACATTAAGGCCAACCGCATCTACCGCATCCTGGAGCTCAACGGCT
ACGACCCCGCCTACGCCGGCTCCGTCTTCCTGGGCTGGGCGCAGAAAAAGTTCG
GTAAACGCAACACCATCTGGCTGTTTGGGCCCGCCACCACCGGCAAGACCAACA
TCGCGGAAGCCATAGCCCACGCCGTGCCCTTCTACGGCTGCGTGAACTGGACCA
ATGAGAACTTTCCCTTCAACGATTGCGTCGACAAGATGGTGATCTGGTGGGAGG
AGGGCAAGATGACCGCAAGGTCGTGGAGTCCGCCAAGGCCATTCTGGGCGGA
AGCAAGGTGCGCGTGGACCAAAAGTGCAAGTCCTCGGCCCAGATCGACCCCACG
CCCGTGATCGTCACCTCCAACACCAACATGTGCGCCGTGATCGACGGGAACAGC
ACCACCTTCGAGCACCAGCAGCCGCTGCAGGACCGCATGTTCAAGTTCGAGCTC
ACCCGCCGTCTGGAGCACGACTTTGGCAAGGTGACCAAGCAGGAAGTCAAAGA
GTTCTTCCGCTGGGCTCAGGATCACGTGACTGAGGTGGCGCATGAGTTCTACGTC
AGAAAGGGCGGAGCCACCAAAAGACCCGCCCCCAGTGACGCGGATATAAGCGA
GCCCAAGCGGGCCTGCCCCTCAGTTCCGGAGCCATCGACGTCAGACGCGGAAGC |

TABLE 7-continued

Nucleic Acid Sequences of Vectors

| SEQ ID NO | Sequence |
|---|---|
| | ACCGGTGGACTTTGCGGACAGGTACCAAAACAAATGTTCTCGTCACGCGGGCAT<br>GCTTCAGATGCTGTTTCCCTGCAAGACATGCGAGAGAATGAATCAGAATTTCAA<br>CGTCTGCTTCACGCACGGGTCAGAGACTGCTCAGAGTGCTTCCCCGGCGCGTC<br>AGAATCTCAACCCGTCGTCAGAAAAAAGACGTATCAGAAACTGTGCGCGATTCA<br>TCATCTGCTGGGGCGGGCACCCGAGATTGCGTGTTCGGCCTGCGATCTCGTCAAC<br>GTGGACTTGGATGACTGTGTTTCTGAGCAATAAATGACTTAAACCAGGTATGGCT<br>GCTGACGGTTATCTTCCAGATTGGCTCGAGGACAACCTCTCTGAGGGCATTCGCG<br>AGTGGTGGGACCTGAAACCTGGAGCCCCGAAGCCCAAGGCCAACCAGCAGAAG<br>CAGGACGACGGCCGGGGTCTGGTGCTTCCTGGCTACAAGTACCTCGGACCCTTC<br>AACGGACTCGACAAGGGGGAGCCCGTCAACGCGGCGGACGCAGCGGCCCTCGA<br>GCACGACAAGGCCTACGACCAGCAGCTCAAAGCGGGTGACAATCCGTACCTGCG<br>GTATAACCACGCCGACGCCGAGTTTCAGGAGCGTCTGCAAGAAGATACGTCTTT<br>TGGGGGCAACCTCGGGCGAGCAGTCTTCCAGGCCAAGAAGAGGGTACTCGAACC<br>TCTGGGCCTGGTTGAAGAAGGTGCTAAAACGGCTCCTGGAAAGAAGAGACCGTT<br>AGAGTCACCACAAGAGCCCGACTCCTCCTCGGGCATCGGCAAAAAAGGCAAAC<br>AACCAGCCAGAAAGAGGCTCAACTTTGAAGAGGACACTGGAGCCGGAGACGGA<br>CCCCCTGAAGGATCAGATACCAGCGCCATGTCTTCAGACATTGAAATGCGTGCA<br>GCACCGGGCGGAAATGCTGTCGATGCGGGACAAGGTTCCGATGGAGTGGGTAAT<br>GCCTCGGGTGATTGGCATTGCGATTCCACCTGGTCTGAGGGCAAGGTCACAACA<br>ACCTCGACCAGAACCTGGGTCTTGCCCACCTACAACAACCACTTGTACCTGCGTC<br>TCGGAACAACATCAAGCAGCAACACCTACAACGGATTCTCCACCCCTGGGGAT<br>ATTTTGACTTCAACAGATTCCACTGTCACTTCTCACCACGTGACTGGCAAAGACT<br>CATCAACAACAACTGGGGACTACGACCAAAAGCCATGCGCGTTAAAATCTTCAA<br>TATCCAAGTTAAGGAGGTCACAACGTCGAACGGCGAGACTACGGTCGCTAATAA<br>CCTTACCAGCACGGTTCAGATATTTGCGGACTCGTCGTATGAGCTCCCGTACGTG<br>ATGGACGCTGGACAAGAGGGGAGCCTGCCTCCTTTCCCCAATGACGTGTTCATG<br>GTGCCTCAATATGGCTACTGTGGCATCGTGACTGGCGAGAATCAGAACCAAACG<br>GACAGAAACGCTTTCTACTGCCTGGAGTATTTTCCTTCGCAAATGTTGAGAACTG<br>GCAACAACTTTGAAATGGCTTACAACTTTGAGAAGGTGCCGTTCCACTCAATGTA<br>TGCTCACAGCCAGAGCCTGGACAGACTGATGAATCCCCTCCTGGACCAGTACCT<br>GTGGCACTTACAGTCGACTACCTCTGGAGAGACTCTGAATCAAGGCAATGCAGC<br>AACCACATTTGGAAAAATCAGGAGTGGAGACTTTGCCTTTTACAGAAAGAACTG<br>GCTGCCTGGGCCTTGTGTTAAACAGCAGAGATTCTCAAAAACTGCCAGTCAAAA<br>TTACAAGATTCCTGCCAGCGGGGGCAACGCTCTGTTAAAGTATGACACCCACTA<br>TACCTTAAACAACCGCTGGAGCAACATCGCGCCCGGACCTCCAATGGCCACAGC<br>CGGACCTTCGGATGGGGACTTCAGTAACGCCCAGCTTATATTCCCTGGACCATCT<br>GTTACCGGAAATACAACAACTTCAGCCAACAATCTGTTGTTTACATCAGAAGAA<br>GAAATTGCTGCCACCAACCCAAGAGACACGGACATGTTTGGCCAGATTGCTGAC<br>AATAATCAGAATGCTACAACTGCTCCCATAACCGGCAACGTGACTGCTATGGGA<br>GTGCTGCCTGGCATGGTGTGGCAAAACAGAGACATTTACTACCAAGGGCCAATT<br>TGGGCCAAGATCCCACACGCGGACGGACATTTTCATCCTTCACCGCTGATTGGTG<br>GGTTTGGACTGAAACACCCGCCTCCCCAGATATTCATCAAGAACACTCCCGTACC<br>TGCCAATCCTGCGACAACCTTCACTGCAGCCAGAGTGGACTCTTTCATCACACAA<br>TACAGCACCGGCCAGGTCGCTGTTCAGATTGAATGGGAAATTGAAAAGGAACGC<br>TCCAAACGCTGGAATCCTGAAGTGCAGTTTACTTCAAACTATGGGAACCAGTCTT<br>CTATGTTGTGGGCTCCTGATCAACTGGGAAGTATACAGAGCCGCGGGTTATTG<br>GCTCTCGTTATTTGACTAATCATTTGTAA |
| SEQ ID NO: 1417 | TTGCGACAGTTTGCGACACCATGTGGTCACAAGAGGTATATAACCGCGAGTGAG<br>CCAGCGAGGAGCTCCATTTTGCCCGCGAAGTTTGAACGAGCAGCAGCCATGCCG<br>GGGTTCTACGAGGTGGTGATCAAGGTGCCCAGCGACCTGGACGAGCACCTGCCC<br>GGCATTTCTGACTCCTTTGTGAACTGGGTGGCCGAGAAGGAATGGGAGTTGCCC<br>CCGGATTCTGACATGGATCAGAATCTGATTGAGCAGGCACCCCTGACCGTGGCC<br>GAGAAGCTGCAGCGCGAGTTCCTGGTGGAATGGCGCCGAGTGAGTAAATTTCTG<br>GAGGCCAAGTTTTTTGTGCAGTTTGAAAAGGGGGACTCGTACTTTCATTTGCATA<br>TTCTGATTGAAATTACCGGCGTGAAATCCATGGTGGTGGGCCGCTACGTGAGTC<br>AGATTAGGGATAAACTGATCCAGCGCATCTACCGCGGGGTCGAGCCCCAGCTGC<br>CCAACTGGTTCGCGGTTCACAAAGACCCGAAATGGCGCCGGAGGCGGGAACAAG<br>GTGGTGGACGAGTGCTACATCCCCAACTACCTGCTCCCCAAGGTCCAGCCCGAG<br>CTTCAGTGGGCGTGGACTAACATGGAGGAGTATATAAGCGCCTGTTTGAACCTC<br>GCGGAGCGTAAACGGCTCGTGGCGCAGCACCTGACGCACGTCTCCCAGACCCAG<br>GAGGGCGACAAGGAGAATCTGAACCCGAATTCTGACGCGCCGGTGATCCGGTCA<br>AAAACCTCCGCCAGGTACATGGAGCTGGTCGGGTGGCTGGTGGACAAGGGCATC<br>ACGTCCGAGAAGCAGTGGATCCAGGAGGACCAGGCCTCGTACATCTCCTTCAAC<br>GCGGCCTCCAACTCCCGGTCGCAGATCAAGGCGGCCCTGGACAATGCCTCCAAA<br>ATCATGAGCCTCACCAAAACGGCTCCGGACTATCTCATCGGGCAGCAGCCCGTG<br>GGGGACATTACCACCAACCGGATCTACAAAATCCTGAACTGAACGGGTACGAC<br>CCCCAGTACGCCGCCTCCGTCTTTCTCGGCTGGGCCCAGAAAAAGTTTGGAAAG<br>CGCAACACCATCTGGCTGTTTGGGCCGCCACCACCGGCAAGACCAACATCGCG<br>GAAGCCATCGCCCACGCGGTCCCCTTCTACGGCTGCGTCAACTGGACCAATGAG<br>AACTTTCCCTTCAACGACTGCGTCGACAAAATGGTGATTTGGTGGGAGGAGGGC<br>AAGATGACCGCCAAGGTCGTAGAGTCCGCCAAGGCCATTCTGGGCGGCAGCAAG<br>GTGCGCGTGGACCAAAAATGCAAGGCCTCTGCGCAGATCGACCCCACCCCCGTG<br>ATCGTCACCTCCAACACCAACATGTGCGCCGTGATTGACGGGAACAGCACCACC<br>TTCGAGCACCAGCAGCCCCTGCAGGACCGGATGTTCAAGTTTGAACTCACCCGC<br>CGCCTCGACCACGACTTTGGCAAGGTCACCAAGCAGGAAGTCAAGGACTTTTTC |

TABLE 7-continued

Nucleic Acid Sequences of Vectors

| SEQ ID NO | Sequence |
|---|---|
| | CGGTGGGCGGCTGATCACGTGACTGACGTGGCTCATGAGTTTTACGTCACAAAG<br>GGTGGAGCTAAGAAAAGGCCCGCCCCCTCTGACGAGGATATAAGCGAGCCCAA<br>GCGGCCGCGCGTGTCATTTGCGCAGCCGGAGACGTCAGACGCGGAAGCTCCGG<br>AGACTTCGCCGACAGGTACCAAAACAAATGTTCTCGTCACGCGGGTATGCTGCA<br>GATGCTCTTTCCCTGCAAGACGTGCGAGAGAATGAATCAGAATTCCAACGTCTG<br>CTTCACGCACGGTCAGAAAGATTGCGGGGAGTGCTTTCCCGGGTCAGAATCTCA<br>ACCGGTTTCTGTCGTCAGAAAAACGTATCAGAAACTGTGCATCCTTCATCAGCTC<br>CGGGGGGCACCCGAGATCGCCTGCTCTGCTTGCGACCAACTCAACCCCGATTTG<br>GACGATTGCCAATTTGAGCAATAAATGACTGAAATCAGGTATGGCTGCTGACGG<br>TTATCTTCCAGATTGGCTCGAGGACAACCTCTCTGAAGGCATTCGCGAGTGGTGG<br>GCGCTGAAACCTGGAGCTCCACAACCCAAGGCCAACCAACAGCATCAGGACAA<br>CGGCAGGGGTCTTGTGCTTCCTGGGTACAAGTACCTCGGACCCTTCAACGGACTC<br>GACAAGGGAGAGCCGGTCAACGAGGCAGACGCCGCGGCCCTCGAGGCACGACAA<br>GGCCTACGACAAGCAGCTCGAGCAGGGGGACAACCCGTATCTCAAGTACAACCA<br>CGCCGACGCCGAGTTCCAGCAGCGCTTGGCGACCGACACCTCTTTTGGGGGCAA<br>CCTCGGGCGAGCAGTCTTCCAGGCCAAAAAGAGGATTCTCGAGCCTCTGGGTCT<br>GGTTGAAGAGGGCGTTAAAACGGCTCCTGGAAAGAAACGCCCATTAGAAAAGA<br>CTCCAAATCGGCCGACCAACCCGGACTCTGGGAAGGCCCCGGCCAAGAAAAAG<br>CAAAAAGACGGCGAACCAGCCGACTCTGCTAGAAGGACACTCGACTTTGAAGAC<br>TCTGGAGCAGGAGACGGACCCCCTGAGGGATCATCTTCCGGAGAAATGTCTCAT<br>GATGCTGAGATGCGTGCGGCGCCAGGCGGAAATGCTGTCGAGGCGGGACAAGG<br>TGCCGATGGAGTGGGTAATGCCTCCGGTGATTGGCATTGCGATTCCACCTGGTCA<br>GAGGGCCGAGTCACCACCACCAGCACCCGAACCTGGGTCCTACCCACGTACAAC<br>AACCACCTGTACCTGCGAATCGGAACAACGGCCAACAGCAACACCTACAACGGA<br>TTCTCCACCCCCTGGGGATACTTTGACTTTAACCGCTTCCACTGCCACTTTTCCCC<br>ACGCGACTGGCAGCGACTCATCAACAACAACTGGGGACTCAGGCCGAAATCGAT<br>GCGTGTTAAAATCTTCAACATACAGGTCAAGGAGGTCACGACGTCAAACGGCGA<br>GACTACGGTCGCTAATAACCTTACCAGCACGGTTCAGATCTTTGCGGATTCGACG<br>TATGAACTCCCATACGTGATGGACGCCGGTCAGGAGGGGAGCTTTCCTCCGTTTC<br>CCAACGACGTCTTTATGGTTCCCCAATACGGATACTGCGGAGTTGTCACTGGAAA<br>AAACCAGAACCAGACAGACAGAAATGCCTTTTACTGCCTGGAATACTTTCCATC<br>CCAAATGCTAAGAACTGGCAACAATTTTGAAGTCAGTTACCAATTTGAAAAAGT<br>TCCTTTCCATTCAATGTACGCGCACAGCCAGAGCCTGGACAGAATGATGAATCCT<br>TTACTGGATCAGTACCTGTGGCATCTGCAATCGACCACTACCGGAAATTCCCTTA<br>ATCAAGGAACAGCTACCACCACGTACGGGAAAATTACCACTGGAGACTTTGCCT<br>ACTACAGGAAAAACTGGTTGCCTGGAGCCTGCATTAAACAACAAAATTTTCAA<br>AGAATGCCAATCAAAACTACAAGATTCCCGCCAGCGGGGAGACGCCCTTTTAA<br>AGTATGACACGCATACCACTCTAAATGGGCGATGAGTAACATGGCTCCTGGAC<br>CTCCAATGGCAACCGCAGGTGCCGGGGACTCGGATTTTAGCAACAGCCAGCTGA<br>TCTTTGCCGGACCCAATCCGAGCGGTAACACGACCACATCTTCAAACAATTTGTT<br>GTTTACCTCAGAAGAGGAGATTGCCACAACAAACCCACGAGACACGGACATGTT<br>TGGACAGATTGCAGATAATAATCAAATGCCACCACCGCCCCTCACATGCTAA<br>CCTGGACGCTATGGGAATTGTTCCCGAATGGTCTGGCAAAACAGAGACATCTA<br>CTACCAGGGCCCTATTTGGGCAAGGTCCCTCACACGGACGGACACTTTCACCCT<br>TCGCCGCTGATGGGAGGATTTGGACTGAAACACCCGCCTCCACAGATTTTCATCA<br>AAAACACCCCCGTACCCGCCAATCCCAATACTACCTTTAGCGCTGCAAGGATTA<br>ATTCTTTTCTGACGCAGTACAGCACCGGACAAGTTGCCGTTCAGATCGACTGGGA<br>AATTCAGAAGGAGCATTCCAAACGCTGGAATCCCGAAGTTCAATTTACTTCAAA<br>CTACGGCACTCAAAATTCTATGCTGTGGGCTCCCGACAATGCTGGCAACTACCAC<br>GAACTCCGGGCTATTGGGTCCCGTTTCCTCACCCACCACTTGTAA |
| SEQ ID<br>NO: 1418 | CCGCGAGTGAGCGAACCAGGAGCTCCATTTTGCCCGCGAATTTTGAACGAGCAG<br>CAGCCATGCCGGGATTCTACGAGATTGTCCTGAAGGTGCCCAGCGACCTGGACG<br>AGCACCTGCCTGGCATTTCTGACTCTTTTGTAAACTGGGTGGCGGAGAAGGAAT<br>GGGAGCTGCCGCCGGATTCTGACATGGATCTGAATCTGATTGAGCAGGCACCCC<br>TAACCGTGGCCGAAAAGCTGCAACGCGAATTCCTGGTCGAGTGGCGCCGCGTGA<br>GTAAGGCCCCGGAGGCCCTCTTCTTTGTTCAGTTCGAGAAGGGGGACAGCTACTT<br>CCACCTACACATTCTGGTGGAGACCGTGGGCGTGAAATCCATGGTGGTGGGCCG<br>CTACGTGAGCCAGATTAAAGAGAAGCTGGTGACCCGCATCTACCGCGGGGTCGA<br>GCCGCAGCTTCCGAACTGGTTCGCGGTGACCAAGACGCGTAATGGCGCCGGAGG<br>CGGGAACAAGGTGGTGGACGACTGCTACATCCCCAACTACCTGCTCCCAAGAC<br>CCAGCCCGAGCTCCAGTGGGCGTGGACTAATATGGACCAGTATTTAAGCGCCTG<br>TTTGAATCTCGCGGAGCGTAAACGGCTGGTGGCGCAGCATCTGACGCACGTGTC<br>GCAGACGCAGGAGCAGAACAAAGAGAACCAGAATCCCAATTCTGACGCGCCGG<br>TGATCAGATCAAAAACCTCCGCGAGGTACATGGAGCTGGTCGGGTGGCTGGTGG<br>ACCGCGGGATCACGTCAGAAAAGCAATGGATCCAGGAGGACCAGGCCTCTTACA<br>TCTCCTTCAACGCCGCCTCCAACTCGCGGTCACAAATCAAGGCCGCACTGGACA<br>ATGCCTCCAAATTTATGAGCCTGACAAAAACGGCTCCGGACTACCTGGTGGGAA<br>ACAACCCGCCGGAGGACATTACCAGCAACCGGATCTACAAAATCCTCGAGATGA<br>ACGGGTACGATCCGCAGTACGCGGCCTCCGTCTTCCTGGGCTGGGCGCAAAAGA<br>AGTTCGGGAAGAGGAACACCATCTGGCTCTTTGGGCCGGCCACGACGGGTAAA<br>CCAACATCGCTGAAGCTATCGCCCACGCCGTGCCCTTTTACGGCTGCGTGAACTG<br>GACCAATGAGAACTTTCCGTTCAACGATTGCGTCGACAAGATGGTGATCTGGTG<br>GGAGGAGGGCAAGATGACGGCCAAGGTCGTGGAGTCCGCCAAGGCCATTCTGG<br>GCGGAAGCAAGGTGCGCGTGGACCAAAAGTGCAAGTCATCGGCCCAGATCGAC<br>CCAACTCCCGTCATCGTCACCTCCAACACCAACATGTGCGCGGTCATCGACGGA |

TABLE 7-continued

Nucleic Acid Sequences of Vectors

| SEQ ID NO | Sequence |
|---|---|
| | AATTCCACCACCTTCGAGCACCAACAACCACTCCAAGACCGGATGTTCAAGTTC<br>GAGCTCACCAAGCGCCTGGAGCACGACTTTGGCAAGGTCACCAAGCAGGAAGTC<br>AAGGACTTTTTCCGGTGGGCGTCAGATCACGTGACTGAGGTGTCTCACGAGTTTT<br>ACGTCAGAAAGGGTGGAGCTAGAAAGAGGCCCGCCCCCAATGACGCAGATATA<br>AGTGAGCCCAAGCGGGCCTGTCCGTCAGTTGCGCAGCCATCGACGTCAGACGCG<br>GAAGCTCCGGTGGACTACGCGGACAGGTACCAAAACAAATGTTCTCGTCACGTG<br>GGCATGAATCTGATGCTTTTTCCCTGCCGGCAATGCGAGAGAATGAATCAGAAT<br>GTGGACATTTGCTTCACGCACGGGGTCATGGACTGTGCCGAGTGCTTCCCCGTGT<br>CAGAATCTCAACCCGTGTCTGTCGTCAGAAAGCGGACATATCAGAAACTGTGTC<br>CGATTCATCACATCATGGGGAGGGCGCCCGAGGTGGCTTGTTCGGCCTGCGATC<br>TGGCCAATGTGGACTTGGATGACTGTGACATGGAGCAATAAATGACTCAAACCA<br>GATATGACTGACGGTTACCTTCCAGATTGGCTAGAGGACAACCTCTCTGAAGGC<br>GTTCGAGAGTGGTGGGCGCTGCAACCTGGAGCCCCTAAACCCAAGGCAAATCAA<br>CAACATCAGGACAACGCTCGGGGTCTTGTGCTTCCGGGTTACAAATACCTCGGA<br>CCCGGCAACGGACTTGACAAGGGGGAACCCGTCAACGCAGCGGACGCGGCAGC<br>CCTCGAACACGACAAGGCCTACGACCAGCAGCTCAAGGCCGGTGACAACCCCTA<br>CCTCAAGTACAACCACGCCGACGCCGAGTTTCAGGAGCGTCTTCAAGAAGATAC<br>GTCTTTTGGGGGCAACCTCGGACGAGCAGTCTTCCAGGCCAAAAAGAGGATCCT<br>TGAGCCTCTGGGTCTGGTTGAGGAAGCGGCTAAGACGGCTCCTGGAAAAAAGAG<br>ACCTGTAGAGCAATCTCCAGCAGAACCGGACTCCTCTTCGGGCATCGGCAAATC<br>AGGCCAGCAGCCCGCTAGAAAAAGACTGAATTTTGGTCAGACTGGCGACACAGA<br>GTCAGTCCCAGACCCTCAACCACTCGGACAACCTCCCGCAGCCCCCTCTGGTGTG<br>GGATCTACTACAATGGCTTCAGGCGGTGGCGCACCAATGGCAGACAATAACGAG<br>GGTGCCGATGGAGTGGGTAATTCCTCAGGAAATTGGCATTGCGATTCCCAATGG<br>CTGGGCGACAGAGTCATCACCACCAGCACCCGCACCTGGGCCTGCCCACCTAC<br>AACAATCACCTCTACAAGCAAATCTCCAGCCAATCAGGAGCCACCAACGACAAC<br>CACTACTTTGGCTACAGCACCCCCTGGGGGTATTTTGACTTCAACAGATTCCACT<br>GCCACTTTTCACCACGTGACTGGCAAAGACTCATCAACAACAACTGGGGATTCC<br>GACCCAAGAGACTCAACTTCAAGCTCTTTAACATTCAAGTCAAAGAGGTCACGC<br>AGAATGACGGTACGACGACGATTGCCAATAACCTTACCAGCACGGTTCAGGTGT<br>TTACTGACTCCGAGTACCAGCTCCCGTACGTCCTCGGCTCGGCGCATCAGGGATG<br>CCTCCCGCCGTTCCCAGCAGACGTCTTCATGGTCCCACAGTATGGATACCTCACC<br>CTGAACAACGGGAGTCAGGCGGTAGGACGCTCTTCCTTTTACTGCCTGGAGTACT<br>TTCCTTCTCAGATGCTGCGTACTGGAAACAACTTTCAGTTTAGCTACACTTTTGA<br>AGACGTGCCTTTCCACAGCAGCTACGCTCACAGCCAAAGTCTGGACCGTCTCAT<br>GAATCCTCTGATCGACCAGTACCTGTACTATCTGAACAGGACACAAACAGCCAG<br>TGGAACTCAGCAGTCTCGGCTACTGTTTAGCCAAGCTGGACCCCACCAGTATGTCT<br>CTTCAAGCTAAAAACTGGCTGCCTGGACCTTGCTACAGACAGCAGCGTCTGTCA<br>AAGCAGGCAAACGACAACAACAACAGCAACTTTCCCTGGACTGGTGCCACCAAA<br>TATCATCTGAATGGCCGGGACTCATTGGTGAACCCGGGCCCTGCTATGGCCAGTC<br>ACAAGGATGACAAAGAAAAGTTTTTCCCCATGCATGGAACCCTGATATTTGGTA<br>AAGAAGGAACAAATGCCAACAACGCGGATTTGGAAAATGTCATGATTACAGAT<br>GAAGAAGAAATCCGCACCACCAATCCCGTGGCTACGGAGCAGTACGGGACTGTG<br>TCAAATAATTTGCAAAACTCAAACGCTGGTCCAACTACTGGAACTGTCAATCAC<br>CAAGGAGCGTTACCTGGTATGGTGTGGCAGGATCGAGACGTGTACCTGCAGGGA<br>CCCATTTGGGCCAAGATTCCTCACACCGATGACACTTTCATCCTTCTCCACTGA<br>TGGGAGGTTTTGGGCTCAAACACCCGCCTCCTCAGATCATGATCAAAAACACTC<br>CCGTTCCAGCCAATCCTCCCACAAACTTTAGTGCGGCAAAGTTTGCTTCCTTCAT<br>CACACAGTACTCCACGGGGCAGGTCAGCGTGGAGATCGAGTGGGAGCTGCAGA<br>AGGAGAACAGCAAACGCTGGAATCCCGAAATTCAGTACACTTCCAACTACAACA<br>AATCTGTTAATGTGGACTTTACTGTGGACACTAATGGTGTGTATTCAGAGCCTCG<br>CCCCATTGGCACCAGATACCTGACTCGTAATCTGTAATTGCTTGTTAATCAATAA<br>ACCGGTTAATTCG |
| SEQ ID<br>NO: 1419 | CCGCCATGCCGGGGTTTTACGAGATTGTGATTAAGGTCCCCAGCGACCTTGACG<br>AGCATCTGCCCGGCATTTCTGACAGCTTTGTGAACTGGGTGGCCGAGAAGGAAT<br>GGGAGTTGCCGCCAGATTCTGACATGGATCTGAATCTGATTGAGCAGGCACCCC<br>TGACCGTGGCCGAGAAGCTGCAGCGCGACTTTCTGACGGAATGGCGCCGTGTGA<br>GTAAGGCCCCGGAGGCCCTTTTCTTTGTGCAATTTGAGAAGGGAGAGAGCTACT<br>TCCACATGCACGTGCTCGTGGAAACCACCGGGGTGAAATCCATGGTTTTGGGAC<br>GTTTCCTGAGTCAGATTCGCGAAAAACTGATTCAGAGAATTTACCGCGGGATCG<br>AGCCGACTTTGCCAAACTGGTTCGCGGTCACAAAGACCAGAAATGGCGCCGGAG<br>GCGGGAACAAGGTGGTGGATGAGTGCTACATCCCCAATTACTTGCTCCCCAAAA<br>CCCAGCCTGAGCTCCAGTGGGCGTGGACTAATATGGAACAGTATTTAAGCGCCT<br>GTTTGAATCTCACGGAGCGTAAACGGTTGGTGGCGCAGCATCTGACGCACGTGT<br>CGCAGACGCAGGAGCAGAACAAAGAGAATCAGAATCCCAATTCTGATGCGCCG<br>GTGATCAGATCAAAAACTTCAGCCAGGTACATGGAGCTGGTCGGGTGGCTCGTG<br>GACAAGGGGATTACCTCGGAGAAGCAGTGGATCCAGGAGGACCAGGCCTCATA<br>CATCTCCTTCAATGCGGCCTCCAACTCGCGGTCCCAAATCAAGGCTGCCTTGGAC<br>AATGCGGGAAAGATTATGAGCCTGACTAAAACCGCCCCCGACTACCTGGTGGGC<br>CAGCAGCCCGTGGAGGACATTTCCAGCAATCGGATTTATAAAATTTTGGAACTA<br>AACGGGTACGATCCCCAATATGCGGCTTCCGTCTTTCTGGGATGGGCCACGAAA<br>AAGTTCGGCAAGAGGAACACCATCTGGCTGTTTGGGCCTGCAACTACCGGGAAG<br>ACCAACATCGCGGAGGCCATAGCCCACACTGTGCCCTTCTACGGGTGCGTAAAC<br>TGGACCAATGAGAACTTTCCCTTCAACGACTGTGTCGACAAGATGGTGATCTGGT<br>GGGAGGAGGGGAAGATGACCGCCAAGGTCGTGGAGTCGGCCAAAGCCATTCTC |

TABLE 7-continued

Nucleic Acid Sequences of Vectors

| SEQ ID NO | Sequence |
|---|---|
| | GGAGGAAGCAAGGTGCGCGTGGACCAGAAATGCAAGTCCTCGGCCCAGATAGA
CCCGACTCCCGTGATCGTCACCTCCAACACCAACATGTGCGCCGTGATTGACGG
GAACTCAACGACCTTCGAACACCAGCAGCCGTTGCAAGACCGGATGTTCAAATT
TGAACTCACCCGCCGTCTGGATCATGACTTTGGGAAGGTCACCAAGCAGGAAGT
CAAAGACTTTTTCCGGTGGGCAAAGGATCACGTGGTTGAGGTGGAGCATGAATT
CTACGTCAAAAAGGGTGGAGCCAAGAAAAGACCCGCCCCCAGTGACGCAGATA
TAAGTGAGCCCAAACGGGTGCGCGAGTCAGTTGCGCAGCCATCGACGTCAGACG
CGGAAGCTTCGATCAACTACGCAGACAGGTACCAAAACAAATGTTCTCGTCACG
TGGGCATGAATCTGATGCTGTTTCCCTGCAGACAATGCGAGAGAATGAATCAGA
ATTCAAATATCTGCTTCACTCACGGACAGAAAGACTGTTTAGAGTGCTTTCCCGT
GTCAGAATCTCAACCCGTTTCTGTCGTCAAAAAGGCGTATCAGAAACTGTGCTAC
ATTCATCATATCATGGGAAAGGTGCCAGACGCTTGCACTGCCTGCGATCTGGTCA
ATGTGGATTTGGATGACTGCATCTTTGAACAATAAATGATTTAAATCAGGTATGG
CTGCCGATGGTTATCTTCCAGATTGGCTCGAGGACACTCTCTCTGAAGGAATAAG
ACAGTGGTGGAAGCTCAAACCTGGCCCACCACCACCAAAGCCCGCAGAGCGGC
ATAAGGACGACAGCAGGGGTCTTGTGCTTCCTGGGTACAAGTACCTCGGACCCT
TCAACGGACTCGACAAGGGAGAGCCGGTCAACGAGGCAGACGCCGCGGCCCTC
GAGCACGACAAAGCCTACGACCGGCAGCTCGACAGCGGAGACAACCCGTACCT
CAAGTACAACCACGCCGACGCCGAGTTCCAGGAGCGGCTCAAAGAAGATACGTC
TTTTGGGGGCAACCTCGGGCGAGCAGTCTTCCAGGCCAAAAAGAGGCTTCTTGA
ACCTCTTGGTCTGGTTGAGGAAGCGGCTAAGACGGCTCCTGGAAAGAAGAGGCC
TGTAGAGCACTCTCCTGTGGAGCCAGACTCCTCCTCGGGAACCGGAAAGGCGGG
CCAGCAGCCTGCAAGAAAAAGATTGAATTTTGGTCAGACTGGAGACGCAGACTC
AGTCCCAGACCCTCAACCAATCGGAGAACCTCCCGCAGCCCCCTCAGGTGTGGG
ATCTCTTACAATGGCTGCAGGCGGTGGCGCACCAATGGCAGACAATAACGAGGG
CGCCGACGGAGTGGGTAATTCCTCGGGAAATTGGCATTGCGATTCCACATGGAT
GGGCGACAGAGTCATCACCACCAGCACCCGAACCTGGGCCCTGCCCACCTACAA
CAACCACCTCTACAAGCAAATCTCCAACAGCACATCTGGAGGATCTTCAAATGA
CAACGCCTACTTCGGCTACAGCACCCCCTGGGGGTATTTTGACTTTAACAGATTC
CACTGCCACTTTTCACCACGTGACTGGCAGCGACTCATCAACAACAACTGGGGA
TTCCGGCCCAAGAGACTCAGCTTCAAGCTCTTCAACATCCAGGTCAAGGAGGTC
ACGCAGAATGAAGGCACCAAGACCATCGCCAATAACCTCACCAGCACCATCCAG
GTGTTTACGGACTCGGAGTACCAGCTGCCGTACGTTCTCGGCTCTGCCCACCAGG
GCTGCCTGCCTCCGTTCCCGGCGGACGTGTTCATGATTCCCCAGTACGGCTACCT
AACACTCAACAACGGTAGTCAGGCCGTGGGACGCTCCTCCTTCTACTGCCTGGA
ATACTTTCCTTCGCAGATGCTGAGAACCGGCAACAACTTCCAGTTTACTTACACC
TTCGAGGACGTGCCTTTCCACAGCAGCTACGCCCACAGCCAGAGCTTGGACCGG
CTGATGAATCCTCTGATTGACCAGTACCTGTACTACTTGTCTGGACTCAAACAA
CAGGAGGCACGACAAATACGCAGACTCTGGGCTTCAGCCAAGGTGGGCCTAATA
CAATGGCCAATCAGGCAAAGAACTGGCTGCCAGGACCCTGTTACCGCCAGCAGC
GAGTATCAAAGACATCTGCGGATAACAACAACAGTGAATACTCGTGGACTGGAG
CTACCAAGTACCACCTCAATGGCAGAGACTCTCTGGTGAATCCGGGCCCGGCCA
TGGCAAGCCACAAGGACGATGAAGAAAAGTTTTTTCCTCAGAGCGGGGTTCTCA
TCTTTGGGAAGCAAGGCTCAGAGAAAACAAATGTGGACATTGAAAAGGTCATGA
TTACAGACGAAGAGGAAATCAGGACAACCAATCCCGTGGCTACGGAGCAGTAT
GGTTCTGTATCTACCAACCTCCAGAGAGGCAACAGACAAGCAGCTACCGCAGAT
GTCAACACACAAGGCGTTCTTCCAGGCATGGTCTGGCAGGACAGAGATGTGTAC
CTTCAGGGGCCCATCTGGGCAAAGATTCCACACACGGACGGACATTTTCACCCC
TCTCCCCTCATGGGTGGATTCGGACTTAAACACCCTCCGCCTCAGATCCTGATCA
AGAACACGCCTGTACCTGCGGATCCTCCGACCACCTTCAACCAGTCAAGCTGA
ACTCTTTCATCACCCAGTATTCTACTGGCCAAGTCAGCGTGGAGATCGAGTGGGA
GCTGCAGAAGGAAAACAGCAAGCGCTGGAACCCCGAGATCCAGTACACCTCCA
ACTACTACAAATCTACAAGTGTGGACTTTGCTGTTAATACAGAAGGCGTGTACTC
TGAACCCCGCCCCATTGGCACCCGTTACCTCACCCGTAATCTGTAATTGCCTGTT
AATCAATAAACCGGTTGATTCGTTTCAGTTGAACTTTGGTCTCTGCGAAGGGCGA
ATTCGTTTAAACCTGCAGGACTAGAGGTCCTGTATTAGAGGTCACGTGAGTGTTT
TGCGACATTTTGCGACACCATGTGGTCACGCTGGGTATTTAAGCCCGAGTGAGC
ACGCAGGGTCTCCATTTTGAAGCGGGAGGTTTGAACGCGCAGCCGCCAAGCCGA
ATTCTGCAGATATCCATCACACTGGCGGCCGCTCGACTAGAGCGGCCGCCACCG
CGGTGGAGCTCCAGCTTTTGTTCCCTTTAGTGAGGGTTAATTGCGCGCTTGGCGT
AATCATGGTCATAGCTGTTTCCTGTGTGAAATTGTTATCCGCTCACAATTCCACA
CAACATACGAGCCGGAAGCATAAAGTGTAAAGCCTGGGGTGCCTAATGAGTGA
GCTAACTCACATTAATTGCGTTGCGCTCACTGCCCGCTTTCCAGTCGGGAAACCT
GTCGTGCCAGCTGCATTAATGAATCGGCCAACGCGCGGGGAGAGGCGGTTTGCG
TATTGGGCGCTCTTCCGCTTCCTCGCTCACTGACTCGCTGCGCTCGGTCGTTCGGC
TGCGGCGAGCGGTATCAGCTCACTCAAAGGCGGTAATACGGTTATCCACAGAAT
CAGGGGATAACGCAGGAAAGAACATGTGAGCAAAAGGCCAGCAAAAGGCCAGG
AACCGTAAAAAGGCCGCGTTGCTGGCGTTTTTCCATAGGCTCCGCCCCCCTGACG
AGCATCACAAAAATCGACGCTCAAGTCAGAGGTGGCGAAACCCGACAGGACTA
TAAAGATACCAGGCGTTTCCCCCTGGAAGCTCCCTCGTGCGCTCTCCTGTTCCGA
CCCTGCCGCTTACCGGATACCTGTCCGCCTTTCTCCCTTCGGGAAGCGTGGCGCT
TTCTCATAGCTCACGCTGTAGGTATCTCAGTTCGGTGTAGGTCGTTCGCTCCAAG
CTGGGCTGTGTGCACGAACCCCCCGTTCAGCCCGACCGCTGCGCCTTATCCGGTA
ACTATCGTCTTGAGTCCAACCCGGTAAGACACGACTTATCGCCACTGGCAGCAG
CCACTGGTAACAGGATTAGCAGAGCGAGGTATGTAGGCGGTGCTACAGAGTTCT
TGAAGTGGTGGCCTAACTACGGCTACACTAGAAGAACAGTATTTGGTATCTGCG |

TABLE 7-continued

Nucleic Acid Sequences of Vectors

| SEQ ID NO | Sequence |
|---|---|
| | CTCTGCTGAAGCCAGTTACCTTCGGAAAAAGAGTTGGTAGCTCTTGATCCGGCA<br>AACAAACCACCGCTGGTAGCGGTGGTTTTTTTGTTTGCAAGCAGCAGATTACGCG<br>CAGAAAAAAAGGATCTCAAGAAGATCCTTTGATCTTTTCTACGGGGTCTGACGC<br>TCAGTGGAACGAAAACTCACGTTAAGGGATTTTGGTCATGAGATTATCAAAAAG<br>GATCTTCACCTAGATCCTTTTAAATTAAAAATGAAGTTTTAAATCAATCTAAAGT<br>ATATATGAGTAAACTTGGTCTGACAGTTACCAATGCTTAATCAGTGAGGCACCTA<br>TCTCAGCGATCTGTCTATTTCGTTCATCCATAGTTGCCTGACTCCCCGTCGTGTAG<br>ATAACTACGATACGGGAGGGCTTACCATCTGGCCCCAGTGCTGCAATGATACCG<br>CGAGACCCACGCTCACCGGCTCCAGATTTATCAGCAATAAACCAGCCAGCCGGA<br>AGGGCCGAGCGCAGAAGTGGTCCTGCAACTTTATCCGCCTCCATCCAGTCTATTA<br>ATTGTTGCCGGGAAGCTAGAGTAAGTAGTTCGCCAGTTAATAGTTTGCGCAACG<br>TTGTTGCCATTGCTACAGGCATCGTGGTGTCACGCTCGTCGTTTGGTATGGCTTC<br>ATTCAGCTCCGGTTCCCAACGATCAAGGCGAGTTACATGATCCCCCATGTTGTGC<br>AAAAAAGCGGTTAGCTCCTTCGGTCCTCCGATCGTTGTCAGAAGTAAGTTGGCC<br>GCAGTGTTATCACTCATGGTTATGGCAGCACTGCATAATTCTCTTACTGTCATGC<br>CATCCGTAAGATGCTTTTCTGTGACTGGTGAGTACTCAACCAAGTCATTCTGAGA<br>ATAGTGTATGCGGCGACCGAGTTGCTCTTGCCCGGCGTCAATACGGGATAATAC<br>CGCGCCACATAGCAGAACTTTAAAAGTGCTCATCATTGGAAAACGTTCTTCGGG<br>GCGAAAACTCTCAAGGATCTTACCGCTGTTGAGATCCAGTTCGATGTAACCCACT<br>CGTGCACCCAACTGATCTTCAGCATCTTTTACTTTCACCAGCGTTTCTGGGTGAG<br>CAAAAACAGGAAGGCAAAATGCCGCAAAAAAGGGAATAAGGGCGACACGGAA<br>ATGTTGAATACTCATACTCTTCCTTTTTCAATATTATTGAAGCATTTATCAGGGTT<br>ATTGTCTCATGAGCGGATACATATTTGAATGTATTTAGAAAAATAAACAAATAG<br>GGGTTCCGCGCACATTTCCCCGAAAAGTGCCACCTAAATTGTAAGCGTTAATATT<br>TGTTAAAATTCGCGTTAAATTTTTGTTAAATCAGCTCATTTTTTAACCAATAGGC<br>CGAAATCGGCAAAATCCCTTATAAATCAAAAGAATAGACCGAGATAGGGTTGAG<br>TGTTGTTCCAGTTTGGAACAAGAGTCCACTATTAAAGAACGTGGACTCCAACGTC<br>AAAGGGCGAAAAACCGTCTATCAGGGCGATGGCCCACTACGTGAACCATCACCC<br>TAATCAAGTTTTTTGGGGTCGAGGTGCCGTAAAGCACTAAATCGGAACCCCTAAA<br>GGGAGCCCCCGATTTAGAGCTTGACGGGGAAAGCCGGCGAACGTGGCGAGAAA<br>GGAAGGGAAGAAAGCGAAAGGAGCGGGCGCTAGGGCGCTGGCAAGTGTAGCGG<br>TCACGCTGCGCGTAACCACCACACCCGCCGCGCTTAATGCGCCGCTACAGGGCG<br>CGTCCCATTCGCCATTCAGGCTGCGCAACTGTTGGGAAGGGCGATCGGTGCGGG<br>CCTCTTCGCTATTACGCCAGCTGGCGAAAGGGGGATGTGCTGCAAGGCGATTAA<br>GTTGGGTAACGCCAGGGTTTTCCCAGTCACGACGTTGTAAAACGACGGCCAGTG<br>AGCGCGCGTAATACGACTCACTATAGGGCGAATTGGGTACCGGGCCCCCCCTCG<br>ATCGAGGTCGACGGTATCGGGGAGCTCGCAGGGTCTCCATTTTGAAGCGGGAG<br>GTTTGAACGCGCAG |
| SEQ ID<br>NO: 1420 | CATCATCAATAATATACCCCACAAAGTAAACAAAAGTTAATATGCAAATGAGCT<br>TTTGAATTTTAACGGTTGTGGGGCGGAGCCAACGCTGATTGGACGAGAAGCGGT<br>GATGCAAATAACGTCACGACGCACGGCTAATGGCCGGCGCGGAGGCGTGGCCTA<br>GGCCGGAAGCAAGTCGCGGGGCTGATGACGTATAAAAAAGCGGACTTTAGACC<br>CGGAAACGGCCGATTTTCCCGCGGCCACGCCCGGATATGAGGTAATTCTGGGCG<br>GATGCAAGTGAAATTAGGTCATTTTGGCGCCAAAACTGAATGAGGAAGTGAAAA<br>GTGAAAAATACCTGTCCCGCCCAGGGCGGAATATTTACCGAGGGCCGAGAGACT<br>TTGACCGATTACGTGGGGTTTCGATTGCGGTGTTTTTTTCGCGAATTTCCGCGTCC<br>GTGTGAAAGTCCGGTGTTTATGTCACAGATCAGCTGATCCACAGGGTATTTAAAC<br>CAGTTGAGCCCGTCAAGAGGCCACTCTTGAGTGCCAGCGAGTAGAGATTTCTCT<br>GAGCTCTGCTCCCAGAGTCTAAAAAAAATGAGACACCTGCGCCTTCTGTCTTCAA<br>CTGTGCCTATTAACATGGCCGCATTATTGCTGGAGGACTATGTGAGTACAGTATT<br>GGAGGACGAACTACATCCATCTCCATTTGAGCTGGGACCTACACTTCAGGACCTT<br>TATGATTTGGAGGTAGATGCCCATGATGACGACCCAAACGAAGAGGCTGTGAAT<br>TTAATATTTCCAGAATCTCTGATTCTTCAGGCTAACATAGCCAGCGAAGCTGTAC<br>CTACACCACTTCATACACCGACTCTGTCACCCATACCTGAATTGGAAGAGGAGG<br>ACGAGCTAGACCTCCGATGTTATGAGGAAGGTTTTCCTCCCAGCGATTCAGAGG<br>ACGAACAGGGTGAGCAGAGCATGGCTGTAATCTCAGAATATGCTTGTGTGGTTG<br>TGGAAGAGCATTTTGTGTTGGACAATCCTGAGGTGCCCGGGCAAGGCTGTAGAT<br>CCTGCCAGTACCACCGGGATAAGACCGGAGACACGAACGCCTCCTGCGCTCTGT<br>GTTACATGAAAAAGAACTTCAGCTTTATTTACAGTAAGTGGAGTGAATGTGAGA<br>GAGGCGAGTGCTTAACACATAACTGGGTGATGCTTAAACAGCTGTGCTAAGTGT<br>GGTTTATTTTTGTTTCTAGGTCCGGTGTCAGAGGATGAGTCATCACCCTCAGAAG<br>AAGACCACCCGTGTCCCCCTGAGCTGTCAGGCGAAACGCCCCTGCAAGTGCACA<br>GACCCACCCCAGTCAGACCCAGTGGCGAGAGGCGAGCAGCTGTTGAAAAAATTG<br>AGGACTTGTTACATGACATGGGTGGGATGAACCTTTGGACCTGAGCTTGAAAC<br>GCCCCAGGAACTAGGCTCAGCTGTGCTTAGTCATGTGTAAATAAAGTTGTACAA<br>TAAAAGTATATGTGACGCATGCAAGGTGTGGTTCATGATTCATGGGCGGGGCTT<br>ATTCCTATATAAGTGGCAACACCTGGGCACTGGGGCACAGACCTTTAGGGAGTT<br>CCTGATGGATGTGTGGACTATCCTTGCAGACTTTAGCAAGACACGCCGACTTGTA<br>GAGGATAGTTCAGACGGGTGCTCCGGGTTCTGGAGACACTGGTTTGGAACTCCT<br>CTATCTCGTCTGGTGTACACAGTTAAGAAGGATTATAACGAGGAATTTGAAAAT<br>CTTTTTGCTGATTGCTCTGGCCTGCTAGATTCTCTGAATCTCGGCCACCAGTCCCT<br>TTTCAGGAAAGGGTACTCCACAGCCTTGATTTTTCCAGCCCAGGGCGCACTACA<br>GCCGGGGTTGCTTTTGTGGTTTTTCTGGTTGACAAATGGAGCCAGAACACCCAAC<br>TGAGCAGGGGCTACATTCTGGACTTTGCAGCCATGCACCTGTGGAGGGCATGGG<br>TGAGGCAGCGGGGACAGAGAATCTTGAACTACTGGCTTATACAGCCAGCAGCTC |

TABLE 7-continued

Nucleic Acid Sequences of Vectors

SEQ ID NO Sequence

```
CGGGTCTTCTTCGTCTACACAGACAAACATCCATGTTGGAGGAAGAAATGAGGC
AGGCCATGGACGAGAACCCGAGGAGCGGCCTGGACCCTCCGTCGGAAGAGGAG
CTGGATTGAATCAGGTATCCAGCTTGTACCCAGAGCTTAGCAAGGTGCTGACAT
CCATGGCCAGGGGAGTGAAGAGGGAGAGGAGCGATGGGGGCAATACCGGGATG
ATGACCGAGCTGACGGCCAGCCTGATGAATCGCAAGCGCCCAGAGCGCATTACC
TGGCACGAGCTACAGATGGAGTGCAGGGATGAGTTGGGCCTGATGCAGGATAA
ATATGGCCTGGAGCAGATAAAAACACATTGGTTGAACCCAGATGAGGATTGGGA
GGAGGCCATTAAGAAATATGCCAAGATAGCCCTGCGCCCAGATTGCAAGTACAT
AGTGACCAAGACCGTGAATATTAGACATGCCTGCTACATTTCGGGGAACGGGGC
AGAGGTGGTCATCGATACCCTGGACAAGGCCGCCTTCAGGTGTTGCATGATGGG
AATGAGAGCAGGAGTGATGAATATGAATTCCATGATCTTCATGAACATGAAGTT
CAATGGAGAGAAGTTTAATGGGGTGCTGTTCATGGCCAACAGCCACATGACCCT
GCATGGCTGCAGTTTCTTTGGCTTTAACAATATGTGCGCCGAGGTCTGGGGCGCT
TCCAAGATCAGGGGATGTAAGTTTTATGGCTGCTGGATGGGCGTGGTCGGAAGA
CCCAAGAGCGAGATGTCTGTAAAGCAGTGTGTGTTTGAGAAATGCTACCTGGGA
GTCTCTACCGAGGGCAATGCTAGAGTGAGACACTGCTCTTCCCTGGATACGGGC
TGCTTCTGCCTGGTGAAGGGTACGGCCTCTCTAAAGCATAATATGGTGAAGGGC
TGCACAGATGAGCGCATGTACAACATGCTGACCTGCGACTCGGGGGTCTGCCAT
ATCCTGAAGAACATCCATGTGACCTCCCACCCCAGAAAGAAGTGGCCAGTGTTT
GAGAATAACCTGCTGATCAAGTGCCATATGCACCTGGGTGCCAGAAGGGCACCC
TTCCAGCCGTACCAGTGCAACTTTAGCCAGACCAAGCTGCTGTTGGAGAACGAT
GCCTTCTCCAGGGTGAACCTGAACGGCATCTTTGACATGGATGTCTCGGTGTACA
AGATCCTGAGATACGATGAGACCAAGTCCAGGGTGCGCGCTTGCGAGTGCGGGG
GCAGACACACCAGGATGCAGCCAGTGGCCCTGGATGTGACCGAGGAGCTGAGA
CCAGACCACCTGGTGATGGCCTGTACCGGGACCGAGTTCAGCTCCAGTGGGGAG
GACACAGATTAGAGGTAGGTTTGAGTAGTGGGCGTGGCTAATGTGAGTATAAAG
GCGGGTGTCTTACGAGGGTCTTTTTGCTTTTCTGCAGACATCATGAACGGGACCG
GCGGGGCCTTCGAAGGGGGGCTTTTTAGCCCTTATTTGACAACCCGCCTGCCGGG
ATGGGCCGGAGTTCGTCAGAATGTGATGGGATCGACGGTGGACGGGCGCCCAGT
GCTTCCAGCAAATTCCTCGACCATGACCTACGCGACCGTGGGGAACTCGTCGCTC
GACAGCACCGCCGCAGCCGCGGCAGCCGCAGCCGCCATGACAGCGACGAGACT
GGCCTCGAGCTACATGCCCAGCAGCAGCAGTAGCCCCTCTGTGCCCAGTTCCATC
ATCGCCGAGGAGAAACTGCTGGCCCTGCTGGCCGAGCTGGAAGCCCTGAGCGT
CAGCTGGCCGCCCTGACCCAGCAGGTGTCCGAGCTCCGCGAACAGCAGCAGCAG
CAAAATAAATGATTCAATAAACACAGATTCTAATTCAAACAGCAAAGTATCTTT
ATTATTTATTTTTTCGCGCGCGATAGGCCCTGGTCCACCTCTCCCGATCATTGAG
AGTGCGGTGGATTTTTTCCAGGACCCGGTAGAGGTGGGATTGGATGTTAAGGTA
CATGGGCATGAGCCCGTCCCGGGGGTGGAGGTAGCACCACTGCATGGCCTCGTG
CTCTGGGGTCGTGTTGTAGATGATCCAGTCATAGCAGGGGCGCTGGGCGTGGTG
CTGGATGATGTCCTTGAGGAGGAGACTAATGCCACGGGGAGCCCCTTGGTGTA
GGTGTTGGCGAAGCGGTTGAGCTGGGAGGGATGCATGCGGGGGAGATGATGT
GCAGTTTGGCCTGGATCTTGAGGTTGGCGATGTTGCCACCCAGATCCCGCCGGG
GGTTCATGTTGTGCAGGACCACCAGAACGGTGTAGCCCGTGCACTTGGGGAACT
TGTCATGCAACTTGGAAGGGAATGCGTGGAAGAATTTGGAGACGCCCTTGTGCC
CGCCCAGGTTTTCCATGCACTCATCCATGATGATGGCGATGGGCCCGTGGGCTGC
GGCTTTGGCAAAGACGTTTCTGGGGTCAGAGACATCATAATTTATGCTCCTGGGTG
AGATCATCATAAGACATTTTAATGAATTTGGGCGGAGGGTGCCAGATTGGGGG
ACGATGGTTCCCTCGGGCCCCGGGGCGAAGTTCCCCTCGCAGATCTGCATCTCCC
AGGCTTTCATCTCGGAGGGGGGATCATGTCCACCTGCGGGCGATGAAAAAAA
CGGTTTCCGGGGCGGGGTGATTAGCTGCGAGGAGAGCAGGTTTTCTCAACAGCT
GGGACTTGCCGCACCCGGTCGGGCCGTAGATGACCCCGATGACTGGTTGCAGGT
GGTAGTTCAAGGAGATGCAGCTGCCGTCGTCCCGGAGAAGGGGGCCACCTCGT
TGAGCATGTCCCTGACTTGGAGGTTTTCCCGGACGAGCTCGCCAAGGAGGCGGT
CCCCGCCCAGCGAGAGCAGCTCTTGCAGGGAAGCAAAGTTTTTCAGTGGCTTGA
GCCCGTCGGCCATGGGCATCTTGGCGAGGGTCTGCGAGAGGAGCTCGAGGCGGT
CCCAAAGCTCGGTGACGTGCTCTACGGCATCTCGATCCAGCAGACTTCCTCGTTT
CGGGGGTTGGGACGACTGCGACTGTAGGGCACGAGACGATGGGCGTCCAGCGCT
GCCAACGTCATGTCCTTCCAGGGTCTCAGGGTCCGCGTGAGCGTGGTCTCCGTCA
CGGTGAAGGGGTGGGCCCCGGGCTGGGCGCTTGCAAGGGTGCGCTTGAGACTCA
TCCTGCTGGTGCTGAAACGGGCACGGTCTTCGCCCTGCGCGTCGGCGAGATAGC
AGTTGACCATAAGCTCGTAGTTAAGGGCCTCGGCGGCGTGCCCTTGGCGCGGA
GCTTGCCCTTGGAAGAGTGACCGCAGGCGGGACAGAGGATGGATTGCAGGGCGT
AGAGCTTGGGTGCAAGAAAGACGGACTCGGGGGCGAAGGCGTCCGCTCCGCAG
TGGGCGCAGACGGTCTCGCACTCGACGAGCCAGGTGAGCTCGGGGTGTTCGGGG
TCAAAAACCAGTTTTCCCCCGTTCTTTTTGATGCGCTTCTTACCTCGCGTCTCCAT
GAGTCTGTGTCCGCGCTCGGTGACAAACAGGCTGTCTGTGTCCCCGTAGACGGA
CTTGATGGGCCTGTCCTGCAGGGGCGTCCCGCGGTCCTCCTTCGTAGAGAAACTCG
GACCACTCTGAGACGAAGGCGCGCGTCCACGCCAAGACAAAGGAGGCCACGTG
CGAGGGGTAGCCGGTCGTTGTCCACCAGGGGGTCCACCTTTTCCACCGTGTGCAG
ACACATGTCCCCCTCCTCCGCATTCAAGAAGGTGATTGGCTTGTAGGTGTAGGCC
ACGTGACCGGGGTCCCCGACGGGGGGTATAAAAGGGGCGGGTCTGTGCTC
GTCCTCACTCTCTTCCGCGTCGCTGTCCACGAGCGCCAGCTGTTGGGGTAGGTAT
TCCCTCTCGAGAGCGGGCATGACCTCGGCACTCAGGTTGTCAGTTTCTAGAAACG
AGGAGGATTTGATGTTGGCCTGCCCTGCCGCAATGCTTTTTAGGAGACTTTCATC
CATCTGGTCAGAAAAAACTATTTTTTTATTGTCAAGCTTGGTGGCGAAGGAGCCA
TAGAGGGCGTTGGAGAGAAGCTTGGCGATGGATCTCATGGTCTGATTTTTGTCAC
```

TABLE 7-continued

Nucleic Acid Sequences of Vectors

| SEQ ID NO | Sequence |
|---|---|
| | GGTCGGCGCGCTCCTTGGCCGCGATGTTGAGCTGGACATATTCGCGCGCGACAC |
| | ACTTCCATTCGGGAAAGACGGTGGTGCGCTCGTCGGGCACGATCCTGACGCGCC |
| | AGCCGCGGTTATGCAGGGTGACCAGGTCAACGCTGGTGGCCACCTCGCCGCGCA |
| | GGGGCTCGTTGGTCCAGCAGAGTCTGCCGCCCTTGCGCGAGCAGAAAGGGGGCA |
| | GTACATCAAGTAGATGCTCGTCAGGGGGGTCCGCATCGATGGTGAAGATACCGG |
| | GACAGAGTTCCTTGTCAAAATAGTCTATTTTTGAGGATGCATCATCCAAGGCCAT |
| | CTGCCACTCGCGGGCGGCCATCGCTCGCTCGTAGGGGTTGAGGGGCGGACCCCA |
| | GGGCATGGGATGCGTGAGGGCGGAGGCGTACATGCCGCAGATGTCATAGACAT |
| | AGATGGGCTCCGAGAGGATGCCGATGTAGGTGGGATAACAGCGCCCCCCGCGG |
| | ATGCTGGCGCGCACATAGTCATACAACTCGTGCGAGGGGGCCAAGAAGGCGGG |
| | GCCGAGATTGGTGCGCTGGGGCTGCTCGGCGCGGAAGACGATCTGGCGAAAGAT |
| | GGCATGCGAGTTGGAGGAGATGGTGGGCCGTTGGAAGATGTTAAAGTGGGCGTG |
| | CGGCAGTCGGACCGAGTCGCGGATAAAGTGCGCGTAGGAGTCTTGCAGCTTGGC |
| | GACGAGCTCGGCGGTGACAAGGACGTCCATGGCGCAGTAGTCCAGCGTTTCGCG |
| | GATGATGTCATAACCCGCCTCTCCTTTCTTCTCCCACAGCTCGCGGTTGAGAGCG |
| | TACTCCTCGTCATCCTTCCAGTACTCCCGGAGCGGGAATCCTCGATCGTCCGCAC |
| | GGTAAGAGCCCAGCATGTAGAAATGGTTCACGGCCTTGTAGGGACAGCAGCCCT |
| | TCTCCACGGGGAGGGCGTAAGCTTGAGCGGCCTTGCGGAGCGAGGTGTGCGTCA |
| | GGGCGAAGGTGTCCCTGACCATGACTTTCAAGAACTGGTACTTGAAGTCCGAGT |
| | CGTCGCAGCCGCCGTGCTCCCAGAGCTCGAAATCGGTGCGCTTCTTCGAGAGGG |
| | GGTTAGGCAGAGCGAAAGTGACGTCATTGAAGAGAATCTTGCCTGCTCGCGGCA |
| | TGAAATTGCGGGTGATGCGGAAAGGGCCCGGAACGGAGGCTCGGTTGTTGATGA |
| | CCTGGGCGGCGAGGACGATCTCGTCGAAGCCGTTGATGTTGTGCCCGACGATGT |
| | AGAGTTCCATGAATCGCGGGCGGCCTTTGATGTGCGGCAGCTTTTTGAGCTCATC |
| | GTAGGTGAGGTCCTCGGGGCATTGCAGGCCGTGCTGTTCGAGCGCCAACTCCTG |
| | GAGATGTGGGTTGGCTTGCATGAAGGAAGCCCAGAGCTCGCGGGCCATGAGGGT |
| | CTGGAGCTCGTCGCGAAAGAGGCGGAACTGCTGGCCCACGGCCATCTTTTCGGG |
| | TGTGACGCAGTAGAAGGTGAGGGGGTCCCGCTCCCAGCGATCCCAGCGTAAGCG |
| | CGCGGCGAGATCGCGAGCGAGGGCGACCAGCTCGGGGTCCCCCGAGAATTTCAT |
| | GACCAGCATGAAGGGGACGAGCTGCTTGCCGAAGGACCCCATCCAGGTGTAGGT |
| | TTCTACATCGTAGGTGACAAAGAGCCGCTCCGTGCGAGGATGAGAGCCGATTGG |
| | GAAGAATTGGATTTCCTGCCACCAGTTGGACGAGTGGCTGTTGATGTGATGAAA |
| | GTAGAAATCCCGCCGGCGAACCGAGCACTCGTGCTGATGCTTGTAAAAGCGTCC |
| | GCAGTACTCGCAGCGCTGCACGGGCTGTACCTCATCCACGAGATACACAGCGCG |
| | TCCCTTGAGGAGGAACTTCAGGAATGGCGGCCCTGGCTGGTGGTTTTCATGTTCG |
| | CCTGCGTGGGACTCACCCTGGGGCTCCTCGAGGACGGAGAGGCTGACGAGCCCG |
| | CGCGGCAGCCAGGTCCAGATCTCGGCGCGGCGGGGCGGAGAGCGAAGACGAG |
| | GGCGCGCAGTTGGGAGCTGTCCATGGTGTCGCGGAGATCCAGGTCCGGGGGCAG |
| | GGTTCTGAGGTTGACCTCGTAGAGGCGGGTGAGGGCGTGCTTGAGATGCAGATG |
| | GTACTTGATCTCCACGGGTGAGTTGGTGGTCGTGTCCACGCATTGCATGAGCCCG |
| | TAGCTGCGCGGGGCCACGACCGTGCCGCGGTGCGCTTTTAGAAGCGGTGTCGCG |
| | GACGCGCTCCCGGCGGCAGCGGCGGTTCCGGCCCCGCGGGCAGGGGCGGCAGA |
| | GGCACGTCGGCGTGGCGCTCGGGCAGGTCCCGGTGCTGCGCCCTGAGAGCGCTG |
| | GCGTGCGCGACGACGCGGCGGTTGACATCCTGGATCTGCCGCCTCTGCGTGAAG |
| | ACCACTGGCCCCGTGACTTTGAACCTGAAAGACAGTTCAACAGAATCAATCTCG |
| | GCGTCATTGACGGCGGCCTGACGCAGGATTTCTTGCACGTCGCCCGAGTTGTCCT |
| | GGTAGGCGATCTCGGACATGAACTGCTCGATCTCCTCCTCCTGGAGATCGCCGCG |
| | GCCCGCGCGCTCGACGGTGGCGGCGAGGTCATTCGAGATGCGACCCATGAGCTG |
| | CGAGAAGGCGCCCAGGCCGCTCTCGTTCCAGACGCGGCTGTAGACCACGTCCCC |
| | GTCGGCGTCGCGCGCGCATGACCACCTGCGCGAGGTTGAGCTCCACGTGCCG |
| | CGCGAAGACGGCATAGTTGCGCAGGCGTTGGAAGAGGTAGTTGAGGGTGGTGG |
| | CGATGTGCTCGGTGACGAAGAAGTACATAATCCAGCGGCGCAGGGGCATTTCGC |
| | TGATGTCGCCAATGGCCTCCAGCCTTTCCATGGCCTCGTAGAAATCCACGGCGAA |
| | GTTGAAAAACTGGGCGTTGCGGGCCGAGACCGTGAGCTCGTCTTCCAGGAGCCT |
| | GATGAGTTCGGCGATGGTGGCGCGCACCTCGCGCTCGAAATCCCCGGGGGCCTC |
| | CTCCTCTTCCTCTTCTTCCATGACGACCTCTTCTTCTATTTCTTCCTCTGGGGGCG |
| | GTGGTGGTGGCGGGGCCCGACGACGACGGCGACGCACCGGGAGACGGTCGACG |
| | AAGCGCTCGATCATCTCCCCGCGGCGGCGACGCATGGTTTCGGTGACGGCGCGA |
| | CCCCGTTCGCGAGGACGCAGCGTGAAGACGCCACCGGTCATCTCCCGGTAATGG |
| | GGTGGGTCCCCGTTGGGCAGCGATAGGGCGCTGACAATGCATCTTATCAATTGC |
| | GGTGTAGGGCACGTGAGCGCGTCGAGATCGACCGGATCGGAGAATCTTTCGAGG |
| | AAAGCGTCTAGCCAATCGCAGTCGCAAGGTAAGCTCAAACACGTAGCAGCCCTG |
| | TGGACGCTGTTAGAATTGCGGTTGCTGATGATGTAATTGAAGTAGGCGTTTTTGA |
| | GGCGGCGGATGGTGGCGAGGAGGACCAGGTCCTTGGGTCCCGCTTGCTGGATGC |
| | GGAGCCGCTCGGCCATGCCCAGGCCTGGCCCTGACACCGGCTCAGGTTCTTGT |
| | AGTAGTCATGCATGAGCCTCTCGATGTCATCACTGGCGGAGGCGGAGTCTTCCAT |
| | GCGGGTGACCCCGACGCCCTGAACGGCTGCACGAGCGCCAGGTCGGCGACGAC |
| | GCGCTCGGCGAGGATGGCCTGTTGCACGCGGGTGAGGGTGTCCTGGAAGTCGTC |
| | CATGTCGACGAAGCGGTGGTAGGCCCCTGTGTTGATGGTGTAAGTGCAGTTGGC |
| | CATAAGCGACCAGTTGACGGTCTGCAGGCCGGGTTGCACGACCTCGGAGTACCT |
| | GAGCCGCGAGAAGGCGCGAGTCGAAGACATAGTCGTTGCAGGTGCGACAA |
| | GGTACTGGTATCCGACTAGAAAGTGCGGCGGCGGCTGGCGGTAGAGCGGCCAGC |
| | GCTGGGTGGCCGGCGCGCCCGGGGCCAGGTCCTCAAGCATGAGTCGGTGGTAGC |
| | CGTAGAGGTAGCGGGACATCCAGGTGATGCCGGCGGCGGTGGTGGAGGCGCGC |
| | GGGAACTCGCGGACGCGGTTCCAGATGTTGCGCAGGGGCAGGAAATAGTCCATG |
| | GACGGCACGGTCTGGCCGGTGAGACGCGCGCAGTCATTGATGCTCTAGAGGCAA |

TABLE 7-continued

Nucleic Acid Sequences of Vectors

SEQ ID NO Sequence

```
AAACGAAAGCGGTTGAGCGGGCTCTTCCTCCGTAGCCTGGCGGAACGCAAACGG
GTTAGGCCGCGTGTGTACCCGGTTCGAGTCCCCTCGAATCAGGCTGGAGCCGC
GACTAACGTGGTATTGGCACTCCCGTCTCGACCCAAGCCCGATAGCCGCCAGGA
TACGGCGGAGAGCCCTTTTTGTCGGCCGAGGGGAGTCGCTAGACTTGAAAGCGG
CCGAAAACCCTGCCGGGTAGTGGCTCGCGCCCGTAGTCTGGAGAAGCATCGCCA
GGGTTGAGTCGCGGCAGAACCCGGTTCAAGGACGGCCGCGGCGAGCGGGACTT
GGTCACCCCGCCGATTTAAAGACCCACAGCCAGCCGACTTCTCCAGTTACGGGA
GCGAGCCCCCTTTTTTCTTTTTGCCAGATGCATCCCGTCCTGCGCCAAATGCGTCC
CACCCCCCGGCGACCACCGCGACCGCGGCCGTAGCAGGCGCCGGCGCTAGCCA
GCCACAGCCACAGACAGAGATGGACTTGGAAGAGGGCGAAGGGCTGGCGAGAC
TGGGGGCGCCGTCCCGGAGCGACATCCCCGCGTGCAGCTGCAGAAGGACGTGC
GCCCGGCGTACGTGCCTGCGCAGAACCTGTTCAGGGACCGCAGCGGGGAGGAGC
CCGAGGAGATGCGCGACTGCCGGTTTCGGGCGGGCAGGGAGCTGCGCGAGGGC
CTGGACCGCCAGCGCGTGCTGCGCGACGAGGATTTCGAGCCGAACGAGCAGACG
GGGATCAGCCCCGCGCGCGCGCACGTGGCGGCGGCCAACCTGGTGACGGCCTAC
GAGCAGACGGTGAAGCAGGAGCGCAACTTCCAAAAGAGTTTCAACAACCACGT
GCGCACCCTGATCGCGCGCGAGGAGGTGGCCCTGGGCCTGATGCACCTGTGGGA
CCTGGCGGAGGCCATCGTGCAGAACCCGGACAGCAAGCCTCTGACGGCACAGCT
GTTCCTGGTGGTGCAGCACAGCAGGGACAACGAGGCGTTCAGGGAGGCACTGCT
GAACATCGCCGAGCCCGAGGGTCGCTGGCTGCTGGAGCTGATTAACATCTTGCA
GAGCATCGTAGTGCAGGAGCGCAGCCTGAGCCTGGCCGAGAAGGTGGCGGCGA
TCAACTACTCGGTGCTGAGCCTGGGCAAGTTTTACGCGCGCAAGATTTACAAGA
CGCCGTATGTGCCCATAGACAAGGAGGTGAAGATAGACAGCTTTTACATGCGCA
TGGCGCTCAAGGTGCTGACGCTGAGCGACGACCTGGGCGTGTACCGCAACGACC
GCATCCACAAGGCCGTGAGCACAAGCCGGCGGCGCGAGCTGAGCGACCGCGAG
CTGATGCTGAGTCTGCGCCGGGCGCTGGTAGGAGGCGCCACCGGCGGTGAGGAG
TCCTACTTTGACATGGGGGCGGACCTGCATTGGCAGCCGAGCCGACGCGCCTTG
GAGGCCGCCTACGGTCCAGAGGACTTGGATGAGGAAGAGGAAGAGGAGGAGGA
TGCACCCGTTGCGGGGTACTGACGCCTCCGTGATGTGTTTTTAGATGCAGCAAGC
CCCGGACCCCGCCATAAGGGCGGCGCTGCAAAGTCAGCCGTCCGGTCTAGCATC
GGACGACTGGGAGGCCGCGATGCAACGCATCATGGGCCTGACGACCCGCAACCC
CGAGTCCTTTAGACAACAGCCGCAGGCCAACAGACTCTCGGCCATTCTGGAGGC
GGTGGTTCCTTCTCGGACCAACCCCACGCACGAGAAGGTGCTGGCGATCGTGAA
CGCGCTGGCGGAGAACAAGGCCATCCGTCCCGACGAGGCCGGGCTAGTGTACAA
CGCCCTGCTGGAGCGCGTGGGCCGCTACAACAGCACAAACGTGCAGTCCAACCT
GGACCGGCTGGTGACGGACGTGCGCGAGGCCGTGGCGCAGCGCGAGCGGTTCA
AGAACGAGGGCTGGGTTCGCTGGTGGCGCTGAACGCCTTCCTGGCGACGCAGC
CGGCGAACGTGCCGCGCGGGCAGGATGATTATACCAACTTTTATAAGCGCGCTGC
GGCTGATGGTGACCGAGGTGCCCCAGAGCGAGGTGTACCAGTCGGGCCCGGACT
ACTTTTTCCAGACGAGCAGACAGGGCCTGCAGACGGTGAACCTGAGTCAGGCTT
TCAAGAACCTGCGCGGGCTGTGGGGCGTGCAGGCGCCCGTGGGCGACCGGTCGA
CGGTGAGCAGCTTGCTGACGCCCAACTCGCGGCTGCTGCTGCTGCTGATCGCGCC
CTTCACCGACAGTGGCAGCGTGAACCGCAACTCGTACCTGGGTCACCTGCTGAC
GCTGTACCGCGAGGCCATAGGCCAGGCGCAGGTGGATGAGCAGACCTTCCAGGA
GATCACTAGCGTAAGCCGCGCGCTGGGTCAGAACGACACCGACAGTCTGAGGGC
CACCCTGAACTTCTTGCTGACCAATAGACAGCAGAAGATCCCGGCGCAGTACGC
GCTGTCGGCCGAGGAGGAGCGCGTCCTGAGATATGTGCAGCAGAGCGTAGGGCT
GTTCCTGATGCAGGAGGGGGCCACCCCCAGCGCCGCGCTGGACATGACCGCGCG
CAACATGGAACCTAGCATGTACGCCGCCAACCGGCCGTTTATTAATAAGCTGAT
GGACTACCTGCACCGCGCGGCGTCCATGAACTCGGACTACTTTACCAATGCCATC
TTGAACCCGCACTGGCTCCCGCCGCCGGGGTTCTACACGGGCGAGTACGACATG
CCTGACCCCAACGACGGGTTTTTGTGGGACGACGTGGACAGCGCGGTGTTCTCA
CCGACCTTGCAAAAGCGCCAGGAGGCGGTGCGCACGCCCGCGAGCGAGGGCGC
GGTGGGTCGGAGCCCCTTTCCTAGCTTAGGGAGTTTGCATAGCTTGCCGGGCTCG
GTGAACAGCGGCAGGGTGAGCCGGCCGCGCTTGCTGGGCGAGGACGAGTACCT
GAACGACTCGCTGCTGCAGCCGCCGCGGGTCAAGAACGCCATGGTCAATAACGG
GATAGAGAGTCTGGTGGACAAACTGAACCGCTGGAAAACCTACGCTCAGGACCA
TAGGGAACCTGCGCCCGCCGCGGCGACAGCGTCACGACCGGCAGCGGGGCCT
GGTGTGGGACGACGAGGACTCGGCCGACGATAGCAGCGTGTTGGACTTGGGCGG
AAGCGGTGGGGCCAACCCGTTCGCGCATCTGCAACCCAGACTGGGGCGACGGAT
GTTTTGAATGCAAAATAAAACTCACCAAGGCCATAGCGTGCGTTCTCTTCCTTGT
TAGAGATGAGGCGCGCGGTGGTGTCTTCCTCTCCTCCTCCCTCGTACGAGAGCGT
GATGGCGCAGGCGACCCTGGAGGTTCGTTTGTGCCTCCGCGGTATATGGCTCCT
ACGGAGGGCAGAAACAGCATTCGTTACTCGGAGCTGGCTCCGCTGTACGACACC
ACTCGCGTGTATTTGGTGGACAACAAGTCGGCGGACATCGCTTCCCTGAACTACC
AAAACGACCACAGCAACTTCCTGACCACGGTGGTGCAGAACAACGATTTCACCC
CTGCCGAGGCCAGCACGCAGACGATAAATTTTGACGAGCGGTCGCGGTGGGCG
GTGATCTGAAGACCATTCTGCACACCAACATGCCTAATGTGAACGAGTACATGT
TCACCAGCAAGTTTAAGGCGCGGGTGATGGTGGCTAGAAAAAAGGCGGAAGGG
GCTGATGCAAATGATAGGAGCAAGGATATCTTAGAGTATCAGTGGTTTGAGTTT
ACCCTGCCCGAGGGCAACTTTTCCGAGACCATGACCATAGACCTAATGAACAAC
GCCATCTTGGAAAACTACTTGCAAGTGGGGCGGCAAAATGGCGTGCTGGAGAGT
GATATCGGAGTCAAGTTTGACAGCAGAAATTTCAAGCTGGGCTGGGACCCGGTG
ACCAAGCTGGTGATGCCAGGGGTCTACACCTACGAGGCCTTCCACCCGGACGTG
GTGCTGCTGCCGGGCTGCGGGGTGGATTTCACCGAGAGCCGCCTGAGCAACCTC
CTGGGCATTCGCAAGAAGCAACCTTTTCAAGAGGGCTTCAGAATCATGTATGAG
```

TABLE 7-continued

Nucleic Acid Sequences of Vectors

SEQ ID NO Sequence

GACCTAGTAGGGGGCAACATCCCCGCTCTCCTGAATGTCAAGGAGTATCTGAAG
GATAAGGAAGAAGCTGGCAAAGCAGATGCAAATACTATTAAGGCTCAGAATGA
TGCCGTCCCAAGAGGAGATAACTATGCATCAGCGGCAGAAGCCAAAGCAGCAG
GAAAAGAAATTGAGTTGAAGGCCATTTTGAAAGATGATTCAGACAGAAGCTACA
ATGTGATCGAGGGAACCACAGACACCCTGTACCGCAGTTGGTACCTGTCCTATA
CCTACGGGGATCCCGAGAAGGGGGTGCAGTCGTGGACGCTGCTCACCACCCCGG
ACGTCACCTGCGGCGCGGAGCAAGTCTACTGGTCGCTGCCGGACCTCATGCAAG
ACCCCGTCACCTTCCGCTCTACCCAGCAAGTCAGCAACTACCCCGTGGTCGGCGC
CGAGCTCATGCCCTTCCGCGCCAAGAGCTTTTACAACGACCTCGCCGTCTACTCC
CAGCTCATCCGCAGCTACACCTCCCTCACCCACGTCTTCAACCGCTTCCCCGACA
ACCAGATCCTTTGCCGCCCGCCCGCGCCCACCATCACCACCGTCAGTGAAAACG
TGCCTGCTCTCACAGATCACGGGACGCTACCGCTGCGCAGCAGTATCCGCGGAG
TCCAGCGAGTGACCGTCACTGACGCCCGTCGCCGCACCTGTCCCTACGTCTACAA
GGCCCTGGGCATAGTCGCGCCGCGCGTGCTTTCCAGTCGCACCTTCTAAAAAATG
TCTATTCTCATCTCGCCCAGCAATAACACCGGCTGGGGTCTTACTAGGCCCAGCA
CCATGTACGGAGGAGCCAAGAAACGCTCCCAGCAGCACCCCGTCCGCGTCCGCG
GTCACTTCCGCGCTCCCTGGGGCGCTTACAAGCGGGGGCGGACCTCTGCTCCTGC
CGCCGTGCGCACCACCGTCGACGACGTCATCGACTCGGTGGTCGCCGATGCGCG
CAACTACACCCCCGCCCCCTCGACCGTGGACGCGGTCATCGACAGCGTGGTGGC
AGACGCGCGTGACTATGCCAGACGCAAGAGCCGGCGGCGACGGATCGCCAGGC
GCCACCGGAGCACGCCCGCCATGCGCGCCGCCCGAGCTCTGCTGCGCCGCGCCA
GACGCACGGGCCGCCGGGCCATGATGCGAGCCGCGCGCCGCGCTGCCACTGCAC
CCACCCCCGCAGGCAGGACTCGCAGACGAGCGGCCGCTGCCGCCGCCGCGGCCA
TCTCTAGCATGACCAGACCCAGGCGCGGAAACGTGTACTGGGTGCGCGACTCCG
TCACGGGCGTGCGCGTGCCCGTGCGCACCCGTCCTCCTCGTCCCTGATCTAATGC
TTGTGTCCTCCCCCGCAAGCGACGATGTCAAAGCGCAAATCAAGGAGGAGATG
CTCCAGGTCGTCGCCCCGGAGATTTACGGACCACCCCAGGCGGACCAGAAACCC
CGCAAAATCAAGCGGGTTAAAAAAAAGGATGAGGTGGACGAGGGGGCAGTAGA
GTTTGTGCGCGAGTTCGCTCCGCGGCGGCGCGTAAATTGGAAGGGGCGCAGGGT
GCAGCGCGTGTTGCGGCCCGGCACGGCGGTGGTGTTCACGCCCGGCGAGCGGTC
CTCGGTCAGGAGCAAGCGTAGCTATGACGAGGTGTACGGCGACGACGACATCCT
GGACCAGGCGGCGGAGCGGGCGGGCGAGTTCGCCTACGGGAAGCGGTCGCGCG
AAGAGGAGCTGATCTCGCTGCCGCTGGACGAAAGCAACCCCACGCCGAGCCTGA
AACCCGTGACCCTGCAGCAGGTGCTGCCCCAGGCGGTGCTGCTGAGCCGCG
GGGTTAAGCGCGAGGGCGAGAGCATGTACCCGACCATGCAGATCATGGTGCCCA
AGCGCCGGCGCGTGGAGGACGTGCTGGACACCGTGAAAATGGATGTGGAGCCC
GAGGTTAAGGTGCGCCCCATCAAGCAGGTGGCGCCGGGCCTGGGCGTGCAAACC
GTGGACATTCAGATCCCCACCGACATGGATGTCGACAAAAAACCCTCGACCAGC
ATCGAGGTGCAAACCGACCCCTGGCTCCCAGCCTCCACCGCTACCGTCTCCACTT
CTACCGCCGCCACGGCTACCGAGCCTCCCAGGAGGCGAAGATGGGGCCCTGCCA
ACCGGCTGATGCCCAACTACGTGTTGCATCCTTCCATCATCCCGACGCCGGGCTA
CCGCGGCACCCGGTACTACGCCAGCCGCAGGCGCCCAGCCAGTAAACGCCGCG
CCGCACCGCCACCCGCCGCCGTCTGGCCCCCGCCCGCGTGCGCCGCGTGACCAC
GCGCCGGGGCCGCTCGCTCGTTCTGCCCACCGTGCGCTACCACCCCAGCATCCTT
TAATCCGTGTGCTGTGATACTGTTGCAGAGAGATGGCTCTCACTTGCCGCCTGCG
CATCCCCGTCCCGAATTACCGAGGAAGATCCCGCCGCAGGAGAGGCATGGCAGG
CAGTGGCCTGAACCGCCGCCGGCGGCGGGCCATGCGCAGGCGCCTGAGTGGCGG
CTTTCTGCCCGCGCTCATCCCCATAATCGCCGCGGCCATCGGCACGATCCCGGGC
ATAGCTTCCGTTGCGCTGCAGGCGTCGCAGCGCCGTTGATGTGCGAATAAAGCC
TCTTTAGACTCTGACACACCTGGTCCTGTATATTTTTAGAATGGAAGACATCAAT
TTTGCGTCCCTGGCTCCGCGGCACGGCACGCGGCCGTTCATGGGCACCTGGAAC
GAGATCGGCACCAGCCAGCTGAACGGGGGCGCCTTCAATTGGAGCAGTGTCTGG
AGCGGGCTTAAAAATTTCGGCTCGACGCTCCGGACCTATGGGAACAAGGCCTGG
AATAGTAGCACTGGGCAGTTGTTAAGGGAAAAGCTCAAAGACCAGAACTTCCAG
CAAAAGGTGGTGGACGGGCTGGCCTCGGGCATTAACGGGGTGGTGGACATCGCG
AACCAGGCCGTGCAGCGCGAGATAAACAGCCGCCTGGACCCGCGGCCGCCCAC
GGTGGTGGAGATGGAAGATGCAACTCTTCCGCCGCCCAAGGGCGAGAAGCGAC
CGCGGCCCGACGCGGAGGAGACAATCCTGCAAGTGGACGAGCCGCCCTCGTACG
AGGAGGCCGTCAAGGCCGGCATGCCCACCACGCGCATCATCGCGCCGCTGGCCA
CGGGTGTAATGAAACCCGCTACCCCTTGACCTGCCTCCACCACCCACGCCCGCTCC
ACCAAAAGCAGCTCCGGTTGTGCAGCCCCTCCGGTGGCGACCGCCGTGCGCCG
CGTCCCCGCCCGCCGCCAGGCCCAGAACTGGCAGAGCACGCTGCACAGTATCGT
GGGCCTGGGAGTGAAAAGTCTGAAGCGCCGCCGATGCTATTGAGAGAGGAA
AGAGGACACTAAAGGGAGAGCTTAACTTGTATGTGCCTTACCGCCAGAGAACGC
GCGAAGATGGCCACCCCCTCGATGATGCCGCAGTGGGCGTACATGCACATCGCC
GGGCAGGACGCCTCGGAGTACCTGAGCCCGGGTCTGGTGCAGTTTGCCCGCGCC
ACCGACACGTACTTCAGCCTGGGCAACAAGTTTAGGAACCCCACGGTGGCCCCA
ACCCACGATGTGACCACGGACCGGTCCCAGCGTCTGACGCTGCGCTTCGTGCCC
GTGGATCGCGAGGACACCACGTACTCGTACAAGGCGCTTCACTCTGGCCGTG
GGCGACAACCGGGTGCTAGACATGGCCAGCACTTACTTTGACATCCGCGGCGTT
CTGGACCGCGGCCCCAGCTTCAAACCCTACTGGGCACGGCTTACAACAGCCTG
GCCCCCAAGGGCGCCCCCAATTCCAGTCAGTGGGATGCTCAAGAAAAAAATGGA
CAAGGAGGAAATGACATGGTTACCAAAACTCACACATTTGGCGTGGCTGCTATG
GGAGGAACAAATATTACAAACCAGGGTTTGTTAATTGGAACTGAAGAAACAGCC
GATAATCCTCCAAAGGAAATCTTTGCAGACAAATTATTCCAGCCAGAACCTCAA
GTAGGAGAGGAAAACTGGCAAGACAGCAATGCATTCTATGGAGGCAGGGCTCTT

TABLE 7-continued

Nucleic Acid Sequences of Vectors

| SEQ ID NO | Sequence |
|---|---|
| | AAGAAGGAAACTAAAATGAAACCATGCTATGGATCTTATGCTAGACCAACAAAC |
| | ACAAGTGGCGGACAGGCTAAGCTTAAAACTGGTGACAATATCGATCCTACCAAG |
| | GATTTCGACATAGATCTTGCTTTCTTCGATACTCCTGGCGGAAATCCTCCAGCAG |
| | GTGGTATTGGAACGGAAGAATACAAAGCAGATATTGTTATGTACACTGAAAATG |
| | TCAACCTTGAAACACCTGACACTCATGTGGTGTACAAACCAGCCAAAGAGGATG |
| | AAAGTTCTCAGGCCAACTTGGTTCAGCAGTCCATGCCCAACAGACCCAACTACA |
| | TTGGCTTCAGAGACAATTTTGTGGGGCTCATGTATTACAACAGCACTGGCAACAT |
| | GGGAGTGCTGGCTGGTCAGGCCTCTCAGTTGAATGCTGTGGTGGACTTGCAAGA |
| | CAGAAACACAGAGCTGTCTTACCAGCTCTTGCTAGATTCTCTGGGTGACAGAAC |
| | CAGATACTTTAGCATGTGGAACTCTGCGGTGGACAGCTATGATCCAGATGTCAG |
| | AATCATTGAAAATCACGGTGTGGAAGATGAGCTTCCAAACTATTGCTTTCCATTG |
| | GATGGCTCTGGTACCAATGCTGCCTACCAAGGTGTAAAGGTTCAAGATGGTGAA |
| | GACGGGGATAAAGAAACTGAATGGGAAAAAGATACCAAAGTCGCAGATCGTAA |
| | CCAACTGTGCAAGGGTAACATCTTCGCCATGGAGATCAACCTCCAGGCCAACCT |
| | GTGGAAGAGTTTTCTGTACTCGAACGTGGCCCTGTACCTGCCCGACTCCTACAAG |
| | TACACGCCGGCCAACATCACGCTGCCCGCCAACACCAACACCTACGAGTACATG |
| | AACGGCCGCGTGGTAGCCCCCTCGCTGGTGGACGCATACGTCAACATCGGTGCG |
| | CGCTGGTCGCTGGACCCCATGGACAACGTCAACCCCTTCAACCACCACCGCAAC |
| | GCGGGCCTGCGCTACCGCTCCATGCTTCTCGGCAACGGCCGCTACGTGCCCTTCC |
| | ACATCCAAGTGCCCCAAAAGTTCTTTGCCATTAAGAACCTGCTCCTGCTCCCCGG |
| | CTCCTACACCTACGAGTGGAACTTCCGCAAGGATGTCAACATGATCCTGCAGAG |
| | TTCCCTCGGAAACGACCTGCGCGTCGACGGCGCCTCCGTGCGCTTCGACAGCGTC |
| | AACCTCTACGCTACCTTCTTCCCCATGGCGCACAACACCGCCTCCACCCTGGAAG |
| | CCATGCTGCGCAACGACACCAACGACCAGTCCTTTAACGACTACCTCTCGGCCG |
| | CCAACATGCTCTACCCCATCCCGGCCAAGGCCACCAACGTGCCCATTTCCATCCC |
| | CTCGCGCAACTGGGCCGCCTTCCGCGGCTGGAGTTTCACCCGGCTCAAGACCAA |
| | GGAAACTCCCTCCCTTGGCTCGGGTTTTGACCCCTACTTTGTCTACTCGGGCTCC |
| | ATCCCCTACCTCGACGGGACCTTCTACCTCAACCACACCTTCAAGAAGGTTTCCA |
| | TCATGTTCGACTCCTCGGTCAGCTGGCCCGGCAACGACCGGCTGCTTACGCCGAA |
| | CGAGTTCGAGATCAAGCGCAGCGTCGACGGGGAGGGCTACAACGTGGCCCAAT |
| | GCAACATGACCAAGGACTGGTTCCTCGTCCAGATGCTCTCCCACTACAACATCG |
| | GCTACCAGGGCTTCCATGTGCCCGAGGGCTACAAGGACCGCATGTACTCCTTCTT |
| | CCGCAACTTCCAGCCCATGAGCAGGCAGGTGGTCGATGAGATCAACTACAAGGA |
| | CTACAAGGCAGTCACCCTGCCCTTCCAGCACAACAACTCTGGCTTCACCGGCTAC |
| | CTGGCACCCACCATGCGTCAGGGGCAGCCCTACCCCGCCAACTTCCCCTACCCGC |
| | TCATCGGCTCCACCGCAGTGCCATCCGTCACCCAGAAAAAGTTCCTCTGCGACA |
| | GGGTCATGTGGCGCATCCCCTTCTCCAGCAACTTCATGTCCATGGGCGCCCTCAC |
| | CGATCTGGGTCAGAACATGCTCTACGCCAACTCGGCCCACGCGCTCGACATGAC |
| | CTTCGAGGTGGACCCCATGGATGAGCCCACCCTCCTCTATCTTCTCTTCGAAGTT |
| | TTCGACGTGGTCAGAGTGCACCAGCCGCACCGCGGCGTCATCGAGGCCGTCTAC |
| | CTGCGCACGCCCTTCTCCGCCGGCAACGCCACCACCTAAGCATGAGCGGCTCCA |
| | GCGAACGAGAGCTCGCGGCCATCGTGCGCGACCTGGGCTGCGGGCCCTACTTTT |
| | TGGGCACCCACGACAAGCGCTTCCCGGGCTTCCTCGCCGGCGACAAGCTGGCCT |
| | GCGCCATCGTCAACACGGCCGGTCGCGAGACCGGGGCGTGCACTGGCTCGCCT |
| | TTGGCTGGAACCCGCGCTCGCGCACCTGCTACATGTTCGACCCCTTCGGGTTCTC |
| | GGACCGCCGGCTCAAGCAGATTTACAGCTTCGAGTACGAGGCCATGCTGCGCCG |
| | AAGCGCCCTGGCCTCCTCGCCCGATCGCTGTCTTAGCCTCGAACAGTCCACCCAG |
| | ACCGTGCAGGGGCCCGACTCCGCCGCCTGCGGACTCTTCTGTTGCATGTTCTTGC |
| | ATGCCTTCGTGCACTGGCCCGACCGACCCATGGACGGGAACCCCACCATGAACT |
| | TGCTGACGGGGGTGCCCAACGGCATGCTACAATCGCCACAGGTGCTGCCCACCC |
| | TCAGGCGCAACCAGGAGGAGCTCTACCGCTTCCTCGCGCGCCACTCCCCCTACTT |
| | TCGCTCCCACCGCGCCGCCATCGAACACGCCACCGCTTTTGATAAAATGAAACA |
| | ACTGCGTGTATGACTCAAATAAACAGCACTTTTATTTTACACATGCGCTGGAGTA |
| | TATGCAAGTTATTTAAAAGTCGAAGGGGTTCTCGCGCTCGTCGTTGTGCGCCGCG |
| | CTGGGGAGGGCCACGTTCGGGTACTGGAACTTGGGCTGCCACTTGAACTCGGGG |
| | ATCACCAGTTTGGGCACTGGAGTCTCGGGGAAGGTCTCGCTCCACATGCGCCGG |
| | CTCATTTGCAGGGCGCCCAGCATGTCAGGGCCGGAGATCTTGAAATCGCAGTTG |
| | GGACCGGTGCTCTGCGCGCGCGAGTTGCGGTACACGGGGTTGCAGCACTGGAAC |
| | ACCATCAGACTGGGGTACTTCACACTGGCAAGCACGCTCTTGTCGCTAATCTGAT |
| | CCTTGTCCAGGTCCTCGGCGTTGCTCAGGCCGAACGGGGTCATCTTGCACAGCTG |
| | GCGGCCCAGGAAGGGCACGCTCTGAGGCTTGTGGTTACACTCGCAGTGCACGGG |
| | CATCAGCATCATCCCCGCGCCGCGTGCATATTCGGGTAGAGGGCCTTGACGAA |
| | GGCCGCGATCTGCTTGAAAGCTTGCTGGGCCTTGGCCCCCTCGCTAAAAAACAG |
| | GCCGCAGCTCTTCCCGCTGAACTGGTTATTCCCGCACCCGGCATCATGCACGCAG |
| | CAGCGCGCGTCATGGCTGGTCAGTTGCACCACGCTCCGTCCCCAGCGGTTCTGGG |
| | TCACCTTAGCCTTGCTGGGCTGCTCCTTCAGCGCGCGCTGTCCGTTCTCGCTGGTC |
| | ACATCCATCTCCACCACGTGGTCCTTGTGAATCATCACCGTTCCATGCAGACACT |
| | TGAGCTGACCTTCCACCTCGGTGCAGCCGTGATCCCACAGGACGCAGCCGGTGC |
| | ACTCCCAATTCTTGTGCGCGATCCCGCTGTGGCTGAAATGTAACCTTGCAACAG |
| | GCGACCCATAATGGTGCTAAATGCTTTCTGGGTGGTGAATGTCAGTTGCATCCCG |
| | CGGGCCTCCTCGTTCATCCAGGTCTGGCACATCTTCTGGAAGATCTCGGTCTGCT |
| | CCGGCATGAGCTTGTAAGCATCGCGCAAGCCGCTGTCGACGCGGTAGCGTTCCA |
| | TCAGCACGTTCATGGTATCCATGCCCTTCTCCCATGACGAGACCAGAGGCAGACT |
| | CAGGGGGTTGCGCACGTTCAGGACACCAGGGGTCGCGGGCTCGACGATGCGTTT |
| | TCCGTCCTTGCCTTCCTTCAACAGAACCGGAGGCTGGCTGAATCCCACTCCCACG |
| | ATCACGGCGTCTTCCTGGGGCATCTCTTCGTCGGGGTCTACCTTGGTCACATGCT |

TABLE 7-continued

Nucleic Acid Sequences of Vectors

SEQ ID NO Sequence

TGGTCTTTCTGGCTTGCTTCTTTTTTGGAGGGCTGTCCACGGGGACCACGTCCTCC
TCGGAAGACCCGGAGCCCACCCGCTGATACTTTCGGCGCTTGGTGGGCAGAGGA
GGTGGCGGCGGCGAGGGGCTCCTCTCCTGCTCCGGCGGATAGCGCGCCGACCCG
TGGCCCCGGGGCGGAGTGGCCTCTCGCTCCATGAACCGGCGCACGTCCTGACTG
CCGCCGGCCATTGTTTCCTAGGGGAAGATGGAGGAGCAGCCGCGTAAGCAGGAG
CAGGAGGAGGACTTAACCACCCACGAGCAACCCAAAATCGAGCAGGACCTGGG
CTTCGAAGAGCCGGCTCGTCTAAAACCCCCACAGGATGAACAGGAGCACGAGCA
AGACGCAGGCCAGGAGGAGACCGACGCTGGGCTCGAGCATGGCTACCTGGGAG
GAGAGGAGGATGTGCTGCTAAAACACCTGCAGCGCCAGTCCCTCATCCTCCGGG
ACGCCCTGGCCGACCGAAGCGAAACCCCCCTCAGCGTCAAGGAGCTGTGTCGGG
CCTACGAGCTCAACCTCTTCTCGCCGCGCGTGCCCCCCAAACGCCAGCCCAACG
GCACCTGCGAGCCCAACCCGCGTCTCAACTTCTATCCCGTCTTTGCGGTCCCCGA
GGCCCTTGCCACCTATCACATCTTTTTCAAGAACCAAAAGATCCCCATCTCCTGT
CGCGCCAATCGCACTCGCGCCGACGCGCTCCTCGCTCTGGGGCCCGGCGCGCGC
ATACCTGATATCGCTTCCCTGGAAGAGGTGCCCAAGATCTTCGAAGGGCTCGGT
CGGGACGAGACGCGCGGCAAACGCTCTGAAAGAAACAGCAGAGGAAGAGGG
TTACACTAGCGCCCTGGTAGAGTTGGAAGGCGACAACGCCAGGCTGGCCGTGCT
TAAGCGCAGCGTCGAGCTCACCCATTTCGCCTACCCCGCCGTCAACCTCCCGCCC
AAGGTCATGCGTCGCATCATGGATCAGCTCATCATGCCCCACATCGAGGCCCTTG
ATGAAAGTCAGGAACAGCGCCCCGAGAACGCCCAGCCCGTGGTCAGCGACGAG
ATGCTCGCGCGCTGGCTCGGGACCCGCGACCCCCAGGCCCTGGAGCAGCGGCGC
AAGCTCATGCTGGCCGTGGTCCTGGTCACCCTTGAGCTCGAATGCATGCGCCGCT
TTTTTACCGACCCCGAGACCCTGCGCAAGGTCGAGGAGACCCTGCACTACACTTT
CAGACACGGTTTCGTCAGGCAGGCCTGCAAGATCTCCAACGTGGAGCTGACCAA
CCTGGTCTCCTGCCTGGGGATCCTACACGAGAACCGCTTGGGACAGACCGTGCT
CCACTCTACCCTGAAGGGCGAGGCGCGGCGGGACTACATCCGCGACTGCGTCTT
TCTCTTTCTCTGCCACACATGGCAAGCGGCCATGGGCGTGTGGCAGCAGTGTCTC
GAGGACGAGAACCTGAAGGAGCTGGACAAGCTTCTTGCTAGAAACCTTAAAAA
GCTGTGGACGGGCTTTGACGAGCGCACCGTCGCCTCGGACCTGGCCGAGATCGT
CTTCCCCGAGCGCCTGAGGCAGACGCTGAAAGGAGGGCTGCCCGACTTCATGAG
CCAGAGCATGTTGCAAAACTACCGCACTTTCATTCTCGAGCGATCTGGGATGCTG
CCCGCCACCTGCAACGCCTTCCCCTCCGACTTTGTCCCGCTGAGCTACCGCGAGT
GTCCCCCGCCGCTGTGGAGCCACTGCTACCTCTTGCAGCTGGCCAACTACATTGC
CCACCACTCGGATGTGATCGAGGACGTGAGCGGCGAGGGGCTGCTCGAGTGCCA
CTGTCGCTGCAACCTATGCTCCCCGCACCGCTCCCTGGTCTGCAACCCCCAGCTA
CTGAGCGAGACCCAGGTCATCGGTACCTTTGAGCTGCAAGGTCCGCAGGAGTCC
ACCGCTCCGCTGAAACTCACGCCGGGGTTGTGGACTTCCGCGTACCTGCGCAAA
TTTGTACCCGAGGACTACTACGCCCATGAGATAAAGTTCTTCGAGGACCAATCG
CGTCCGCAGCACGCGGATCTCACGGCCTGCGTCATCACCCAGGGCGCGATCCTC
GCCCAATTGCACGCCATCCAAAAATCCCGCCAAGAGTTTCTTCTGAAAAAGGGT
AGAGGGGTCTACCTGGACCCCCAGACGGGCGAGGTGCTCAACCCGGGTCTCCCC
CAGCATGCCGAGGAAGAAGCAGGAGCCGCTAGTGGAGGAGATGGAAGAAGAAT
GGGACAGCCAGGCAGAGGAGGACGAATGGGAGGAGGAGACAGAGGAGGAAGA
CTTGGAAGAGGTGGAAGAGGAGCAGGCAACAGAGCAGCCCGTCGCCGCACCAT
CCGCGCCGGCAGCCCCTCCGGTCACGGGATACAACCTCCGCAGCTCCGGCCAAGC
CTCCTCGTAGATGGGATCGAGTGAAGGGTGACGGTAAGCACGAGCGACAGGGCT
ACCGATCATGGAGGGCCCACAAAGCCGCGATCATCGCCTGCTTGCAAGACTGCG
GGGGGAACATCGCTTTCGCCCGCCGCTACCTGCTCTTCCACCGCGGGGTGAACAT
CCCCCGCAACGTGTTGCATTACTACCGTCACCTTCACAGCTAAGAAAAAATCAG
AAGTAAGAGGAGTCGCCGGAGGAGGCCTGAGGATCGCGGCGAACGAGCCCTTG
ACCACCAGGGAGCTAAGGAACCGGATCTTCCCCACTCTTTATGCCATTTTTCAGC
AAAGTCGAGGTCAGCAGCAAGAGCTCAAAGTAAAAAACCGGTCTCTGCGCTCGC
TCACCCGCAGTTGCTTGTACCACAAAAACGAAGATCAGCTGCAGCGCACTCTCG
AAGACGCCGAGGCTCTGTTCCACAAGTACTGCGCGCTCACTCTTAAAGACTAAG
GCGGGAATTACCTCATCGCCACCATGAGCAAGGAGATTCCCACCCCTTACATGT
GGGAGCTATCAGCCCCAGATGGGCCTGGCCGCAGGCGCCTCCCAGGACTACTCCA
CCCGCATGAACTGGCTCAGTGCCGGCCCCTCGATGATCTCACAGGTCAATGGGG
TCCGTAACCATCGAAACCAGATATTGTTGGAGCAGGCGGCGGTCACCTCCACGC
CCAGGGCAAAGCTCAACCCGCGTAATTGGCCCTCCACCCTGGTGTATCAGGAAA
TCCCCGGGCCAACTACCGTACTACTTCCGCGTGACGCACTGGCCGAAGTCCGCAT
GACTAACTCAGGTGTCCAGCTGGCCGGCGGCGCTTCCCGGTGCCCGCTCCGCCC
ACAATCGGGTATAAAAACCCTGGTGATCCGAGGCAGAGGCACACAGCTCAACG
ACGAGTTGGTGAGCTCTTCAATCGGTCTGCGACCGGACGGAGTGTTCCAACTAG
CCGGAGCCGGGAGATCCTCCTTCACTCCCCACCAGGCCTACCTGACCTTGCAGA
GCAGCTCTTCGGAGCCTCGCTCCGGAGGCATCGGAACCCTCCAGTTCGTGGAGG
AGTTTGTGCCCTCGGTCTACTTCAACCCCTTCTCGGGATCGCCAGGCCTCTACCC
GGACGAGTTCATACCGAACTTCGATGCAGTGAGAGAAGCGGTGGACGGCTACGA
CTGAATGTCCCATGGTGACTCGGCTGAGCTTGCTCGGTTGAGGCATCTGGACCAC
TGCCGCCGCCTGCGCTGCTTCGCCCGGGAGAGCTGCGGACTCATCTACTTTGAGT
TTCCCAAGGAGCACCCCAACGGCCCGGCACACGGAGTGCGGATCACCGTAGAGG
GCACCACCGAGTCTCACCTGGTCAGGTTCTTCACCCAGCAACCCTTCCTGGTCGA
GCGGGACCGGGGCGCCACCACCTACACCGTCTACTGCATCTGTCCTACCCCGAA
GTTGCATGAGAATTTTTGTTGTACTCTGTGTGCTGAGTTTAATAAAAGCTAAACT
CCTACAATACTCTGGAATCCCGTGTCGTCGCACTCGCAACGAGATCTTCAACCTC
ACCAACCAGACTGAGGTAAAACTTAACTGCAGACCGGGGGGCAAATACATCCTC
TGGCTCTTTGAAAACACTTCCTTCGCAGTCTCCAACGCCTGCGCCAACGACGGTA

TABLE 7-continued

Nucleic Acid Sequences of Vectors

SEQ ID NO Sequence

```
TTGAAATACCCAACAACCTTACCAGTGGACTAACTTACACTACCAGAAAGACTA
AGCTAGTACTCTACAATCCTTTTGTAGAGGGAACCTACCACTGCCAGAGCGGAC
CTTGCTTCCACACTTTCACTTTGGTGAACGTTACCGACAGCAGCACAGCCGCTCC
AGAAACATCTAACCTTTTTGATACTAACACTCCTAAAACCGGAGGTGAGCTCTG
GGTTCCCTCTTTAACAGAGGGGGGTAAACATATTGAAGCGGTTGGGTATTTGATT
TTAGGGGTGGTCCTGGGTGGGTGCATAGCGGTGCTGTATTACCTTCCTTGCTGGA
ACGAAATCAAAATCTTTATCTGCTGGGTCATACATTGTTGGGAGGAACCATGAA
GGGGCTCTTGCTGATTATCCTTTTCCTGGTTGGGGGTGTACTGTCATGCCACGAA
CAGCCACGATGTAACATCACCACAGGCAATGAGAGGAGTGTGATATGCACAGTA
GTCATCAAATGCGAGCATACATGTCCTCTCAACATCACATTCAAGAATAAGACC
ATGAGAAATTCATGGGTGGGCGATTGGGAACCAGGAGATGAGCAGAACTACAC
GGTCACTGTCCATGGTAGCGATGGGAATCACACTTTCGGTTTCAAATTCATTTTT
GAAGTCATGTGTGATATCACACTGCATGTGGCTAGACTTCATGGCTTGTGGCCCC
CTACCAAGGAGAACATAGTTGGGTTTTCTTTGGCTTTTGTGATCATGGCCTGCTT
TATGTCAGGTCTGCTGGTAGGGCTTTAGTATGGTTCCTGAAGCGCAAGCCTAGG
TATGGAAATGAGGAGAAGGAAAAATTGCTATAAATCTTTTTCTCTTCGCAGAAC
CATGAATACTTTGACCGGTGTCGTGCTGCTCTCTCTTCTTGTAGCTTTTAGTCAGG
CAGGATTTCATACTATCAATGCTACATGGTGGGCTAATATAACTTTAGTGGGACC
CTCAGATACGCCAGTCACATGGTATGATAAACAGGGAATGCAGTTCTGTGATGG
AAATACAGTTAAGAATCCTCAAATAAGACATGAGTGTAATGAGCAAAACCTTAC
ACTAATTCATGTGAACAAAACCCATGAAAGGACATACATGGGTTATAATACACA
GAGTACTCATAAGGAAGACTATAAAGTCATAGTTATACCGCCTCCTCCTGCTACT
GTAAAGCCACAGTCAGGTCCAGAGTATGTATATGTTAATATGGGAGAGAACAAA
ACCTTAGTTGGACCTCCAGGAATACCAGTTACTTGGTATGACGGAGAAGGAAAT
AAATTCTGCGATGGAGAAAAAGTTGAACATGCAGAATTTAATCATACATGTGAC
GAGCAAAATCTTACACTGTTGTTTATAAATCTTACACATGATGGGGCTTATCTTG
GCTATAATCACCAGGGAACTAAAAGAACTTGGTATGAGGTTGTAGTGACAGATG
GTTTTCCAAAATCAGGGGAGATGAAAATCGAAGATCAGAGTAGACAAAATGAG
CATAAACAGGGTGGGCAGAAACAGGAGGGGCAAAAAGAGACAAGTCAAAAGA
AAGCTAATGACAAACAGAAGGCGACACACAGGAGGCCATCAAAACTAAAGCCG
CACACACCTGAAGCAAAACTGATTACAGTTTCTAGTGGGTCTAACTTAACATTAC
TTGGGCCAGATGGAAAGGTCACTTGGTATGATGATGATTTAAAAAGACCATGCG
AGCCTGGGTATAAGTTAGGGTGTAAGTGTGACAATCAAAACCTAACGCTAATCA
ATGTAACTAAACTTTATGAGGGAGTTTACTATGGTACTAATGACAGAGGCAACA
GCAAAAGATATAGAGTAAAAGTAAACACTACTAATTCTCAAAGTGTGAAAATTC
AGCCATACAACAGGTCTACTACTCCTAATCAGAAACACAGATTTGAATTGCAAA
TTGATTCTAATCAAGACAATGACAAAATTCCATCAACCACTGTGGCAATCGTGGT
GGGAGTGATTGCGGGCTTCATAACTATAATCATTGTCATTCTGTGCTACATCTGC
TGCCGCAAGCGTCCCAGGGCATACAATCATATGGTAGACCCACTACTTAGCTTCT
CTTACTGAGACTCAGTCACTTTCATTTCAGAACCATGAAGGCTTTCACAGCTTGC
GTTCTGATTAGCATAGTCACATTAGTATCAGCTGATTACAAACAAGTTCAAGTTA
GCAGAGGAGGAAACATTACATTAGATGGACCATTCGATAATACTACATGGACAA
GATATCATAATGATGGACATAAAAATGGTTGGATGAAAATTTGCACATGGACTG
GAGCAACATATAAATGTCACAATAATGGAAGCATTACTATTTTTGCTTTCAACAT
TACATCCGGAGTTTACAAAGCAGAAGGGTATAAAAAAGAGGTTAGAACATTTTC
ATCTAGAAATCAAAACATACAATTGAAGATTCTGGAGATTATGAACAACAAAA
AATATATCTATATAATCTAACAATAATTGAACCGCCAACTACTAAAGCACCCAC
CATAGTTAGAACAACTACTAGGGAAACAACACATCCAACCACCACAACTCACAC
TACACATCTAGACACTACAGTGCAGAATACTACTTTATTGATTGGGTTTTTAATA
AGAGGAAATGAAAGTACTACTGATCAGACAGAGGCTACCTCAAGTGCCTTCAGC
AGCACTGCAAATTTAACTTCGCTTGCTTCGGTAAATGAAACGATCGTGCCAATGA
TGTATGGCCAACCTTACTCAGGTTTGGATATTCAAATTACTTTTCTGGTTGTCTGT
GGGATCTTTATTCTTGTGGTTCTTCTGTACTTTGTCTGCTGCAAAGCCAGAGAAA
AATCTAGGAGGCCCATCTACAGGCCAGTAATTGGGGATCCTCAGCCTCTCCAAG
TGGAAGGGGTCTAAGGAATCTTCTCTTCTCTTTTTCAGTATGGTGATTCAGCCA
TGATTCCTAGGTTCTTCCTATTTAACATCCTCTTCTGTCTATTCAACGTGTGCGCT
GCCTTCGCGGCCGTCTCGCACGCCTCGCCCGACTGTCTTGGGCCCTTCCCCACCT
ACCTTCTTTTTGCCCTGCTCACCTGCACCTGCGTCTGCAGCATTGTCTGCCTGGTC
GTTACCTTCCTGCAGCTCATCGACTGGTGCTGCGCGCGCTACAATTATCTCCACC
ACAGTCCCGAATACAGGGACGAGAACGTAGCCAGAATCTTAAGGCTCATTTGAC
CATGCATACTCTGCTCATACTGCTATCCTCCTCTCCCCTGCCCTCGCTGATGATG
ATTACTCTAAGTGCAAATTTGTGGAGCTATGGAATTTCTTAGACTGCTATGATGT
TAAAATGGATATGCCATCCTATTACTTGGTGATTGTGGGGATAGTCATGGTCTGC
TCCTGCACTTTCTTTGCCATCATGATCTACCCCTGTTTTAATCTCGGCTGGAACTC
TGTTGAGGCATTCACATACACACTAGAAAGCAGTTCACTAGCTTCCACGCCGCC
ACCCACACCGCCTCCCCGCAGAAATCAGTTTCCCATGATTCAGTACTTAGAAGA
GCCCCCTCCCCGGCCCCCTTCCACTGTTAGCTACTTTCACATAACCAGCGGCGAT
GACTGACAACCACCTGGACCTCGAGATGGACGGCCAGGACTCCGAGCAGCGCAT
CCTGCAACTGCGCGTCCGTCAGCAGCAGGAGCGGGCCGCCAAGGAGCTCCTCGA
TGCCATCAACATCCACCAGTGCAAGAAGGGCATCTTCTGCCTGGTCAAACAGGC
AAAGATCACCTACGAGCTCGTGTCCGGCGGCAAGCAGCATCGCCTCGCCTATGA
GCTGCCCCAGCAGAAGCAGAAGTTCACCTGCATGGTGGGCGTCAACCCCCATAGT
CATCACCCAGCAGTCGGGCGAGACCAGCGGCTGCATCCACTGCTCCTGCGAAAG
CCCCGAGTGCATCTACTCCCTCCTTAAAACCCTTTGCGGACTCCGCAACCTTCTT
CCCACAAACTAACTGATTTAAGCCCAAAAACCAATCAAACCCCCTTTTCCCATCT
ACCCAAATAAACATTTATTGGAAATAATTATTCAATAAAGATCACTTACTTAAAA
```

TABLE 7-continued

Nucleic Acid Sequences of Vectors

| SEQ ID NO | Sequence |
|---|---|
| | TCTGAAAGTATGTCTTTGGTGTAGTTGTTTAGCAGCACCTCAGTCCCCTCCTCCC<br>AGCTCTGGTACTCCAGTCCCCGGCGGGCGGCAAACTTTCTCCACACCTTGAAAG<br>GGATGTCAAATTCCTGGTCCACAATTTTCATTGTCTTCCCTCTTAGATGACAAAG<br>AGACTCCGGGTGGAAGATGACTTCAACCCCGTCTACCCCTATGGCTACGCGCGG<br>AATCAAAATATTCCCTTCCTCACTCCCCCCTTTGTCTCCTCCAATGGATTTCAAAA<br>CTTCCCCCCTGGGGTCCTGTCACTTAAACTGGCTGACCCAATCACCATTAACAAT<br>CAAAATGTATCACTCAAGGTTGGAGGGGGGCTAACTTTGCAAGAAGAAACTGGA<br>AAATTAACAGTTAATACTGAACCACCTTTGCATCTTACAAATAACAAATTAGGG<br>ATAGCTTTAGACGCTCCATTTGATGTTATAGACAATAAGCTTACACTATTAGCAG<br>GCCATGGCTTGTCTATTATAACAAAAGAAACATCAACACTGCCTGGCTTGGTTAA<br>TACTCTTGTAGTATTAACTGGAAAGGGTATTGGAACAGATTTATCAAATAATGGT<br>GGAAATATATGTGTTAGAGTTGGAGAAGGCGGCGGCTTATCATTTAATGACAAT<br>GGAGACTTGGTAGCATTTAATAAAAAAGAAGACAAACGCACCCTATGGACAACT<br>CCAGACACATCTCCAAATTGCAGAATTGATCAGGATAAGGACTCTAAGCTAACT<br>TTGGTCCTTACAAAGTGTGGAAGTCAAATATTAGCCAATGTGTCATTAATTGTTG<br>TAGCTGGAAGGTACAAAATTATCAATAACAATACTAATCCAGCTCTTAAAGGAT<br>TTACCATTAAATTGTTGTTTGATAAAAATGGAGTCCTTATGGAATCTTCAAATCT<br>TGGTAAATCATATTGGAACTTTCGAAATCAAAATTCAATTATGTCAACAGCTTAT<br>GAAAAAGCTATTGGTTTTATGCCTAATTTGGTAGCCTATCCAAAACCTACCACTG<br>GCTCTAAAAAATATGCAAGAGATATAGTTTATGGAAACATCTACCTTGGCGAA<br>AGCCACATCAACCAGTAACCATTAAAACTACCTTTAACCAGGAAACTGGATGTG<br>AATACTCTATTACATTTGATTTTAGTTGGGCAAAACTTATGTAAATGTTGAATT<br>TGAAACTACCTCTTTTACCTTTTCCTATATTGCCCAAGAATAAAGGATAAATAAA<br>CGTGTTTTTCATTTAAAAATTTCATGTATCTTTATTGATTTTTACACCAGCGCGGG<br>TACACATTCTCCCACCACCAGCCCATTTTACAGTGTAAACAATTCTCTCAGCACG<br>GGTGGCCTTAAATAGGGGAAAGTTCTCATTAGTGCGGGAACTGGACTTGGGGTT<br>TATAATCCACACAGTTTCCTGGCGAGCCAAACGGGGGTCGGTGATTGAGATGAA<br>GCCGTCCTTTGAAAAATCATCCAAGTGGGCCTCGCAGTCCAAGGTCACAGTCTG<br>GTGGAATGAGAAGAACGCACAGACTCATACTCGGAAAAACAAAATGGGTCTGTG<br>CCTCTCCATCAGCGCCCTTAACAGTCTCTGCCGCCGGGGCTCGGTGCGGCTGCTA<br>CAGATGGGATCGGGATCGCAAGTCTCTTTCACTATAATCCCCACAGCCTTTAGCA<br>TTAGTCTTCTGGTGCGTCGGGCACAGCACCGCATCCTAATCTCGCTCATGTTTTC<br>ACAGTAAGTGCAGCACATAATGACCATGTTATTCAGCAGCCCATAATTTAGGGT<br>GCTCCAGCCAAAGCTTATGTTGGAAATGATGGAACCCACGTGACCATCGTACCA<br>AATGCGGCAGTATATCAGGTGCCTGCCCCTTATAAACACACTGCCCATATACATA<br>ATCTCTTTGGACATG |
| SEQ ID<br>NO: 1421 | CATCATCAATAATATACCCCACAAAGTAAACAAAAGTTAATATGCAAATGAGCT<br>TTTGAATTTGGGGCGTGGCCGCCGCTGATTGGCTGTTGCAAGAACCGTTAGTGAC<br>GTCACGACGCACGGCGTCAACGGTCGGCGCGGAGGCGTGGCCTAGGCCGGAAG<br>CAAGTCGCGGGGCTGATGACGTATAAAAAAGCGGACTTTAGACCCGGAAACGG<br>CCGATTTTCCCGCGGCCACGCCCGGATATGAGGTAATTCTGGGCGGATGCAAGT<br>GAAATTAGGTCATTTTGGCGCGAAAACTGAATGAGGAAGTGAAAAGCGAAAAA<br>TACCGGTCCCGCCCAGGGCGGAATATTTACCGAGGGCCGAGAGACTTTGACCGA<br>TTACGTGGGGGTTTCGATTGCGGTGTTTTTTTCGCGAATTTCCGCGTCCGTGTCAA<br>AGTCCGGTGTTTATGTCACAGATCAGCTGATCCACAGGGTATTTAAACCAGTCGA<br>GCCCGTCAAGAGGCCACTCTTGAGTGCCAGCGAGTAGAGATTTCTCTGAGCTCC<br>GCTCCCAGAGTGTGAGAAAAATGAGACACCTGCGTCTCCTGCCTGGAACTGTGC<br>CCTTGGACATGGCCGCATTATTGCTGGATGACTTTGTGAGTACAGTATTGGAGGA<br>TGAACTGCAACCAACTCCGTTTGAGCTGGGGCCCACACTTCAGGACCTCTATGAT<br>CTGGAGGTAGATGCCCAGGAGGACGACCCGAACGAAGAGGCTGTGAATTTAAT<br>ATTTCCAGAATCTCTGATTCTTCAGGCTGACATAGCCAGCGAAGCTGTACCTACA<br>CCACTTCATACACCGACTCTGTCACCCATACCTGAATTGGAAGAGGAGGACGAA<br>CTAGACCTCCGGTGTTATGAGGAAGGTTTTCCTCCCAGCGATTCAGAGGACGAA<br>CGGGGTGAGCAGAGTATGGCTATAATCTCAGACTATGCTTGTGTGGTTGTGGAA<br>GAGCATTTTGTGTTGGACAATCCTGAGGTGCCTGGGCAAGGCTGTAGATCCTGCC<br>AATATCACCGGGATCAGACCGGAGACCAAAATGCTTCCTGTGCTCTGTGTTACAT<br>GAAAATGAGCTTCAGCTTTATTTACAGTAAGTGGAGTGAATGTGAGAGAGGCTG<br>AGTGCTTAACACATCACTGTGTGATGCTTGAACAGCTGTGCTAAGTGTGGTTTAT<br>TTTGTTACTAGGTCCGGTGTCAGAGGATGAGTCATCACCCTCAGAAGAAGACCA<br>CCCGTCTCCCCCTGATCTCACAGATGACACGCCCCTGCAAGTGATCAGACCCACC<br>CCAGTCAGACTCAGTGGGGAGAGGCGAATGGCTGTTGACAAAATCGAGGACTTG<br>TTGCAGGACATGGGTGGGGATGAACCTTTGGACCTGAGCTTGAAACGCCCCAGG<br>AACTAGGCGCAGCTGTGCTGAGTCATGTGTAAATAAAGTTGTACAATAAAAGTG<br>TATGTGACGCATGCAAGGTGTGGTTTATGACTCATGGGCGGGCTTAGACCTAT<br>ATAAGTGGTAACACCTGGGCACTCAGGCACAGACCTTCAGGGAGTTCCTGATGG<br>ATGTGTGGACTATCCTTGGGGACTTTAGCAAGACACGCCGGCTTGTAGAGGATA<br>GTTCAGACGGGTGCTCCGGGTTCTGGAGACACTGGTTTGGAACTCCTCTATCTCG<br>CCTGGTGTACACAGTTAAGAAGGATTATAGCGAGGAATTTGAAAATCTTTTTTCC<br>GACTGCTCTGGCCTGCTAGATTCTCTGAATCTTGGCCACCAGTCCCTTTTCCAGG<br>AAAGGGTACTCCACAGCCTTGATTTTTCATCTCCCGGGCGCACTACAGCCGGGGT<br>TGCTTTTGTGGTTTTTCTGGTTGACAAATGGAGCCAGGACACCCAACTGAGCAGG<br>GGATACATCCTGGACTTCGCAGCCATGCATCTGTGGAGGGCCTGGATCAGGCAG<br>CGGGGACAGAGAATCTTGAACTACTGGCTTCTACAGCCAGCAGCTCCGGGTCTT<br>CTTCGTCTACACAGACAAACATCCATGTTGGAGGAAGAAATGAGGGAGGCCATG<br>GACGAGAACCCGAGGAGCGGCCTGGACCCTCCGTCGGAAGAGGAGCTGGATTG |

TABLE 7-continued

Nucleic Acid Sequences of Vectors

SEQ ID NO Sequence

```
AATCAGGTATCCAGCCTGTACCCAGAGCTTAGCAAGGTGCTGACATCCATGGCC
AGGGGAGTGAAGAGGGAGAGGAGCGATGGGGGCAATACCGGGATGATGACCGA
GCTGACGGCCAGCCTGATGAATCGCAAGCGCCCAGAGCGCATTACCTGGCACGA
GCTACAGATTGAGTGCAGGGATGAGGTGGGCCTGATGCAGGATAAATACGGCCT
GGAGCAGATAAAAACCCACTGGTTGAATCCAGATGAGGATTGGGAGGAGGCCA
TTAAGAAATATGCCAAGATAGCCCTGCGCCCAGATTGCAAGTACAGGGTGACCA
AGACGGTGAATATCAGACATGCCTGCTACATCTCAGGGAACGGGGCAGAGGTGG
TCATCGACACCCTGGACAAGGCCGCCTTCAGGTGTTGCATGATGGGAATGAGAG
CCGGAGTGATGAATATGAATTCCATGATCTTCATGAACATAAAGTTCAATGAGG
AGAAGTTTAATGGGGTGCTGTTCATGGCCAACAGCCACATGACCCTGCACGGCT
GCAATTTCTTCGGGTTCAACAATATGTGTGCAGAGGTCTGGGGCGCCTCCAAGAT
CAGGGGATGTAAGTTTTATGGCTGCTGGATGGGCGTGGTCGGAAGACCCAAGAG
CGAGATGTCTGTGAAGCAGTGTGTGTTTGAGAAATGCTACCTGGGGGTGTCTAC
AGAGGGCAATGCTCGAGTGAGACACTGCTCTTCCCTGGAGACGGGCTGCTTCTG
CCTGGTGAAGGGCACAGCCTCGATCAAGCATAATGTGGTGAAGGGCTGCACGGA
TGAGCGCATGTACAACATGCTGACCTGCGACTCGGGGGTCTGCCATATCCTGAA
GAACATCCATGTGACCTCCCACCCCAGAAAGAAGTGGCCATTGTTTGAGAATAA
CCTGCTGATCAAGTGTCACATGCACCTGGGCGCCAGAAGGGGCACCTTCCAGCC
GTACCAGTGCAACTTTAGCCAGACCAAGCTGCTGTTGGAGAACGATGCCTTCTCC
AGGGTGAACCTGAACGGCATCTTTGACATGGATGTTTCGGTCTACAAGATCCTG
AGATACGATGAGACCAAGTCCAGGGTGCGCGCTTGCGAGTGCGGGGGCAGGCA
CACCAGGATGCAGCCAGTGGCCCTGGATGTGACCGAGGAGCTGAGACCAGACC
ACCTGGTGATGGCCTGTACCGGGACCGAGTTCAGCTCCAGTGGGGAGGACACAG
ATTAGAGGTAGGTTTTGAGTAGTGGGCGTGGCTAATGTGAGTATAAAGGCGGTG
TCTTACGAGGGTCTTTTTGCTTTTCTGCAGACATCATGAACGGGACCGGCGGGC
CTTCGAAGGGGGGCTTTTTAGCCCTTATTTGACAACCCGCCTGCCGGGATGGGCC
GGAGTTCGTCAGAATGTGATGGGATCGACGGTGGATGGGCGCCCAGTGCTTCCA
GCAAATTCCTCGACCATGACCTACGCGACCGTGGGGAGCTCGTCGCTCGACAGC
ACCGCCGCAGCCGCGGCAGCCGCAGCCGCCATGACAGCGACGAGACTGGCCTCG
AGCTACATGCCCAGCAGCGGCAGCAGCCCCTCTGTGCCCAGTTCCATCATTGCCG
AGGAGAAACTGCTGGCCCTGCTGGCCGAGCTGGAAGCCCTGAGCCGCCAGCTGG
CCGCCCTGACCCAGCAGGTGTCCGATCTCCGCGAGCAGCAGCAGCAAAATAAAT
GATTCAATAAACACAGATTCTGATTCAAACAGCAAAGCATCTTTATTATTTATTT
TTTCGCGCGCGGTAGGCCCTGGTCCACCTCTCCCGATCATTGAGAGTGCGGTGGA
TTTTTTCCAGGACCCGGTAGAGGTGGGATTGGATGTTGAGGTACATGGGCATGA
GCCCGTCCCGGGGGTGGAGGTAGCACCACTGCATGGCCTCGTGCTCTGGGGTCG
TGTTGTAGATGATCCAGTCATAGCAGGGGCGCTGGGCGTGGTGCTGGATGATGT
CCTTGAGGAGGAGACTGATGGCCACCGGAAGCCCCTTGGTGTAGGTGTTGGCAA
AGCGGTTGAGCTGGGAGGGATGCATGCGGGGGGAGATGATGTGCAGTTTGGCCT
GGATCTTGAGGTTGGCGATGTTGCCACCCAGATCCCGCCTGGGGTTCATGTTGTG
CAGGACCACCAGGACGGTGTAGCCCGTGCACTTGGGGAACTTGTCATGCAACTT
GGAAGGGAATGCGTGGAAGAATTTGGAGACGCCCTTGTGCCCGCCCAGGTTTTC
CATGCACTCATCCATGATGATGGCGATGGGCCCGTGGGCTGCGGCTTTGGCAAA
GACGTTTCTGGGGTCAGATACATCATAATTATGCTCCTGGGTGAGATCATCATAA
GACATTTTAATGAATTTGGGCGGAGGGTGCCAGATTGGGGACGATGGTTCCC
TCGGGCCCTGGGGCGAAGTTCCCCTCACAGATCTGCCATCTCCCAGGCTTTCATCT
CGGAGGGGGGATCATGTCCACCTGCGGGGCGATGAAAAAAACGGTTTCCGGG
GCGGGGGTGATGAGCTGCGAAGAGAGCAGGTTTCTCAACAGCTGGGACTTGCCG
CACCCGGTCGGGCCGTAGATGACCCCGATGACGGGTTGCAGGTGGTAGTTCAAG
GACATGCAGCTGCCGTCGTCCCGGAGGAGGGGGGCCACCTCGTTAAGCATGTCC
CTGACTTGGAGGTTTTCCCGGACGAGCTCGCCGAGGAGGCGGTCCCCGCCCAGC
GAGAGCAGCTCTTGCAGGGAAGCAAAGTTTTTCAGGGGCTTGAGCCCGTCGGCC
ATGGGCATCTTGGCGAGGGTCTGCGAGAGGAGCTCCAGGCGGTCCCAGAGCTCT
GTGACGTGCTCTACGGCATCTCGATCCAGCAGACTTCCTCGTTTCGGGGGTTGGG
ACGACTGCGACTGTAGGGTACGAGACGATGGGCGTCCAGCGCTGCCAGCGTCAT
GTCCTTCCAGGGTCTCAGGGTCCGCGTGAGTGTGGTCTCCGTCACGGTGAAGGG
GTGGGCCCCGGGCTGGGCGCTTGCGAGGGTGCGCTTGAGACTCATCCTGCTGGT
GCTGAAACGGGCACGGTCTTCGCCCTGCGCGTCGGCGAGATAGCAGTTGACCAT
GAGCTCGTAGTTGAGGGCCTCGGCGGCGTGGCCCTTGGCGCGGAGCTTGCCCTT
GGAAGAGCGCCCGCAGGCGGGACAGAGGAGGGATTGCAGGGCGTAGAGCTTGG
GCGCGAGAAAGACCGACTCGGGGGCGAAGGCGTCCGCTCCGCAGTGGGCGCAG
ACGGTCTCGCACTCAACGAGCCAGGTGAGCTCGGGCTGCTCGGGTCAAAAACC
AGTTTTCCCCCGTTCTTTTTGATGCGCTTCTTACCTCGCGTCTCCATGAGTCTGTG
TCCGCGTTCGGTGACAAACAAGCTGTCAGTGTCCCCGTAGACGGACTTGATTGG
CCTGTCCTGCAGGGGCGTCCCGCGGTCCTCCTCGTAGAGAAACTCGGACCACTCT
GAGACAAAGGCGCGCGTCCACGCCAAGACAAAGGAGGCCACGTGCGAGGGGTA
GCGGTCGTTGTCCACCAGGGGGTCCACCTTTTCCACCGTGTGCAAGCACATGTCC
CCCTCCTCCGCATCCAAGAAGGTGATTGGCTTGTAGGTGTAGGCCACGTGACCG
GGGGTCACCGACGGGGGGGTATAAAAGGGGCGGGTCTGTGCTCGTCCTCACTC
TCTTCCGCGTCGCTGTCCACGAGCGCCAGCTGTTGGGGTAAGTATTCCCTCTCGA
GAGCGGGCATGACCTCGGCACTCAGGTTGTCAGTTTCTAGAAACGAGGAGGATT
TGATGTTAGCCTGCCCTGCCGCGATGCTTTTGAGGAGACTTTCATCCATCTGGTC
AGAAAAGACTATTTTTTTATTGTCAAGCTTGGTGGCAAAGGAGCCATAGAGGGC
GTTGGAGAGGAGCTTAGCGATGGATCTCATGGTCTGATTTTTGTCACGATCGGCG
CGCTCCTTGGCCGCGATGTTGAGCTGGACATACTCGCGCGCGACGCACTTCCATT
CGGGGAAGACGGTGGTGCGCTCGTCGGGCACGATCCTGACGCGCCAGCCGCGGT
```

TABLE 7-continued

Nucleic Acid Sequences of Vectors

| SEQ ID NO | Sequence |
|---|---|
| | TATGCAGGGTGACCAGGTCCACGCTGGTGGCCACCTCTCCGCGCAGGGGCTCGT |
| | TAGTCCAGCAGAGGCGCCCGCCCTTGCGCGAGCAGAACGGGGGCAACACATCCA |
| | GCAGGTGCTCGTCAGGGGGGTCTGCATCGATGGTAAAGATGCCCGGACAGAGTT |
| | CCTTGTCAAAATAATCGATTTTTGAGGATGCATCATCCAAGGCCATCTGCCATTC |
| | GCGGGCGGCCAGCGCTCGCTCGTAGGGGTTGAGGGGCGGACCCCATGGCATGGG |
| | ATGCGTGAGCGCGGAGGCGTACATGCCGCAGATGTCATAGACATAGATGGGCTC |
| | CGAGAGGATGCCGATGTAGGTGGGATAACAGCGCCCCCGCGGATGCTGGCGCG |
| | CACGTATTCATACAACTCGTGCGAGGGGGCCAAGAAAGCGGGGCCGAGATTGGT |
| | GCGCTGGGGCTGCTCGGCGCGGAAGACGATCTGGCGAAAGATGGCATGCGAGTT |
| | GGAGGAGATGGTGGGCCGTTGGAAGATGTTAAAGTGGGCGTGCGGCAGTCGGA |
| | CCGAGTCGCGGATGAAGTGCGCGTAGGAGTCTTGCAGCTTGGCGACGAGCTCGG |
| | CGGGTGACGAGGACGTCCATGGCGCAGTAGTCGAGGGTTTCGCGGATGATGTCAT |
| | AACCCGCCTCTCCTTTCTTCTCCCACAGCTCGCGGTTGAGGGCGTACTCCTCGTC |
| | ATCCTTCCAGTACTCCCGGAGCGGGAATCCTCGATCGTCCGCACGGTAAGAGCC |
| | CAGCATGTAGAATTGGTTCACGGCCTTGTAGGGACAGCAGCCCTTCTCCACGGG |
| | GAGGGCGTAAGCTTGAGCGGCCTTGCGGAGCGAGGTGTGCGTCAGGGCGAAGG |
| | TGTCCCTGACCATGACTTTCAAGAACTGGTACTTGAAGTCCGAGTCGTCGCAGCC |
| | GCCGTGTTCCCAGAGCTCGAAATCGGTGCGCTTCTTCGAGAGGGGGTTAGGCAG |
| | AGCGAAAGTGACGTCATTGAAGAGAATCTTGCCTGCCCGCGGCATGAAATTGCG |
| | GGTGATGCGGAAAGGGCCCGGGACGGAGGCTCGGTTGTTGATGACCTGGGCGGC |
| | GAGGACGATCTCGTCGAAGCCGTTGATGTTGTGCCCGACGATGTAGAGTTCCAT |
| | GAATCGCGGGCGGCCTTTGACGTGCGGCAGCTTTTTGAGCTCCTCGTAGGTGAG |
| | GTCCTCGGGGCATTGCAGGCCGTGCTGCTCGAGCGCCCACTCCTGGAGATGTGG |
| | GTTGGCTTGCATGAAGGAAGCCCAGAGCTCGCGGGCCATGAGGGTCTGGAGCTC |
| | GTCGCGAAAGAGGCGGAACTGCTGGCCCACGGCCATCTTTTCTGGGGTGACGCA |
| | GTAGAAGGTGAGGGGGTCCCGCTCCCAGCGATCCCAGCGTAAGCGCACGGCGA |
| | GATCGCGAGCGAGGGCGACCAGCTCGGGGTCCCCTGAGAATTTCATGACCAGCA |
| | TGAATGGGACGAGCTGCTTGCCGAAGGACCCCATCCAGGTGTAGGTTTCTACAT |
| | CGTAGGTGACAAAGAGCCGCTCCGTGCGAGGATGAGAGCCGATTGGGAAGAAC |
| | TGGATTTCCTGCCACCAGTTGGACGAGTGGCTGTTGATGTGATGAAAGTAGAAA |
| | TCCCGCCGGCGAACCGAGCACTCGTGCTGATGCTTGTAAAAGCGTCCGCAGTAC |
| | TCGCAGCGCTGCACGGGCTGTACCTCATCCACGAGATACACAGCGCGTCCCTTG |
| | AGGAGGAACTTCAGGAGTGGCGGCCCTGGCTGGTGGTTTTCATGTTCGCCTGCGT |
| | GGGACTCACCATGGGGCTCCTCGAGGACGGAGAGGCTGACGAGCCCGCGCGGG |
| | AGCCAGGTCCAGATCTCGGCGCGGCGGGGCGCAGAGCGAAGACGAGGGCGCG |
| | CAGTTGGGAGCTGTCCATGGTGTCGCGGAGATCCAGGTCCGGGGCAGGGTTCT |
| | GAGGTTGACATCGTAGAGGCGGGTGAGGGCGTGCTTGAGATGCAGATGGTACTT |
| | GATCTCCACGGGTGAGTTGGTGGCCGTGTCCACGCATTGCATGAGCCCGTAGCT |
| | GCGCGGGGCCACGACCGTGCCGCGCTTTAGAAGCGGTGTCGCGGACGCGCTCCC |
| | GGCGGCAGCGGCGGTTCCGGCCCCGCGGGCAGGGCGGCAGAGGCACGTCGGC |
| | GTGGCGCTCGGGCAGGTCCCGGTGCTGCGCCCTGAGAGCGCTGGCGTGCGCGAC |
| | GACGCGGCGGTTGACATCCTGGATCTGCCGCCTCTGAGTGAAGACCACGGGCCC |
| | CGTGACTTTGAACCTGAAAGACAGTTCAACAGAATCAATCTCGGCGTCATTGAC |
| | GGCGGCCTGACGCAGGATCTCTTGCACGTCGCCCGAGTTGTCCTGGTAGGCGAT |
| | CTCGGACATGAACTGCTCGATCTCCTCCTCCTGGAGATCTCCGCGGCCCGCGCGC |
| | TCGACGGTGGCGGCGAGGTCATTTGAGATGCGACCCATGAGCTGCGAGAAGGCG |
| | CCCAGGCCGCTCTCGTTCCAGACGCGGCTGTAGACCACGTCCCCGTCGGCGTCGC |
| | GCGCGCGCATGACCACCTGCGCGAGGTTGAGCTCCACGTGCCGCGTGAAGACGG |
| | CGTAGTTGCGCAGGCGCTGGAAGAGGTAGTTGAGGGTGGTGGCGATGTGCTCGG |
| | TGACGAAGAAGTACATGATCCAGCGGCGCAGTGGCATCTCGCTGATGTCGCCGA |
| | TGGCTTCCAACCTTTCCATGGCCTCGTAGAAGTCCACGGCGAAGTTGAAAAACT |
| | GGGCGTTGCGGGCCGAGACCGTGAGCTCGTCTTCCAGGAGCCTGATGAGCTCGG |
| | CGATGGTGGCGCGCACCTCGCGCTCGAAATCCCCGGGGGCCTCCTCCTCTTCCTC |
| | TTCTTCCATGACGACCTCTTCTTCTATTTCCTCTACCACTGGGGGTGGCGGGCCC |
| | GACGACGACGGCGACGCACCGGGAGACGGTCGACGAAGCGCTCGATCATCTCCC |
| | CGCGGCGGCGACGCATGGTTTCGGTGACGGCGCGACCCCGTTCGCGAGGACGCA |
| | GCGTGAAGACGCCGCCGGTCATCTCCCGGTAATGGGCGGGTCCCCGTTGGGCA |
| | GCGAGAGGGCGCTGACTATGCATCTTATCAATTGCGGTGTAGGGGACGTGAGCG |
| | CGTCGAGATCGACCGGATCGGAGAATCTTTCGAGGAAAGCGTCTAGCCAATCGC |
| | AGTCGCAAGGTAAGCTCAGACACGTAGCAGCCCTGTGGACGCTGTTAGAATTGC |
| | GGTTGCTGATGATGTAATTGAAGTAGGCGTTTTTGAGGCGCGGATGGTGGCGA |
| | GGAGGACCAGGTCCTTGGGTCCCGCTTGCTGGATGCGGAGCCGCTCGGCCATGC |
| | CCCAGGCCTGGCCCTGACACCGGCTCAGGTTCTTGTAGTAGTCATGCATGAGCCT |
| | CTCGATGTCATCACTGACGGAGGCGGAGTCTTCCATGCGGGTGACCCCGACGCC |
| | CCTGAGCGGCTGCACGAGCGCCAGGTCGGCGACGACGCGCTCGGCGAGGATGG |
| | CCTGTTGCACGCGGGTGAGGGTGTCCTGGAAGTCGTCCATGTCGACGAAGCGGT |
| | GGTAGGCCCCTGTGTTGATGGTGTAGGTGCAGTTGGCCATGACGACCAGTTGA |
| | CGGTCTGCAGGCCGGGCTGCACGACCTCGGAGTACCTGAGCCGCGAGAAGGCGC |
| | GCGAGTCGAAGACGTAGTCGTTGCAGGTGCGCACGAGGTACTGGTAGCCCACGA |
| | GGAAGTGCGGCGGCGGCTGGCGGTAGAGGGGCCAGCGCTGGGTGGCCGGCGCG |
| | CCCGGGGCCAGGTCCTCGAGCATGAGGCGGTGGTAGCGTAGAGGTAGCGGGA |
| | CATCCAGGTGATGCCGGCGGCGGTGGTGGAGGCGCGCGGGAACTCGCGGACGC |
| | GGTTCCAGATGTTGCGCAGCGGCAGGAAATAGTCCATGGTCGGCACGGTCTGGC |
| | CGGTGAGACGCGCGCAGTCATTGACGCTCTAGAGGCAAAAACGAAAGCGGTTG |
| | AGCGGGCTCTTCCTCCGTAGCCTGGCGGAACGCAAACGGGTTAGGCCGCGCGTG |
| | TACCCCGGTTCGAGTCCCCTCGAATCAGGCTGGAGCCGCGACTAACGTGGTATT |

TABLE 7-continued

Nucleic Acid Sequences of Vectors

| SEQ ID NO | Sequence |
|---|---|
| | GGCACTCCCGTCTCGACCCGAGCCCGATAGCCGCCAGGATACGGCGGAGAGCCC
TTTTTGCAGGCCGCGCGGGGTCGCTAAACTTGAAAGCGGCCGAAAACCCCGCCG
GGTAGTGGCTCGCGCCCGTAGTCTGGAGAAGCATCGCCAGGGTTGAGTCGCGGC
AGAACCCGGTTCGCGGACGGCCGCGGCGAGCGGGACTTGGTCACCCCGCCTATT
AAAGACCCACAGCCAGCCGACTTCTCCAGTTACGGGAGCGAGCCCCTTTTTTCTT
TTTGCCAGATGCATCCCGTCCTGCGCCAAATGCGTCCCACCCCTCCGGCGACCAC
CGCAACCGCGGCCGTAGCAGGCGCCGGCGCTAGCCAGCCACAGACAGAGATGG
ACTTGGAAGAGGGCGAAGGGCTGGCGAGACTGGGGGCGCCGTCCCCGGAGCGA
CACCCCCGCGTGCAGCTGCAGAAGGACGTGCGCCCGGCGTACGTGCCCGCGCAG
AACCTGTTCAGGGACCGCAGCGGGGAGGAGCCCGAGGAGATGCGCGACTGCCG
GTTTCGGGCGGGCAGGGAGCTCCGCGAGGGTCTGGACCGCCAGCGCGTGCTGCG
CGACGAGGATTTCGAGCCGAACGAGCAGACGGGGATCAGCCCCGCGCGCGCGC
ACGTGGCGGCGGCCAACCTGGTGACGGCCTACGAGCAGACGGTGAAGCAGGAG
CGCAACTTCCAAAAGAGTTTCAACAACCACGTGCGCACCCTGATCGCGCGCGAG
GAGGTGGCACTGGGCCTGATGCACCTGTGGGACCTGGCGGAGGCCATCGTGCAG
AACCCGGACAGCAAGCCTCTGACGGCGCAGCTGTTCCTGGTGGTGCAGCACAGC
AGGGACAATGAGGCGTTCAGGGAGGCGCTGCTGAACATCGCCGAGCCCGAGGG
TCGCTGGCTGCTGGAGCTGATTAACATCTTGCAGAGCATCGTAGTGCAGGAGCG
CAGCCTGAGCCTGGCCGAGAAGGTGGCAGCTATCAACTACTCGGTGCTGAGCCT
GGGCAAGTTTTACGCGCGCAAGATTTACAAGACGCCGTACGTGCCCATAGACAA
GGAGGTGAAGATAGACAGCTTTTACATGCGCATGGCGCTCAAGGTGCTGACGCT
GAGCGACGACCTGGGCGTGTACCGCAACGACCGCATCCACAAGGCCGTGAGCAC
GAGCCGGCGGCGCGAGCTGAGCGACCGCGAGCTGATGCTGAGCCTGCGCCGGG
CGCTGGTAGGGGCGCTACAGGCGAGGAGTCCTACTTCGACATGGGGGCGGACC
TGCATTGGCAGCCGAGCCGACGCGCCTTGGAGGCCGCCTACGGTCCAGAGGACT
TGGATGAGGATGAGGAAGAGGAGGAGGATGCACCCGTTGCGGGGTACTGACGC
CTCCGTGATGTGTTTTTAGATGTCCCAGCAAGCCCCGGACCCCGCCATAAGGGCG
GCGCTGCAAAGCCAGCCGTCCGGTCTAGCATCGGACGACTGGGAGGCCGCGATG
CAACGCATCATGGCCCTGACGACCCGCAACCCCGAGTCCTTTAGACAACAACCG
CAGGCCAACAGACTCTCGGCCATTCTGGAGGCGGTGGTCCCCTCTCGGACCAAC
CCCACGCACGAGAAGGTGCTGGCGATCGTGAACGCGCTGGCGGAGAACAAGGC
CATCCGTCCCGACGAGGCCGGGCTGGTGTACAACGCCCTGCTGGAGCGCGTGGG
CCGCTACAACAGCACGAACGTGCAGTCCAACCTGGACCGGCTGGTGACGGACGT
GCGCGAGGCCGTGGCGCAGCGCGAGCGGTTCAAGAACGAGGGCCTGGGCTCGC
TGGTGGCGCTGAACGCCTTCCTGGCGACGCAGCCGGCGAACGTGCCGCGCGGGC
AGGACGATTACACCAACTTTATCAGCGCGCTGCGGCTGATGGTGACCGAGGTGC
CCCAGAGCGAGGTGTACCAGTCGGGCCCGGACTACTTTTTCCAGACGAGCCGGC
AGGGCTTGCAGACGGTGAACCTGAGCCAGGCTTTCAAGAATCTGCGCGGGCTGT
GGGGCGTGCAGGCGCCCGTGGGCGACCGGTCGACGGTGAGCAGCTTGCTGACGC
CCAACTCGCGGCTGCTGCTGCTGATCGCGCCCTTCACCGACAGCGGCAGCGT
GAACCGCAACTCGTACCTGGGCCACCTGCTGACGCTGTACCGCGAGGCCATAGG
CCAGGCGCAGGTGGACGAGCAGACCTTCCAGGAGATCACGAGCGTGAGCCGCG
CGCTGGGGCAGAACGACACCGACAGTCTGAGGGCCACCCTGAACTTTTTGCTGA
CCAATAGACAGCAGAAGATCCCGGCGCAGTACGCGCTATCGGCCGAGGAGGAA
AGGATCCTGAGATATGTGCAGCAGAGCGTAGGGCTGTTCCTAATGCAGGAGGGC
GCCACCCCCAGCGCCGCGCTGGACATGACCGCGCGCAACATGGAACCTAGCATG
TACGCCGCCAACCGGCCGCGTTCATCAATAAGCTGATGGACTACCTGCACCGCGCG
GCGGCCATGAACACGGACTACTTTACCAACGCCATCCTGAACCCGCACTGGCTC
CCGCCGCCGGGGTTCTACACTGGCGAGTACGACATGCCCGACCCCAACGACGGG
TTCCTGTGGGACGACTGGACAGCGCGGTGTTCTCCCCGACCTTGCAAAAGCGC
CAGGAGGCGGTGCGCACGCCCGCCAGCGAGGGCGCGGTGGGTCGCAGCCCCTTT
CCTAGCTTAGGGAGTTTGCATAGCTTGCCGGGCTCGGTGAACAGCGGCAGGGTG
AGCCGGCCGCGCTTGCTGGGCGAGGACGAGTACCTGAACGACTCGCTGCTGCAG
CCGCCCACGGGTCAAGAACGCCATGGCCAATAACGGGATAGAGAGTCTGGTGGA
CAAACTGAACCGCTGGAAGACCTACGCTCAGGACCATAGGGACGCGCCCGCGCC
GCGGCGACAGCGCCACGACCGGCAGCGGGGCCTGGTGTGGGACGACGAGGACT
CGGCCGACGATAGCAGCGTGTTGGACTTGGGCGGGAGCGGTGGGGCCAACCCGT
TCGCGCATCTGCAGCCCAAACTGGGGCGGCGGATGTTTTGAAATGCAAAATAAA
ACTCACCAAGGCCATAGCGTGCGTTCTCTTCCTTGTTAGAGATGAGGCGCGCGGT
GGTGTCTTCCTCTCCTCCTCCCTCGTACGAGAGCGTGATGGCGCAGGCGACCCTG
GAGGTTCCGTTTGTGCCTCCGCGGTATATGGCTCCTACGGAGGGCAGAAACAGC
ATTCGTTACTCGGAGCTGGCTCCGCTGTACGACACCACTCGCGTGTACTTGGTGG
ACAACAAGTCGGCGGACATCGCTTCCCTGAACTACCAAAACGACCACAGCAACT
TCCTGACCACGGTGGTGCAGAACAACGATTTCACCCCCGCCGAGGCCAGCACGC
AGACGATAAATTTTGACGAGCGGTCCCGGTGGGCGGTGATCTGAAGACCATTC
TGCACACCAACATGCCCAATGTGAACGAGTACATGTTCACCAGCAAGTTTAAGG
CGCGGGTGATGGTGGCTAGGAAGCACCCACAGGGGGTAGAAGCAACAGATTTA
AGTCAGGATAAGCTTGAGTATGATTGGTTTGAGTTTACCCTGCCCGAGGGCAACT
TTTCCGAGACCATGACCATAGACCTGATGAACAACGCCATCTTGGAAAACTACT
TGCAAGTGGGGCGGCAAAATGGCGTGCTGGAGAGCGATATCGGAGTCAAGTTTG
ACAGCAGGAATTTCAGACTGGGCTGGGACCCGGAGACCAAGCTGGTGATGCCAG
GTGTCTACACCTACGAGGCCTTCCACCCGGACGTGGCTGCTGCCGGGCTGCG
GGGTGGACTTCACCGAGAGCCGCCTGAGCAACCTCCTGGGCATTCGCAAGAAGC
AACCTTTCCAAGAGGGCTTCAGGATCATGTATGAGGATCTAGAAGGGGGCAACA
TCCCCGCACTCCTTGATGTGGCCAAGTACTTGGAAAGCAAGAAGGAACTTGAGG
ATGCTGCCAAGGAAGCTGCAAAGCAACAGGGAGATGGCGCTGTCACTAGAGGC |

TABLE 7-continued

Nucleic Acid Sequences of Vectors

SEQ ID NO Sequence

```
GATACCCACCTCACTGTAGCTCAAGAAAAAGCAGCTGGAAAGGAGCTAGTGATT
GTTCCCATTGAGAAAGATGAAAGCAACAGAAGCTACAACCTGATCAAGGATACC
CATGACACCCTGTACCGAAGTTGGTACCTGTCCTATACCTACGGGGACCCCGAG
AAGGGGGTGCAGTCGTGGACGCTGCTCACCACCCCGGACGTCACCTGCGGCGCG
GAGCAAGTCTACTGGTCGCTGCCGGACCTCATGCAAGACCCGGTCACCTTCCGCT
CCACCCAGCAAGTCAGCAACTACCCCGTGGTCGGCGCCGAGCTCATGCCCTTCC
GCGCCAAGAGCTTTTACAACGACCTCGCCGTCTACTCCCAGCTCATCCGCAGCTA
CACCTCCCTCACCCACGTCTTCAACCGCTTCCCCGACAACCAGATCCTCTGCCGC
CCGCCCGCGCCCACCATCACCACCGTCAGTGAAAACGTGCCTGCTCTCACAGAT
CACGGGACGCTACCGCTGCGCAGCAGTATCCGCGGAGTCCAGCGAGTGACCGTC
ACTGACGCCCGTCGCCGCACCTGTCCCTACGTCTACAAGGCCCTGGGCATAGTCG
CGCCGCGCGTGCTATCCAGTCGCACCTTCTAAAAAATGTCTATTCTCATCTCGCC
CAGCAATAACACCGGCTGGGGTCTTACTAGGCCCAGCACCATGTACGGAGGAGC
CAAGAAGCGCTCCCAGCAGCACCCCGTCCGCGTCCGCGGCCACTTCCGCGCTCC
CTGGGGCGCTTACAAGCGCGGGCGGACTTCCACCGCCGTGCGCACCACCGTCGA
CGACGTCATCGACTCGGTGGTCGCCGACGCGCGCAACTACACCCCCGCCCCCTC
GACCGTGGACGCGGTCATCGACAGCGTGGTGGCCGACGCGCGCGACTATGCCAG
ACGCAAGAGCCGGCGGCGACGGATTGCCAGGCGCCACCGGAGCACGCCCGCCA
TGCGCGCCGCCCGGGCTCTGCTGCGCCGCGCCAGACGCACGGGCCGCCGGGCCA
TGATGCGAGCCGCGCGCCGCGCCGCCGCCGCACCCACCCCCGCAGGCAGGACTC
GCAGACGAGCGGCCGCCGCCGCCGCGGCCATCTCTAGCATGACCAGACCCA
GGCGCGGAAACGTGTACTGGGTGCGCGACTCCGTCACGGGCGTGCGCGTGCCCG
TGCGCACCCGTCCTCCTCGTCCCTGATCTAATGCTTGTGTCCTCCCCCGCAAGCG
ACGATGTCAAAGCGCAAATCAAGGAGGAGATGCTCCAGGTCGTCGCCCCGGA
GATTTACGGACCACCCCAGGCGGACCAGAAACCCCGCAAAATCAAGCGGGTTAA
AAAAAAGGATGAGGCGGACGAGGGGGCAGTAGAGTTTGTGCGCGAGTTCGCTC
CGCGGCGGCGCGTAAATTGGAAGGGGCGCAGGGTGCAGCGCGTGTTGCGGCCC
GGCACGGCGGTGGTGTTCACGCCCGGCGAGCGGTCCTCGGTCAGGATGAAACGT
AGCTATGACGAGGTGTACGGCGACGACGACATCCTGGACCAGGCGGCGGAGCG
GGCGGGCGAGTTCGCCTACGGGAAGCGGTCTCGCGAAGAGGAGCTGATCTCGCT
GCCGCTGGACGAGAGCAACCCCACGCCGAGCCTGAAGCCCGTGACCCTGCAGCA
GGTGCTGCCCCAGGCGGTGCTGCTGCCGAGCGCGGGGTCAAGCGCGAGGGCGA
GAGCATGTACCCGACCATGCAGATCATGGTGCCCAAGCGCCGGCGCGTGGAGGA
CGTGCTGGACACCGTGAAAATGGATGTGGAGCCCGAGGTCAAGGTGCGCCCCAT
CAAGCAGGTGGCGCCGGGCCTGGGCGTGCAGACCGTGGACATTCAGATCCCCAC
CGACATGGATGTCGACAAAAAACCCTCGACCAGCATCGAGGTGCAGACCGACCC
CTGGCTCCCAGCTTCTACCGCCACCGCCTCTACATCTACGGTTGCCACGGCTACC
GAGCCTCCCAGGAGGCGAAGATGGGGCGCCGCCAGCCGGCTGATGCCCAACTAC
GTGTTGCATCCTTCCATCATCCCGACGCCGGGCTACCGCGGCACCCGGTACTACG
CCAGCCGCAGGCGCCCAGCCAGCAAACGCCGCCGCCGCACCACCACCCGCCGCC
GTCTGGCCCCCGCCCGCGTGCGCCGCGTGACCACGCGCCGGGGCCGCTCGCTCG
TTCTGCCCACCGTGCGCTACCACCCCAGCATCCTTTAATCCGTGTGCTGTGATAC
TGTTGCAGAGAGATGGCTCTCACTTGCCGCCTGCGCATCCCCGTCCCGAATTACC
GAGGAAGATCCCGCCGCAGGAGAGGCATGGCAGGCAGCGGCCTGAACCGCCGC
CGGCGGCGGGCCATGCGCAGGCGCCTGAGTGGCGGGTTCCTGCCCCGCGCTCATC
CCCATAATCGCCGCGGCCATCGGCACGATCCCGGGCATAGCTTCCGTGGCGCTG
CAGGCGTCGCAGCGCCGTTGATGCGCGAATAAAGCCTCTTTAGACTCTGACACA
CCTGGTCCTGTATATTTTTAGAATGGAAGACATCAATTTTGCGTCCCTGGCTCCG
CGGCACGGCACGCGGCCGTTCATGGGCACCTGGAACGAGATCGGCACCAGCCAG
CTGAACGGGGGCGCCTTCAATTGGAGCAGTGTCTGGAGCGGGCTTAAAAATTTC
GGCTCGACGCTCCGGACCTATGGGAACAAGGCCTGGAATAGTAGCACGGGGCA
GTTGTTAAGGGAAAAGCTCAAAGACCAGAACTTCCAGCAGAAGGTGGTGGACG
GCCTGGCCTCGGGCATTAACGGGGTGGTGGACATCGCGAACCAGGCCGTGCAGC
GCGAGATAAACAGTCGCCTGGACCCGCGCCCGCCCGCCGCCACGGTGGTGGAGA
TGGAAGATGCAAGTGCGCATCCTCCGCCCAGGGGCGAGAAGCGGCCGCGACCC
GACGCGGAGGAGACGACCCTGCAGGTGGACGAGCCTCCCTCGTACGAGGAGGC
CGTCAAGGCCGGCATGCCCACCACGCGCATCATCGCGCCGCTGGCCACGGGAGT
GATGAAACCCGCCACCCTAGACTTGCCTCCACCACCCGCGCCCGCTCCACCAAA
GGCAGCTCCCGCGGTCGTGCAGCCCCCCCCGGTGGCGACCGCCGTGCGCCGCGT
CCCCGCCCGCCGCCAGGCCCAGAACTGGCAGAGCACGCTGCACAGTATCGTGGG
CCTGGGAGTGAAAAGTCTGAAGCGCCGCCGATGCTATTGAGAGAGGAAAGA
GGACACTAAAGGGAGAGCTTAACTTGTATGTGCCTTACCGCCAGAGAACGCGCG
AAGATGGCCACCCCCTCGATGATGCCGCAGTGGGCGTACATGCACATCGCCGGG
CAGGACGCCTCGGAGTACCTGAGCCCGGGTCTGGTGCAGTTTGCCCGCGCCACC
GACACGTACTTCAGCCTGGGCAACAAGTTTAGGAACCCCACGGTGGCTCCCACC
CACGATGTGACCACGGACCGGTCCCAGCGTCTGACGCTGCGCTTCGTGCCCGTG
GATCGCGAGGACACCACGTACTCGTACAAGGCGCGCTTCACTCTGGCCGTGGGC
GACAACCGGGTGCTAGACATGGCCAGCACTTACTTTGACATCCGCGGCGTCCTG
GACCGCGGTCCCAGCTTCAAACCCTACTCGGGACACGCTTACAACAGCCTGGCC
CCCAAGAGCGCTCCCAATCCCAGCCAGTGGGTTGCCAAAGAAAATGGTCAGGGA
ACTGATAAGACACATACTTATGGCTCAGCTGCCATGGGAGGAAGCAACATCACC
ATTAAAGGTTTAGTAATTGGAACTGATGAAAAAGCTGAGGATGGCCAAAAGAT
ATTTTTGCAAATAAACTTTATCAGCCAGAACCCCAGGTAGGAGAAGAAAACTGG
CAAGAGTCTGAAGCCTTCTATGGAGGCAGAGCTCTTAAGAAAGACACAAAAATG
AAGCCCTGCTATGGCTCATTTGCAAGACCTACCAATGAAAAGGCGGACAAGCT
AAATTTAAGCCAGTGGAAGAGGGGCAACAACCTAAAGATTATGACATAGATTTG
```

TABLE 7-continued

Nucleic Acid Sequences of Vectors

SEQ ID NO Sequence

GCTTTCTTTGACACACCTGGAGGCACCATCACAGGAGGCACAGGCGAAGAATAT
AAAGCAGACATTGTGTTGTACACTGAAAATGTCAACCTTGAAACCCCAGACACC
CACGTGGTATACAAGCCAGGAAAAGAGGATGACAGTTCAGAAGTAAATTTGAC
ACAGCAGTCCATGCCCAACAGGCCTAACTACATTGGCTTCAGAGACAACTTTGT
GGGGCTCATGTATTACAACAGTACTGGTAACATGGGTGTGCTGGCTGGTCAGGC
CTCTCAGTTGAATGCTGTGGTCGACTTGCAAGACAGAAACACCGAGCTGTCTTAC
CAGCTCTTGCTAGATTCTCTGGGTGACAGAACCAGATACTTTAGCATGTGGAACT
CTGCGGTGGATAGCTATGATCCCGATGTCAGGATCATTGAAAATCATGGTGTGG
AAGATGAGCTTCCCAACTACTGCTTCCCGTTGAATGGCACTGGCACCAATTCCAC
TTATCAAGGCGTAAAGGTGAAACCAGATCAAGATGGTGATGTTGAGAGCGAGTG
GGATAAAGATGATACCATTGCAAGGCAGAATCAAATCGCCAAGGGCAACGTCTT
TGCCATGGAGATCAACCTCCAGGCCAACCTGTGGAAGAGTTTTCTGTACTCGAA
CGTGGCCCTGTACCTGCCCGACTCCTACAAGTACACGCCTGCCAACGTCACGCTG
CCCACCAACACCAACACCTATGAGTACATGAACGGCCGCGTGGTGGCCCCCTCG
CTGGTGGACGCCTACATCAACATCGGCGCCCGCTGGTCGCTGGATCCCATGGAC
AATGTCAACCCCTTCAACCACCACCGCAATGCGGGCCTGCGCTATCGCTCCATGC
TGCTGGGCAACGGCCGCTACGTGCCCTTCCACATCCAAGTGCCCCAAAAGTTCTT
TGCCATCAAGAACCTGCTCCTGCTCCCCGGCTCCTACACCTACGAGTGGAACTTC
CGCAAGGATGTCAACATGATCCTGCAGAGTTCCCTGGGCAACGACCTGCGCGTC
GACGGCGCCTCCGTTCGCTTCGACAGCGTCAACCTCTACGCCACCTTCTTCCCCA
TGGCGCACAACACCGCCTCCACCCTGGAAGCCATGCTGCGCAACGACACCAACG
ACCAGTCCTTCAACGACTACCTCTCGGCCGCCAACATGCTCTACCCCATCCCGGC
CAAGGCCACCAACGTGCCCATCTCCATCCCCTCGCGCAACTGGGCCGCCTTCCGC
GGCTGGAGTTTCACGCGGCTCAAGACCAAGGAAACTCCCTCCCTCGGCTCGGGT
TTCGACCCATACTTTGTCTACTCGGGCTCCATCCCCTACCTCGACGGGACCTTCT
ACCTCAACCACACCTTCAAGAAGGTCTCCATCATGTTCGACTCCTCGGTCAGCTG
GCCCGGCAACGACCGGCTGCTCACGCCGAACGAGTTCGAGATCAAGCGCAGCGT
CGACGGGGAGGGCTACAACGTGGCCCAATGCAACATGACCAAGGACTGGTTCCT
CGTCCAGATGCTCTCCCACTACAACATCGGCTACCAGGGCTTCCACGTGCCCGAG
GGCTACAAGGACCGCATGTACTCCTTCTTCCGCAACTTCCAGCCCATGAGCAGGC
AGGTGGTCGATGAGATCAACTACAAGGACTACAAGGCCGTCACCCTGCCCCTTCC
AGCACAACAACTCGGGCTTCACCGGCTACCTTGCACCCACCATGCGTCAGGGGC
AGCCCTACCCCGCCAACTTCCCCTACCCGCTCATCGGCCAGACCGCCGTGCCCTC
CGTCACCCAGAAAAAGTTCCTCTGCGACAGGGTCATGTGGCGCATCCCCTTCTCC
AGCAACTTCATGTCCATGGGCGCCCTCACCGACCTGGGTCAGAACATGCTCTAC
GCCAACTCGGCCCACGCGCTCGACATGACCTTCGAGGTGGACCCCATGGATGAG
CCCACCCTCCTCTATCTTCTCTTCGAAGTTTTCGACGTGGTCAGAGTGCACCAGC
CGCACCGCGGCGTCATCGAGGCCGTCTACCTGCGCACGCCCTTCTCCGCCGGCA
ACGCCACCACCTAAGCATGAGCGGCTCCAGCGAACGAGAGCTCGCGGCCATCGT
GCGCGACCTGGGCTGCGGGCCCTACTTTTTGGGCACCCACGACAAGCGCTTCCC
GGGCTTCCTCGCCGGCGACAAGCTGGCCTGCGCCATCGTCAACACGGCCGGCCG
CGAGACCGGAGGCGTGCACTGGCTCGCCTTTGGCTGGAACCCGCGCTCGCGCAC
CTGCTACATGTTCGACCCCTTTGGGTTCTCGGACCGCCGGCTCAAGCAGATTTAC
AGCTTCGAGTACGAGGCCATGCTGCGCCGAAGCGCCCTGGCCTCCTCGCCCGAC
CGCTGTCTCAGCCTCGAGCAGTCCACCCAGACAGTGCAGGGGCCCGACTCCGCC
GCCTGCGGACTTTTCTGTTGCATGTTCTTGCATGCCTTCGTGCACTGGCCCGACC
GACCCATGGACTGGAACCCCACCATGAACTTGCTGACGGGGTGCCCAACGGCA
TGCTACAATCGCCACAGGTGCTGCCCACCCTCCGGCGCAACCAGGAGGAGCTCT
ACCGCTTCCTCGCGCGCCACTCCCCCTACTTTCGCTCCCACCGCGCCGCCATCGA
ACACGCCACCGCTTTTGATAAAATGAAACAACTGCGTGTATCTCAATAAACAGC
ACTTTTATTTTACATGCACTGGAGTATATGCAAGTTATTTAAAAGTCGAAGGGGT
TCTCGCGCTCGTCGTTGTGCGCCGCGCTGGGGAGGGCCACGTTGCGGTACTGGTA
CTTGGGCTGCCACTTGAACTCGGGGATCACCAGTTTGGGAACCGGAATCTCGGG
GAAGGTCTCGCTCCACATGCGCCGGCTCATCTGCAGGACGCCCAGCATGTCGGG
CGCGGAGATCTTGAAATCGCAGTTGGGGCCGGTGCTCTGCGCGCGCGAGTTGCG
GTACACGGGGTTGCAGCACTGGAACACCATCAGACTGGGGTACTTGACGCTGGC
CAGCACGCTCTTGTCGCTGATCTGATCCTTGTCCAGGTCCTCGGCGTTGCTCAGG
CCGAACGGGGTCATCTTGCACAACTGGCGGCCCAGGAAGGGCACGCTGTGGGGC
TTGTGGTTACACTCGCAGTGTACGGGCATCAGCATCATCCCCGCGCCGCGCTGCA
TATTCGGGTAGAGGGCCTTGACGAAGGCCATGATCTGCTTGAAAGCTTGCTGGG
CCTTGGCCCCCTCGCTGAAGAACAGGCCGCAGCTCTTCCCGCTGAACTGGTTATT
CCCGCACCCGGCATCCTGCACGCAGCAGCGCGTCGTGGCTGGTCAGTTGCAC
CACGCTTCTCCCCCATCGGTTCTGGGTCACCTTGGCCTTGCTGGGCTGCTCCTTCA
ACGCGCGCTGCCCGTTCTCGCTGGTCACATCCATCTCCACCACGTGGTCCTTGTG
GATCATCACCGTCCCGTGCAGACACTTGAGCTGACCTTCGACCTCGGTGCATCCG
TGGTCCCACAGGACGCAGCCGGTGCACTCCCAGTTCTTGTGCGCGATCCCGCTGT
GGCTGAAAATGTAACCTTGCAACAGGCGGCCCATCACGGTGCTAAAGGTTTTCT
GGGTGGTGAAGGTCAATTGCAGCCCGCGGGCCTCCTCGTTCATCCAGGTCTGGC
ACATCTTTTGGAAGATCTCGGTCTGCTCGGGCATGAGCTTGAAAGCATCGCGCA
GGCCGCTGTCGACGCGGTAGCGTTCCATCAGCACGTTCATGGCATCCATGCCCTT
CTCCCAGGACGAGACCAGAGGCAGACTCAGGGGGTTGCGCACGTTCAGAATACC
GGGGGTCGCGGGTTCGACGATGCGTTTTCCGTCCTTGCCTTCCTTCAACAGAACC
GGCGGCTGGCTGAATCCCACTCCCACGATCACGGCATCTTCTTCCTGGGGCATCT
CTTCGTCGGGTCTACCTTGGTCACATGCTTGGTCTTTCTGGCTTGCTTCTTTTTT
GGAGGGCTGTCCATGGGAACCACGTCCTCCTCGGAAGACCCGGAGCCCACCCGC
TGATACTTTCGGCGCTTGGTGGGCAGAGGAGGTGGTGGCGGCGAGGGGCTCCTC

TABLE 7-continued

Nucleic Acid Sequences of Vectors

SEQ ID NO Sequence

TCCTGCTCCGGCGGATAGCGCGCCGACCCGTGACCCCGGGGCGGAGTGGCCTCT
CGGTCCATGAACCGGCGCACGTCCTGACTGCCGCCGGCCATTATTTCCTAGGGG
AAGATGGAGGAGCAGCCGCGTAAGCAGGAGCAGGAGGAGGACTTAACCACCCA
CGAGCAACCCAAAATCGAGCAGGACCTGGGCTTCGAAGAGCCGGCTCGTCTAGA
ACCCCCACAGGATGAACAGGAGCACGAGCAAGACGCAGGCCAGGAGGAGACCG
ACGCTGGGCTCGAGCATGGCTACCTGGGAGGAGAGGAGGATGTGCTGCTGAAAC
ACCTGCAGCGCCAGTCCCTCATCCTCCGGGACGCCCTGGCCGACCGGAGCGAAA
CCCCCCTCAGCGTCGAGGAGCTGTGTCGGGCCTACGAGCTCAACCTCTTCTCACC
GCGCGTACCCCCCAAACGCCAGCCCAACGGCACATGCGAGCCCAACCCGCGTCT
CAACTTCTATCCCGTCTTTGCGGTCCCCGAGGCCCTCGCCACCTATCACATCTTTT
TCAAGAACCAAAAGATCCCCGTCTCCTGCCGCGCCAACCGCACCCGCGCCGACG
CGCTCCTTGCTCTGGGGCCCGGCGCGCGCATACCTGATATCGCTTCCCTGGAAGA
GGTGCCCAAGATCTTCGAAGGGCTCGGTCGGACGAGACGCGCGCGGCGAACG
CTCTGAAAGAAACAGCAGAGGAAGAGGGTCACACTAGCGCCCTGGTAGAGTTG
GAAGGCGACAACGCCAGGCTGGCCGTGCTCAAGCGCAGCGTCGAGCTCACCCAC
TTCGCCTACCCCGCCGTCAACCTCCCGCCCAAGGTCATGCGTCGCATCATGGATC
AGCTCATCATGCCCCACATCGAGGCCCTCGATGAGACCCAAGAGCAGCGCCCCG
AGGACGCCCAACCAGTGGTCAGCGACGAGATGCTCGCGCGCTGGCTCGGGACCC
GCGACCCCCAGGCCCTGGAGCAGCGGCGCAAGCTCATGCTGGCCGTGGTGTTGG
TCACCCTAGAGCTGGAATGCATGCGCCGCTTCTTCAGCGACCCCGAGACCCTGC
GCAAGGTCGAGGAGACCCTGCACTACACTTTCAGACACGGTTTCGTCAGGCAGG
CCTGCAAGATCTCCAACGTGGAGCTGACCAACCTGGTCTCCTGCCTGGGGATCCT
GCACGAGAACCGCTGGGGCAGACCGTGCTCCACTCCACCCTGAAGGGCGAGGC
GCGGCGGGACTACGTCCGCGACTGCGTCTTTCTCTTTCTCTGTCACACCTGGCAA
GCGGCCATGGGCGTGTGGCAGCAGTGTCTCGAAGACGAGAACCTGAAGGAGCT
GGACAAGCTTCTTGCTAGAAACCTCAAAAAGCTGTGGACGGGCTTCGACGAGCG
GACCACCGCCGCCGACCTGGCCGAGATCGTTTTCCCCGAGCGCCTGAGGCAGAC
GCTGAAAGGCGGACTGCCCGACTTCATGAGCCAGAGCATGATACAAAACTACCG
CACTTTCATTCTCGAGCGATCTGGGATGCTGCCCGCCACCTGCAACGCCTTCCCC
TCCGACTTTGTCCCGCTGAGCTACCGCGAGTGTCCCCGCCGCTGTGGAGCCACT
GCTACCTCTTGCAGCTGGCCAACTACATCGCCTACCACTCGGACGTGATCGAGG
ACGTGAGCGGCGAGGGCCTGCTCGAGTGCCACTGCCGCTGCAACCTGTGCTCCC
CGCACCGCTCCCTGGTCTGCAACCCCCAGCTCCTGAGCGAAACCCAGGTCATCG
GTACCTTCGAGCTGCAAGGTCCGCAGGAGTCCACCGCTCCGCTGAAACTCACGC
CGGGGTTGTGGACTTCCGCGTACCTGCGCAAATTTGTACCCGAGGACTACCACG
CCCACGAGATAAAGTTCTTCGAGGACCAATCGCGCCCGCAGCACGCGGATCTCA
CGGCCTGCGTCATCACCCAGGGCGCGATCCTCGCCCAATTGCACGCCATCCAAA
AATCCCGCCAAGAGTTTCTTCTGAAAAAGGGTAGAGGGGTCTACCTGGACCCCC
AGACGGGCGAGGTGCTCAACCCGGGTCTCCCCCAGCATGCCGAGGAAGAAGCC
GCTAGTGGAGGAGGAGATGGAAGAAGAATGGGACAGCCAGGCAGAGGAGGAC
GACTGGGAGGAGGAGGAGAGTACAGAGGAGGAAGAATTGGAAGAGGTGGAAG
AGGAGCAGGCAACAGAGCAGCCCGTCGCCGCACCATCCGCGCCGGCAGCCCCG
CCGGTCACGGATACAACCTCCGCAGCACCTCCGGCCAAGCCTCCTCGTAGATGG
GATCGAGTGAAGGGTGACGGTAAGCACGAGCGGCAGGGCTACCGATCATGGAG
GGCCCACAAAGCCGCGATCATCGCCTGCTTGCAAGACTGCGGGGGGAACATCGC
TTTCGCCCGCCGCTACCTGCTCTTCCATCGCGGGGTGAACATCCCCCGCAACGTG
TTGCATTACTACCGTCACCTTCACAGCTAAGAAAAAATCAGAAGTAAGAGGAGT
CGCCGGAGGAGGAGGCCTGAGGATCGCGGCGAACGAGCCCTCGACCACCAGGG
AGCTGAGGAACCGGATCTTCCCCACTCTTTATGCCATTTTTCAGCAGAGTCGAGG
TCAGCAGCAAGAGCTCAAAGTAAAAAATCGGTCTCTGCGCTCGCTCACCCGCAG
TTGCTTGTACCACAAAAACGAAGATCAGCTGCAGCGCACTCTCGAAGACGCCGA
GGCTCTGTTCCACAAGTACTGCGCGCTCACTCTTAAAGACTAAGGCGCGCCCACC
CGGAAAAAAGGCGGGAATTACCTCATCGCCACCACCATGAGCAAAGAGATTCCC
ACACCTTACATGTGGAGCTATCAGCCCCAGATGGGCCTGGCCGCGGGCGCTCC
CAGGACTACTCCACCCGCATGAACTGGCTCAGTGCCGGGCCCTCGATGATCTCA
CGGGTCAACGGGGTCCGTAACCATCGAAACCAGATATTGTTGGAGCAGGCGGCG
GTCACCTCCACGCCCAGGGCAAAGCTCAACCCGCGTAATTGGCCCTCCACCCTG
GTGTATCAGGAAATCCCCGGGCCGACTACCGTACTACTTCCGCGTGACGCACTG
GCCGAAGTCCGCATGACTAACTCAGGTGTCCAGCTGGCCGGCGGCGCTTCCCGG
TGCCCGCTCCGCCCACAATCGGGTATAAAAACCCTGGTGATCCGAGGCAGAGGC
ACACAGCTCAACGACGAGTTGGTGAGCTCTTCGATCGGTCTGCGACCGGACGGA
GTGTTCCAACTAGCCGGAGCCGGGAGATCCTCCTTCACTCCCAACCAGGCCTACC
TGACCTTGCAGAGCAGCTCTTCGGAGCCTCGCTCGGGAGGCATCGGAACCCTCC
AGTTCGTGGAGGAGTTTGTGCCCTCGGTCTACTTCAACCCCTTCTCGGGCTCGCC
AGGCCTCTACCCGGACGAGTTCATACCGAACTTCGACGCAGTGAGAGAAGCGGT
GGACGGCTACGACTGAATGTCCTATGGTGACTCGGCTGAGCTCGCTCGGTTGAG
GCATCTGGACCACTGCCGCCGCCTGCGCTGCTTCGCCCGGGAGAGCTGCGGACT
CATCTACTTTGAGTTTCCCGAGGAGCACCCCAACGGCCCTGCACACGGAGTGCG
GATCACCGTAGAGGGCACCACCGAGTCTCACCTGGTCAGGTTCTTCACCCAGCA
GCCCTTCCTGGTCGAGCGGGACCGGGGCGCCACCACCTACACCGTCTACTGCAT
CTGTCCTACCCCGAAGTTGCATGAGAATTTTTGCTGTACTCTTTGTGCTGAGTTTA
ATAAAAGCTGAAATAAGAATCTTCTCTGGACCTTGTCATCGACCTCGGAATCGC
ACCGTCTTACTCACCAACCAGACCAAGGTTCGACTGAACTGTACAACCAACAGG
AAGTACCTTCTTTGGTCCTTCCAAAACACCTCACTCGCTGTTGTCAACGCCCGTG
ACGACGACGGTGTTTTAATCCCAAACAACCTCACCAGTGGACTTACTTTCTCTAC
CAACAAAACAAAGCTCATCCTTCACCACCCTTTTTGTAGAGGGAACCTACCAGTG

TABLE 7-continued

Nucleic Acid Sequences of Vectors

SEQ ID NO Sequence

```
CCGACACGGACCTTGTGTTCACAACTTCCATTTGGTGAACCTTACCAGCAGCAGT
ACAGTTGCTCCTGAAACAACTAACCTTTCTTCTGATACTAACAAACCTCGTGTCG
GAGGTGAGCTTTGGGTTCCCTCTCTAACAGAGGGTGGGAGTCATATTGAAGTGG
TCGGGTATTTGATTTTAGGGGTGGTCCTGGGTGGGTGCATAGCGGTGCTATATCA
CCTTCCTTGCTGGGTCGAAATCAGAGTCTTTATCTGCTGGGTCAGACACTGTGGG
GAGGAACCATGAAGGGGCTCTTGCTGATTATCCTTTCCCTGGTGGGGGGTTTACT
GGCCTGCCACGAACAGCCACGATGTAACATTACCACAGGGAATGAGAGGAACG
ACTGCTCTGTAGTGATCAAATGCGAGCACCAGTGTCCTTTCAACATTACATTCAA
GAATAAGACCATGGGAAATGTATGGGTGGGATTCTGGCAACCAGGAGATGAGC
AGAACTACACGGTCACTGTCCATGGTAGCGATGGAAATCACACTTTCGGTTTCA
AATTCATTTTTGAAGTCATGTGTGATATCACACTGCATGTGGCTAGACTTCATGG
CTTGTGGCCCCCTACCAAGGAGAACATGGTTGGGTTTTCTTTGGCTTTTGTGATC
ATGGCCTGCTTGATGTCAGGTCTGCTGGTAGGGGCTCTAGTGTGGTTCCTGAAGC
GCAAGCCCAGGTACGGAAATGAGGAGAAGGAAAAATTGCTATAAATTCTTTTTC
TCTTCGCAGAACCATGAATACTTTGACCAGTGTCGTGCTGCTCTCTCTTCTTGTAG
CTTTTAGTCAGGGACAAGCTGTGCATGAGAATCTTGAAATTTCTTATGGTTGTAA
TGGTACACTAATAGGGCCACCTAAAACCCCAGTTGAGTGGTATGATGGCAGAGG
ACACAAACTTTGTGCAGGAACTGATACTTTTCGCAAGGAACTAAATCACACATG
TAATTTACAAAATATGACACTTACCTTTGTTAACTTAACTCATAAGGGTACTTAC
TATGGTTTTGGCAGTGATAACAAAAACTCTAAAGTGTACCAGGTTACTATTAAGC
CACCTGTTCTGACAACACGCAGGCCTTTATTAAAACCTGAAGATGTTGTAATTAC
TAAGGGAAGCAACAAAACTCTTGTGGGTCCTCCAGATACACCAGTTGATTGGTA
TGATGGTTCAGGACATAAATTGTGTAAAGGAAAAGAAGTACACTACCCTGAACT
CAATCACACCTGTGATGAGCAGAACCTTACACTCATATTTGTCAATGCCACTTTT
AAGGGAACCTATTATGGATTTAGAAAAGATGGTACAGACAAAAAGGAGTATAG
AGTCACAATTGATGATTTATATGCAAAACAACTAAAACAGGAAAAAGATGAAA
AGCCAAGGTCTGGTCATGACAGGCAGAAAGCAAAACAGATGAAAGGCAAAAT
ATAAAAACAGAAGAAAAACAGAAACCAAAACAGAGGAAAGGCATAGACAAA
GAGATGTTGTTAAAGAAGTTAGTTTTAAAACTGGAACTAATCAAACTCTAGTGG
GTCCTCCTGGGTCTAAAGTTGATTGGCTTAAAGTGTCAAATGGTGGGACATTTAG
TGAACTTTGTAAAGGAGATGATAAACACTATTCTTGCAATTCTCAAAACTTAACA
ATAATCAACATTACCAGATCTGATGAAGGAAGCTATTATGGATCTAATGATGGT
TCAGCTCATTACAGAGTTTCAGTGTATGACCCAGTACAGAAAAAAAAGGTTATG
AAAATACAGCCACATACCACAAAAAGAACTACAACTAAAGGGACTACAAAAAG
CAGCACTAATGAATCAGATGAAAACTTTGCTTTGCAACAGGGTAATGGGGAAAA
TCAATCTGACGAATCTAATGTTCCATCAGCTACTGTGGCAATTGTGGTGGGAGTG
ATTGCGGGATTCATAACTCTGATCATTGTCATTCTGTGCTACATCTGCTGCCGCA
AGCGTCCCAGGGCTTACAATCATATGGTAGACCCACTACTCAGCTTCTCTTACTG
AGACTCAGTCACTCTCATTTCAGAACCATGAAGGCTTTCACAGCTTGCGTTCTGA
TTAGCATAGTCACACTCATTGCAGCTGCAGGATATACTCAAATTAGCATACCTAG
AGGTGGTAGCATTACATTAAATGGTACTTTTAAAAATACCACATGGACAAGATA
TCACACAAATGGTTGGAAAAAAATTTGTGAATGGAATGTTACAGCTTATAAATG
TCACAATAATGGGAGCATTACTATTACTGCCACAAATATTACTTCCGGCAGATAC
AAAGCTGACAGTTACAAAAAAGAAATTAGAACTTCATTTTTTAGAAATAATAAG
ACTACATTCGAAGATTCTGGAAATTATGAACAACAGAAATTGACTTTATTTAATC
TAACAATAATTGAGCCACCAACTACTAAGGCGCCCACTACCACTAAACCCACCA
CAGTTAGGACAACTAGGGAAACAACCACACAGCCTACTACTGTACCCACTACAC
ATCCAACCACCACAGCCAGTACAACTACCGAGACCACTACTCATACTACACAGT
TAGACACTACAGTGCAGAATAGTACTGTGCTGGTTAGGTATTTGTTGAGGGAGG
AAAGTACTACTGAACAGACAGAGGCTACCTCAAGTGCCTTCAGCAGCACTGCAA
ATTTAACTTCGCTTGCTTCGGTTAATGAAACCGTCATCGCATTGAAACTGGATCA
AGATCGAGGTTTGGATATGCAAATTACTTTTCTAATTGTCTGTGGGATCTTTATTC
TTGCGGTTCTTCTCTACTATGTCTTTTGCAAGGCCAGATCAAAGTCTCATAGAAC
AATCTACAGGCCAGTAATCGGGGATCCTCAGCCACTCCAAGTGGAAGGAGGTCT
AAGGAATCTTCTTTTCTCTTTTTCAGTATGGTGATCAGCCATGATTCCTAGGTTCT
TCCTATTTAACATCCTCTTCTGTCTCTTCAACGTGTGCGCTGCCTTCGCGGCCGTC
TCGCACGCCTCGCCCGACTGTCTCGGGCCCTTCCCCACCTACCTCCTCTTTGCCCT
GCTAACCTGCACCTGCGTCTGCAGCATTGTCTGCCTGGTCATCACCTTCCTGCAG
CTCATCGACTGGTGCTGCGCGCGCTACAATTACCTACACCGCAGTCCCGAATACA
GGGACGAGAACGTGGCCAGAATCTTAAGGCTCATCTGACCATGCAGACTCTGCT
CATACTGCTATTCCTCCTATCCCCTGCCCTCGCTGATGATTACTCAAGTGCAAAT
TCGCGGACATATGGAATTTCTTAGACTGCTATCAGGAGAAAATTGATATGCCCTC
CTATTACTTGGTGATTGTTGGGGTAGTCATGGTCTGCTCACTTTCTTTGCCA
TTATGATCTACCCCTGTTTTAATCTTGGCTGGAACTCTGTTGAGGCATTCACATAC
ACACTAGAAAGCAGTTCACTAGCCTCCACGCCACCACCCACACCGCCTCCCCGC
AGAAATCAGTTCCCCATGATTCAGTACTTAGAAGAGCCCCTCCCCGGCCCCCTT
CCACTGTTAGCTACTTTCACATAACCGGCGGCGATGACTGACAACCACCTGGAC
CTCGAGATGGACGGCCAGGCCTCCGAGCAGCGCATCCTGCAACTGCGCGTCCGT
CAGCAGCAGGAGCGGGCCGCCAAGGAGTCCTCGATGCCATCAACATCCACCAG
TGCAAGAAAGGCATCTTCTGCTTGGTCAAACAGGCAAAGATAACCTACGAGCTC
GTGTCCGGCGGCAAGCAGCATCGCCTCGCCTATGAGCTGCCCCAGCAGAGGAG
AAGTTCACCTGCATGGTGGGCGTCAACCCCATAGTCATCACCCAGCAGTCAGGC
GAGACCAGCGGCTGCATCCACTGCTCCTGCGAAAGCCCCGAGTGCATCTACTCC
CTCCTCAAGACCCTTTGCGGACTCCGCGACCTCCTCCCAATGAACTGATGTTGAT
TAAAAGCCCAAAAACCAATCAGCCCCTTCCCCCATTTCCCCATCCCCAATTACTC
ATAAGAATAAATCATTGGAACTAATCATTCAATAAAGATCACTTACTTGAAATCT
```

TABLE 7-continued

Nucleic Acid Sequences of Vectors

| SEQ ID NO | Sequence |
|---|---|
| | GAAAGTATGTCTCTGGTGTAGTTGTTCAGCAGCACCTCGGTACCATCCTCCCAGC<br>TTTGGTACTCCAGTCCCCGGCGGGCGGCAAACTTCCTCCACACCTTGAAAGGGAT<br>GTCAAATTCCTGGTCCACAATTTTCATTGTCTTCCCTCTCAGATGTCAAAGAGGC<br>TCCGGGTGGAAGATGACTTCAACCCCGTCTACCCCTATGGCTACGCGCGGAATC<br>AGAATATCCCCTTCCTCACTCCCCCCTTTGTCTCTTCCGATGGATTCCAAAACTTC<br>CCCCCTGGGGTCCTGTCGCTCAAACTGGCTGACCCAATCGCCATCGCCAATGGG<br>AATGTTTCACTCAAGGTGGGAGGGGGACTCACTGTGGAACAAGAAAGTGGAAAT<br>CTAAAGGTGAACCCTAAGGCTCCCTTGCAAGTTGCAACAGATGGAACTTTAGAG<br>CTAAATTATGATGATCCATTTAAAGTGGAAAACAACAAGCTTAGCATTAAAGCT<br>GGTCATGGTTTAGCAGTTGTAACCAAAGAAAATACAAGCTTGCCTAGCTTAGTT<br>GGCTCACTTGTTGTTTTAACTGGAAAGGGCATTGGAACCGGATCAAGTGCACAT<br>GGAGGAACAATTGATGTTAGAATTGGAGATGGAGGAGGACTATCTTTTGATGAA<br>AAGGGAGATTTAGTGGCATGGGATAAAAAAAATGACCAGCGCACCCTTTGGACA<br>ACTCCAGACCCATCACCAAATTGCAAAGTGGAAACTGAAAAGGACTCAAAGCTT<br>ACTTTAATTTTAACGAAATGCGGAAGTCAAATTTTGGCAAATGTGTCCTTGCTTG<br>TTGTAAAGGGAAAATATGAAAATATAAGTGATTCAGTTAATCCAAAAACATTTC<br>CAATAAAATTACTTTTTAATGATAAAGGTATTCTTTTAAAAGAATCAAACCTTGA<br>TGGAACATATTGGAACTTTAGAAGTGGCAGCAATAATGTTCCAAAGCCATATGA<br>AAATGCTGTTGGTTTTATGCCAAGCACAACAGCTTATCCAAAGTATGATTCTAGC<br>GCTCCAACTAATCCAGAAGATAAAAAAAGTAGTGGAAAAAATAAAATTGTGAG<br>TAATATTTATTTTGGAGGAGAAATTTATCAACCTGGCCTAATAGTTATTAAGTTT<br>AATCAGGAAAATAACTGTGCTTATTCTATCACATTTGAATTCGGATGGGGAAAA<br>ACCTATACGGCAGCCATACCCTTTGATACTTCTTCTTTCACCTTTTCATACATTGC<br>CCAAGAATGAAAACGAGAACGAATAAAGTATTTTTCAACTAATCAAGTCTTTAT<br>TGAATTTTTACACCAGCACGGGTAGTCAGTCTCCCACCACCAGCCCATTTCACAG<br>TATAAACAATTCTCTCAGCACGGGTGGCCTTAAATAGGGGAATGTTCTGATTAGT<br>GCGGGAACTGATCTTGGGGTCTATAATCCACACAGTTTCCTGGCGAGCCAAACG<br>GGGGTCGGTGATTGAGATGAAGCCGTCCTCTGAAAAGTCATCCAAGCGGGCCTC<br>ACAGTCCAAGGTCACAGTCTGGTGGAATGAGAAGAACGCACAGATTCATACTCG<br>GAAAACAGGATGGGTCTGTGCCTCTCCATCAGCGCCCTCAACAGTCTCTGCCGCC<br>GGGGCTCGGTGCGGCTGCTGCAGATGGGATCGGGATCGCAAGTCTCTCTGACTA<br>TGATCCCCACAGCCTTCAGCATCAGTCTCCTGGTGCGTCGGGCACAGCACCGCAT<br>CCTGATCTCGCTCATGTTCTCACAGTAAGTGCAGCACATTATCACCATGTTATTC<br>AGCAGCCCATAATTCAGGGTGCTCCAGCCAAAGCTCATGTTGGGG |
| SEQ ID NO: 1422 | CATCATCAATAATATACCCCACAAAGTAAACAAAAGTTAATATGCAAATGAGCT<br>TTTGAATTTAGGGCGTGGCCGACGCTGATTGGCTGTTGCAAGAACCGTTAGTGAC<br>GTCATGACGCACGACGTCAACGGTCGCCGCGGAGGCGTGGCCTAGCCCGGAAGC<br>AAGTCGCGGGGCTGATGACGTATAAAAAAGCGGACTTTAGACCCGGAAACGGC<br>CGATTTTCCCGCGGCCACGCCCGGATATGAGGTAATTCTGGGCGGATGCAAGTG<br>AAATTAGGTCATTTTGGCGCGAAAACTGAATGAGGAAGTGAAAAGCGAAAAAT<br>ACCGGTCCCGCCCAGGGCGGAATATTTACCGAGGGCCGAGAGACTTTGACCGAT<br>TACGTGGGGGTTTCGATTGCGGTGTTTTTTTCGCGAATTTCCGCGTCCGTGTCAA<br>AGTCCGGTGTTTATGTCACAGATCAGCTGATCCGCAGGGTATTTAAACCAGTCGA<br>GTCCGTCAAGAGGCCACTCTTGAGTGCCAGCGAGTAGAGATTTCTCTGAGCTCC<br>GCTCCCAGAGTCTGAGAAAAATGAGCACCTGCGCCTCCTGCCTGGAACTGTGC<br>CTATGGACATGGCCGCATTATTGCTGCAGGACTTTGTGGATACAGTATTGGAGG<br>ACGAACTGCAACCAACTCCGTTCGAGCTGGGACCCACACTTCAGGACCTATATG<br>ATCTGGAGGTAGATGCCCAGGATGACGACCCGAACGAAGAGGCTGTGAATTTAA<br>TATTTCCAGAATCTCTGATTCTTCAGGCTGACATAGCCAGCGAAGCTGTACCTAC<br>ACCACTTCATACACCGACTCTGTCGCCCATACCTGAATTGGAAGAGGAGGACGA<br>ACTAGACCTCCGGTGTTATGAGGAAGGTTTTCCTCCCAGCGATTCAGAGGACGA<br>ACGGGGTGAGCAGAGTATGGCTATAATCTCAGACTATGCTTGTGTGGTTGTGGA<br>AGAGCATTTTGTGTTGGACAATCCTGAGGTGCCAGGGCAAGGATGTAGATCCTG<br>CCAATATCACCGGGATCAGACCGGAGACTCAAATGCTTCCTGCGCTCTGTGTTAC<br>ATGAAAATGAGCTTCAGCTTTATTTACAGTAAGTGGAGTGAATGTGAGAGAGGC<br>TGAGTGCTTAACACATCACTGTGTATCGCTTGAACAGCTGTGCTAAGTGTGGTTT<br>ATTTTTGTTACTAGGTCCGGTGTCAGAGGATGAGTCATCACCCTCAGAAGAAGA<br>CCACCCGTCTCCCCCTGATCTCACAGATGACACGCCCCTGCAAGTGTTCAGACCC<br>ACCCCAGTCAGACCCAGTGGCGAGAGGCGAGCGGCTGTTGACAAAATTGAGGA<br>CTTGTTGCAGGACATGGGTGGGATGAACCTTTGGACCTGAGCTTGAAACGCCC<br>CAGGAACTAGGCGCAGCTGCGCTTAGTCATGTGTAAATAAAGTTGTACAATAAA<br>AGTATATGTGACGCATGCAAGGTGTGGTTTATGACTCATGGGCGGGCTTAGTC<br>CTATATAAGTGGCAACACCTGGGCACTTGGGCACAGACCTTCAGGGAGTTCCTG<br>ATGGATGTGTGGACTATCCTTGCAGACTTTAGCAAGACACGCCGGCTTGTAGAG<br>GATAGTTCAGACGGGTGCTCCGGGTTCTGGAGACACTGGTTTGGAACTCCTCTAT<br>CTCGCCTGGTGTACACAGTTAAGAAGGATTATAACGAGGAATTTGAAAATCTTTT<br>TGCTGACTGCTCTGGCCTGCTAGATTCTCTGAATCTTGGCCACCAGTCCCTTTTCC<br>AGGAAAGGGTACTCCACAGTCTTGATTTTTCCAGCCCAGGGCGCACTACAGCCG<br>GGGTTGCTTTTGTGGTTTTTCTGGTTGACAAATGGAGCCAGAACACCCAACTGAG<br>CAGGGGCTACATCCTGGACTTCGCGGCCATGCACCTGTGGAGGTCCTGGGTCAG<br>GCAGCGGGGACAGAGAATCTTGAACTACTGGCTTCTACAGCCAGCAGCTCCGGG<br>TCTTCTTCGTCTACACAGACAAACATCCATGTTGGAGGAAGAAATGAGGCAGGC<br>CATGGACGAGAACCCGAGGAGCGGCCTGGACCCTCCGTCGGAAGAGGAGCTGG<br>ATTGAATCAGGTATCCAGCCTGTACCCAGAGCTTAGCAAGGTGCTGACATCCAT<br>GGCCAGGGGAGTCAAGAGGGAGAGGAGCGATGGGGGCAATACCGGAATGATGA |

TABLE 7-continued

Nucleic Acid Sequences of Vectors

SEQ ID NO Sequence

```
CCGAGCTGACGGCCAGCCTGATGAATCGCAAGCGCCCAGAACGCATTACCTGGC
ACGAGCTACAGATGGAGTGCAGGGATGAGGTGGGCCTGATGCAGGATAAATAT
GGCCTGGAGCAGATAAAAACCCACTGGTTGAACCCAGATGAGGATTGGGAGGA
AGCCATTAAGAAATATGCCAAGATAGCCTTGCGCCCAGATTGCAAGTACAGGGT
GACCAAGACCGTGAATATCAGACATGCCTGCTACATCTCGGGGAACGGGGCAGA
GGTGGTCATCGATACCCTGGACAAGGCCGCCTTTAGGTGTTGCATGATGGGAAT
GAGAGCCGGAGTGATGAATATGAATTCCATGATCTTCATGAACATGAAGTTCAA
TGGAGAGAAGTTTAATGGGGTGATGTTCATGGCCAACAGCCACATGACCCTGCA
TGGCTGCAGTTTCTTTGGCTTCAACAATATGTGTGCAGAGGTCTGGGGCGCTGCT
AAGATCAGGGGATGTAAGTTTTATGGCTGCTGGATGGGCGTGGTCGGAAGACCC
AAGAGCGAGATGTCTGTGAAGCAGTGTGTGTTTGAGAAATGCTACCTGGGAGTC
TCTACCGAGGGCAATGCTAGAGTGAGACATTGCTCTTCCCTGGAGACGGGCTGC
TTCTGCCTGGTGAAGGGCACAGCCTCGATCAAGCATAATGTGGTGAAGGGCTGC
ACGGATGAGCGCATGTACAACATGCTGACCTGCGACTCGGGGGTCTGCCATATC
CTGAAGAACATCCATGTGACCTCCCACCCCAGAAAGAAGTGGCCAGTGTTTGAG
AATAACCTGCTGATCAAGTGCCATATGCACCTGGGTGCCAGAAGGGGCACCTTC
CAGCCGTACCAGTGCAACTTTAGCCAGACCAAGCTGCTGTTGGAGAACGATGCC
TTCTCCAGGGTGAACCTGAACGGCATCTTTGACATGGATGTCTCGGTGTACAAGA
TCCTGAGATACGATGAGACCAAGTCCAGGGTGCGCGCTTGCGAGTGCGGGGGCA
GACACACCAGGATGCAGCCAGTGGCCCTGGATGTGACCGAGGAGCTGAGACCA
GACCACCTGGTGATGGCTTGTACCGGGACCGAGTTCAGCTCCAGTGGGGAGGAC
ACAGATTAGAGGTAGGTTTTGAGTAGTGGGCGTGGCTAAGGTGAGTATAAAGGC
GGTGTCTTACGAGGGTCTTTTTGCTTTTCTGCAGACATCATGAACGGGACCGGCG
GGGCCTTCGAAGGGGGGCTTTTTAGCCCTTATTTGACAACCCGCCTGCCGGGATG
GGCCGGAGTTCGTCAGAATGTGATGGGATCTACGGTGGATGGGCGTCCAGTGCT
TCCAGCAAATTCCTCGACCATGACCTACGCGACCGTGGGGAGCTCGTCGCTCGA
CAGCACCGCCGCAGCCGCGGCAGCCGCAGCCGCCATGACAGCGACGAGACTGG
CCTCGAGCTACATGCCCAGCAGCGGTAGCAGCCCCTCTGCGCCCAGTTCCATCAT
CGCCGAGGAGAAACTGCTGGCCCTGCTGGCCGAGCTGGAAGCCCTGAGCCGCCA
GCTGGCCGCCCTGACCCAGCAGGTGTCCGATCTCCGCGAGCAGCAGCAGCAAAA
TAAATGATTCAATAAACACAGATTCTGATTCAAACAGTAAAGCATCTTTATTATT
TATTTTTTCGCGCGCGGTAGGCCCTGGTCCACCTCTCCCGATCATTGAGAGTGCG
GTGGATTTTTTCCAGGACCCGGTAGAGGTGGGATTGGATGTTGAGGTACATGGG
CATGAGCCCGTCCCGGGGGTGGAGGTAGCACCACTGCATGGCCTCGTGCTCTGG
GGTCGTGTTGTAGATGATCCAGTCATAGCAGGGGCGCTGGGCGTGGTGCTGGAT
GATGTCCTTGAGGAGGAGACTGATGGCCACGGGGAGCCCCTTGGTGTAGGTGTT
GGCAAAGCGGTTGAGCTGGGAGGGATGCATGCGGGGGGAGATGATGTGCAGTT
TGGCCTGGATCTTGAGGTTGGCGATGTTGCCGCCCAGATCCCGCCGGGGGTTCAT
GTTGTGCAGGACCACCAGGACGGTGTAGCCCGTGCACTTGGGGAACTTGTCATG
CAACTTGGAAGGGAATGCGTGGAAGAATTTGGAGACGCCCTTGTGCCCGCCCAG
GTTTTCCATGCACTCATCCATGATGATGGCGATGGGACCGTGGGCTGCGGCTTTG
GCAAAGACGTTTCTGGGGTCAGAGACATCATAATTATGCTCCTGGGTGAGATCA
TCATAAGACATTTTAATGAATTTGGGGCGGAGGGTGCCAGATTGGGGGACTATG
GTTCCCTCGGGTCCCGGGGCAAAGTTCCCCTCACAGATCTGCATCTCCCAGGCTT
TCATCTCGGAGGGGGGATCATGTCCACCTGCGGTGCGATGAAAAAAACGGTTT
CCGGGGCGGGAGTGATGAGCTGCGAGGAGAGCAGGTTTCTCAACAGCTGGGACT
TGCCGCACCCGGTCGGGCCGTAGATGACCCCGATGACGGGTTGCAGGTGGTAGT
TCAAGGACATGCAGCTGCCGTCGTCCCGGAGGAGGGGGCCACCTCGTTGAGCA
TGTCTCTGACTTGGAGGTTTTCCCGGACGAGCTCGCCGAGGAGGCGGTCCCCGCC
CAGCGAGAGCAGCTCTTGCAGGGAAGCAAAGTTTTTCAGGGGCTTGAGCCGTC
GGCCATGGGCATCTTCGCGAGGGTCTGCGAGAGGAGCTCCAGGCGGTCCCAGAG
CTCGGTGACGTGCTCTACGGCATCTCGATCCAGCAGACTTCCTCGTTTCGGGGT
TGGGACGACTGCGACTGTAGGGCACGAGACGATGGGCGTCCAGCGCGGCCAGC
GTCATGTCCTTCCAGGGTCTCAGGGTCCGCGTGAGGGTGGTCTCCGTCACGGTGA
AGGGGTGGGCCCCGGGCTGGGCGCTTGCAAGGGTGCGCTTGAGACTCATCCTGC
TGGTGCTGAAACGGGCACGGTCTTCGCCCTGCGCGTCGGCGAGATAGCAGTTGA
CCATGAGCTCGTAGTTGAGGGCCTCGGCGGCGTGGCCCTTGGCGCGGAGCTTGC
CATTGGAAGAGCGCCCGCAGGCGGGACAGAGGAGGGATTGCAGGGCGTAGAGC
TTGGGCGCGAGAAAGACGGACTCGGGGGCGAAGGCGTCCGCCCCGCAGTGGGC
GCAGACGGTCTCGCACTCGACGAGCCAGGTGAGCTCGGGCTGCTCGGGGTCAAA
AACCAGTTTTCCCCCGTTCTTTTTGATGCGCTTCTTACCTCGCGTCTCCATGAGTC
TGTGTCCGCGCTCGGTGACAAACAGGCTGTCGGTGTCCCCGTAGACGGACTTGA
TTGGCCTGTCCTGCAGGGGCGTCCCGGGTCCTCCTCGTAGAGAAACTCGGACC
ACTCTGAGACAAAGGCGCGCGTCCACGCCAAGACAAAGGAGGCCACGTGCGAG
GGGTAGCGGTCATTGTCAACCAGGGGGTCCACCTTTTCCACCGTGTGCAGACAC
ATGTCCCCTCCTCCGCATCCAAGAAGGTGATTGGCTTGTAGGTGTAGGCCACGT
GACCGGGGTCCCCGACGGGGGGTATAAAAGGGGCGGGTCTGTGCTCGTCCT
CACTCTCTTCCGCGTCGCTGTCCACGAGCGCCAGCTGTTGGGGTAGGTATTCCCT
CTCGAGAGCGGGCATGACCTCGGCACTCAGGTTGTCAGTTTCTAAAAACGAGGA
GGATTTGATGTTGGCTTGCCCTGCCGCGATGCTTTTTAGGAGACTTTCATCCATCT
GGTCAGAAAAGACTATTTTTTTTATTGTCAAGCTTGGTGGCGAAGGAGCCATAGA
GGGCGTTGGAGAGAAGCTTGGCGATGGATCTCATGGTCTGATTTTTGTCACGGTC
GGCGCGCTCCTTGGCCGCGATGTTTAGCTGGACATACTCGCGCGCGACGCACTTC
CATTCGGGGAAGACGGTGGTGCGCTCGTCGGGCACGATCCTGACGCGCCAGCCG
CGGTTATGCAGGGTGACCAGGTCCACGCTGGTGGCCACCTCGCCGCGCAGGGGC
TCGTTGGTCCAGCAGAGTCTGCCGCCCTTGCGCGAGCAGAACGGGGGCAGCACA
```

TABLE 7-continued

Nucleic Acid Sequences of Vectors

SEQ ID NO Sequence

TCAAGCAGATGCTCGTCAGGGGATCCGCATCGATGGTGAAGATGCCCGGACAG
AGTTCCTTGTCAAAATAATCGATTTTTGAGGATGCATCATCCAAGGCCATCTGCC
ACTCGCGGGCGGCCAGCGCTCGCTCGTAGGGGTTAAGGGGCGGACCCCAGGGCA
TGGGATGCGTGAGGGCGGAGGCGTACATGCCGCAGATGTCATACACATAGATGG
GCTCCGAGAGGATGCCGATGTAGGTGGGATAACAGCGCCCCCCGCGGATGCTGG
CGCGCACGTAGTCATACAACTCGTGCGAGGGGGCCAAGAAGGCGGGGCCGAGA
TTGGTGCGCTGGGGCTGCTCGGCGCGGAAGACGATCTGGCGAAAGATGGCATGC
GAGTTGGATGAGATGGTGGGCCGTTGGAAGATGTTAAAGTGGGCGTGGGGCAA
GCGGACCGAGTCGCGGATGAAGTGCGCGTAGGAGTCTTGCAGCTTGGCGACGAG
CTCGGCGGTGACGAGGACGTCCATGGCGCAGTAGTCCAGCGTTTCGCGGATGAT
GTCATAACCCGCCTCTCCTTTCTTCTCCCACAGCTCGCGGTTGAGGGCATACTCC
TCGTCATCCTTCCAGTACTCCCGGAGCGGGAATCCTCGATCGTCCGCACGGTAAG
AGCCCAGCATGTAGAAATGGTTCACGGCCTTGTAGGGACAGCAGCCCTTCTCCA
CGGGGAGGGCGTAAGCTTGAGCGGCCTTGCGGAGCGAGGTGTGCGTCAGGGCG
AAGGTGTCCCTGACCATGACTTTCAAGAACTGGTACTTGAAATCCGAGTCGTCGC
AGCCGCCGTGCTCCCAGAGCTCGAAATCGGTGCGCTTCTTCGAGAGGGGGTTAG
GCAGAGCGAAAGTGACGTCATTGAAGAGAATCTTGCCTGCCCGCGGCATGAAAT
TGCGGGTGATGCGGAAAGGGCCCGGCACGGAGGCTCGGTTGTTGATGACCTGGG
CGGCGAGGACGATCTCGTCGAAGCCGTTGATGTTGTGCCCGACGATGTAGAGTT
CCATGAATCGCGGGCGGCCTTTGATGTGCGGCAGCTTTTTGAGCTCCTCGTAGGT
GAGGTCCTCGGGGCATTGCAGGCCGTGCTGCTCGAGCGCCCACTCCTGGAGATG
TGGGTTGGCTTGCATGAAGGAAGCCCAGAGCTCGCGGGCCATGAGGGTCTGGAG
CTCGTCGCGAAAGAGGCGGAACTGCTGGCCCACGGCCATCTTTTCGGGGGTGAC
GCAGTAGAAGGTGAGGGGGTCCCGCTCCCAGCGATCCCAGCGTAAGCGCACGGC
GAGATCGCGAGCGAGGGCGACCAGCTCGGGGTCCCCGGAGAATTTCATGACCAG
CATGAAGGGGACGAGCTGCTTGCCGAAGGACCCCATCCAGGTGTAGGTTTCTAC
ATCGTAGGTAACAAAGAGCCGCTCCGTGCGAGGATGAGAGCCGATTGGGAAGA
ACTGGATTTCCTGCCACCAGTTGGACGAGTGGCTGTTGATGTGATGAAAGTAGA
AATCCCGCCGGCGAACCGAGCACTCATGCTGATGCTTGTAAAAGCGTCCGCAGT
ACTCGCAGCGCTGCACGGGCTGTACCTCATCCACGAGATACACAGCGCGTCCCT
TGAGGAGGAACTTCAGGAGTGGCGGCCCTGGCTGGTGGTTTTCATGTTCGCCTGC
GTGGGACTCACCCTGGGGCTCCTCGAGGACGGAGAGGCTGACGAGCCCGCGCGG
GAGCCAGGTCCAGATCTCGGCGCGGCGGGGGCGGAGAGCGAAGACGAGGGCGC
GCAGTTGGGAGCTGTCCATGGTGTCGCGGAGATCCAGGTCCGGGGGCAGGGTTC
TGAGGTTGACCTCGTAGAGGCGGGTGAGGGCGTGCTTGAGATGCAGATGGTACT
TGATCTCCACGGGTGAGTTGGTGGTCGTGTCCACGCATTGCATGAGCCCGTAGCT
GCGCGGGGCCACGACCGTGCCGCGCTTTAGAAGCGGTGTCGCGGGCGCGCTCCC
GGCGGCAGCGGCGGTTCCGGCCCCGCGGGCAGGGGCGGCAGAGGCACGTCTGC
GTGGCGCTCGGGCAGGTCCCGGTGCTGCGCCCTGAGAGCGCTGGCGTGCGCGAC
GACGCGGCGGTTGACATCCTGGATCTGCCGCCTCTGTGTGAAGACCACGGGCCC
CGTGACTTTGAACCTGAAAGACAGTTCAACAGAATCAATCTCGGCGTCATTGAC
GGCGGCCTGACGCAGGATCTCTTGCACGTCGCCCGAGTTGTCCTGGTAGGCGAT
CTCGGACATGAACTGCTCGATCTCCTCCTCCTGGAGATCGCCGCGGCCCGCGCGC
TCCACGGTGGCGGCGAGGTCATTCGAGATGCGACCCATGAGCTGCGAGAAGGCG
CCCAGGCCGCTCTCGTTCCAGACGCGGCTGTAGACCACGTCCCCGTCGGCGTCGC
GCGCGCGCATGACCACCTGCGCGAGGTTGAGCTCCACGTGCCGCGTGAAGACGG
CGTAGTTGCGCAGGCGCTGGGAGAGGTAGTTGAGGGTGGTGGCGATGTGCTCGG
TGACGAAGAAGTACATGATCCAGCGGCGCAGGGGCATCTCGCTGATGTCGCCGA
TGGCCTCCAGCCTTTCCATGGCCTCGTAGAAATCCACGGCGAAGTTGAAAAACT
GGGCGTTGCGGGCCGAGACCGTGAGCTCGTCTTCCAGGAGCCTGATGAGCTCGG
CGATGGTGGCGCGCACCTCGCGCTCGAAATCCCCGGGGGCCTCCTCTTCTTCCTC
TTCTTCCATGACGACCTCTTCTTCTATTTCTTCCTCTGGGGGCGGTGGTGGTGGCG
GGGCCCGACGACGACGGCGACGCACCGGGAGACGGTCGACGAAGCGCTCGATC
ATCTCCCCGCGGCGGCGACGCATGGTTTCGGTGACGGCGCGACCCCGTTCGCGA
GGACGCAGCGTGAAGACGCCGCCGGTCATCTCCCGGTAATGGGGCGGGTCCCCG
TTGGGCAGCGAGAGGGCGCTGACTATGCATCTTATCAATTGCGGTGTAGGGGAC
GTGAGCGCGTCGAGATCGACCGGATCGGAGAATCTTTCGAGGAAAGCGTCTAGC
CAATCGCAGTCGCAAGGTAAGCTCAAACACGTAGCAGCCCTGTGGACGCTGTTA
GAATTGCGGTTGCTGATGATGTAATTGAAGTAGGCGTTTTTGAGGCGGCGGATG
GTGGCGAGGAGGACCAGGTCCTTGGGTCCCGCTTGCTGGATGCGGAGCCGCTCG
GCCATGCCCAGGCCTGGCCCTGACACCGGCTCAGGTTCTTGTAGTAGTCATGCA
TGAGCCTCTCGATGTCATCACTGGCGGAGGCGGAGTCTTCCATGCGGGTGACCC
CGACGCCCTGAGCGGCTGCACGAGCGCCAGGTCGGCGACGACGCGCTCGGCGA
GGATGGCCTGTTGCACGCGGGTGAGGGTGTCCTGGAAGTCGTCCATGTCGACGA
AGCGGTGGTAGGCCCCGGTGTTGATGGTGTAGGTGCAGTTGGCCATGATCGACC
AGTTGACGGTCTGCAGGCCGGGCTGCACGACCTCGGAGTACCTGAGCCGCGAGA
AGGCGCGCAGTCGAAGACGTAGTCGTTGCAGGTGCGCACCAGGTACTGGTAGC
CGACTAGGAAGTGCGGCGGCGGCTGGCGATAGAGCGGCCAGCGCTGGGTGGCC
GGCGCGCCCGGGCCAGGTCCTCGAGCATGAGGCGGTGGTAGCCGTAGAGGTA
GCGGGACATCCAGGTGATGCCGGCGGCGGTGGTGGAGGCGCGCGGGAACTCGC
GGACGCGGTTCCAGATGTTGCGCAGCGGCAGGAAATAGTCCATGGTCGGCACGG
TCTGGCCGGTGAGACGCGCGCAGTCATTGACGCTCTAGAGGCAAAAACGAAAGC
GGTTGAGCGGGCTCTTCCTCCGTAGCCTGCGGAACGCAAACGGGTTAGGCCGC
GTGTGTACCCCGGTTCGAGTCCCCTCGAATCAGGCTGGACCGCGACTAACGTG
GTATTGGCACTCCCGTCTCGACCCGAGCCCGATAGCCGCCAGGATACGGCGGAG
AGCCCTTTTTGCCGGCCGCGGGGGGTCGCTAGACTTGAAAGCGGCCGAAAACCC

TABLE 7-continued

Nucleic Acid Sequences of Vectors

| SEQ ID NO | Sequence |
|---|---|
| | CGCCGGGTAGTGGCTCGCGCCCGTAGTCTGGAGAAGCATCGCCAGGGTTGAGTC
GCGGCAGAACCCGGTTCGAGGACGGCCGCGGCGAGCGGGACTTGGTCACCCCGC
CGATTTAAAGACCCACAGCCAGCCGACTTCTCCAGTTACGGGAGCGAGCCCCCT
TTTTTCTTTTTGCCAGATGCATCCCGTCCTGCGCCAAATGCGTCCCACCCCCCGG
CGACCACCGCGACCGCGGCCGTAGCAGGCGCCGGCGCTAGCCAGCCACAGACA
GAGATGGACTTGGAAGAGGGCGAAGGGCTGGCGAGACTGGGGGCGCCGTCCCC
GGAGCGACACCCCCGCGTGCAGCTGCAGAAGGACGTGCGCCCGGCGTACGTGCC
TGCGCAGAATCTGTTCAGGGACCGCAGCGGGGAGGAGCCCGAGGAGATGCGCG
ACTGCCGGTTTCGGGCGGGCAGGGAGCTGCGCGAGGGCCTGGACCGCCAGCGA
GTGCTGCGCGACGAGGATTTCGAGCCGAACGAGCAGACGGGGATCAGCCCCGC
GCGCGCGCACGTGGCGGCGGCCAACCTGGTGACGGCCTACGAGCAGACGGTGA
AGCAGGAGCGCAACTTCCAAAAGAGTTTCAACAACCACGTGCGCACCTTGATCG
CGCGCGAGGAGGTGGCCCTGGGCCTGATGCACCTGTGGGACCTGGCGGAGGCCA
TCGTGCAGAACCCGGACAGCAAGCCTCTGACGGCGCAGCTGTTCCTGGTGGTGC
AGCACAGCAGGGACAACGAGGCGTTCAGGGAGGCGCTGCTGAACATCGCCGAG
CCCGAGGGTCGCTGGCTGCTGGAGCTGATTAACATCTTGCAGAGCATCGTAGTG
CAGGAGCGCAGCCTGAGCCTGGCCGAGAAGGTGGCGGCGATCAACTACTCGGTG
CTGAGCCTGGGCAAGTTTTACGCGCGCAAGATTTACAAGACGCCGTACGTGCCC
ATAGACAAGGAGGTGAAGATAGACAGCTTTTACATGCGCATGGCGCTCAAGGTG
CTGACGCTGAGCGACGACCTGGGCGTGTACCGCAACGACCGCATCCACAAGGCC
GTGAGCACGAGCCGGCGGCGCGAGCTGAGCGACCGCGAGCTGATGCTGAGCCT
GCGCCGGGCGCTGGTAGGGGGCGCCGCCGGCGGCGAGGAGTCCTACTTCGACAT
GGGGGCGGACCTGCATTGGCAGCCGAGCCGGCGCGCCTTGGAGGCCGCCTACGG
TCCAGAGGACTTGGATGAGGAAGAGGAAGAGGAGGAGGATGCACCCGCTGCGG
GGTACTGACGCCTCCGTGATGTGTTTTAGATGCAGCAAGCCCCGGACCCCGCCA
TAAGGGCGGCGCTGCAAAGCCAGCCGTCCGGTCTAGCATCGGACGACTGGGAGG
CCGCGATGCAACGCATCATGGCCCTGACGACCCGCAACCCCGAGTCCTTTAGAC
AACAGCCGCAGGCCAACAGACTCTCGGCCATTCTGGAGGCGGTGGTCCCCTCTC
GGACCAACCCCACGCACGAGAAGGTGCTGGCGATCGTGAACGCGCTGGCGGAG
AACAAGGCCATCCGTCCCGACGAGGCCGGGCTGGTGTACAACGCCCTGCTGGAG
CGCGTGGGCCGCTACAACAGCACGAACGTGCAGTCCAACCTGGATCGGCTGGTG
ACGGACGTGCGCGAGGCCGTGGCGCAGCGCGAGCGGTTCAAGAACGAGGGCCT
GGGCTCGCTGGTGGCGCTGAACGCCTTCCTGGCGACGCAGCCGGCGAACGTGCC
GCGCGGGCAGGACGATTACACCAACTTTATCAGCGCGCTGCGGCTGATGGTGAC
CGAGGTGCCCCAGAGCGAGGTGTACCAGTCGGGCCCGGACTACTTTTTCCAGAC
GAGCCGGCAGGGCCTGCAGACGGTGAACCTGAGCCAGGCTTTCAAGAATCTGCG
CGGGCTGTGGGGCGTGCAGGCGCCCGTGGGCGACCGGTCGACGGTGAGCAGCTT
GCTGACGCCCAACTCGCGGCTGCTGCTGCTGCTGATCGCGCCCTTCACCGACAGC
GGCAGCGTGAACCGCAACTCGTACCTGGGCCACCTGCTGACGCTGTACCGCGAG
GCCATAGGCCAGGCGCAGGTGGACGAGCAGACCTTCCAGGAGATCACGAGCGT
GAGCCGCGCGCTGGGGCAGAACGACACCGACAGTCTGAGGGCCACCCTGAACTT
TTTGCTGACCAATAGACAGCAGAAGATTCCGGCGCAGTACGCACTGTCGGCCGA
GGAGGAAAGGATCCTGAGATATGTGCAGCAGAGCGTAGGGCTGTTCCTGATGCA
GGAGGGCGCCACCCCCAGCGCCGCGCTGGACATGACCGCGCGCAACATGGAAC
CTAGCATGTACGCCGCCAACCGGCCGTTCATCAATAAGCTGATGGACTACCTGC
ACCGCGCGGCGGCCATGAACACGGACTACTTTACCAACGCCATATTGAACCCGC
ACTGGCTCCCGCCGCCGGGGTTCTACACGGGCGAGTACGACATGCCCGACCCCA
ACGACGGGTTCCTGTGGGACGACGTGGACAGCGCGGTGTTCTCCCCGACCTTGC
AAAAGCGCCAGGAGGCGCCGCCGAGCGAGGGCGCGGTGGGTCGGAGTCCCTTT
CCTAGCTTAGGGAGTTTGCATAGCTTGCCGGGCTCGGTGAACAGCGGCAGGGTG
AGCCGGCCGCGCTTGCTGGGCGAGGACGAGTACCTGAACGACTCGCTGCTGCAG
CCGCCGCGGGTCAAGAACGCCATGGCCAATAACGGGATAGAGAGTCTGGTGGA
CAAACTGAACCGTTGGAAGACCTACGCTCAGGACCATAGGGATGCGCCCGCGCC
GCGGCGACAGCGCCACGACCGGCAGCGGGGCCTGGTGTGGGACGACGAGGACT
CGGCCGACGATAGCAGCGTGTTGGACTTGGGCGGGAGCGGTGGGGCCAACCCGT
TCGCGCATCTGCAGCCCAAACTGGGGCGGCGGATGTTTTGAAAAGCAAAATAAA
ACTCACCAAGGCCATAGCGTGCGTTCTCTTCCTTGTTAGAGATGAGGCGCGCGGT
GGTGTCTTCCTCTCCTCCTCCCTCGTACGAGAGCGTGATGGCGCAGGCGACCCTG
GAGGTTCCGTTTGTGCCTCCGCGGTATATGGCTCCTACGGAGGGCAGAAACAGC
ATTCGTTACTCGGAGCTGGCTCCGCAGTACGACACCACTCGCGTGTACTTGGTGG
ACAACAAGTCGGCGGACATCGCTTCCCTGAACTACCAAAACGACCACAGCAACT
TCCTGACCACGGTGGTGCAGAACAACGATTTCACCCCAGCCGAGGCCAGCACGC
AGACGATAAATTTTGACGAGCGGTCCCGGTGGGCGGTGATCTGAAGACCATTC
TGCACACCAACATGCCCAATGTGAACGAGTACATGTTCACCAGCAAGTTTAAGG
CGCGGGTGATGGTGGCTAGGAAGCATCCCAAAGAGGTTACAGATGAGAATGAT
AGAAGCAAGGATATCTTAGAGTATGAGTGGTTTGAGTTTACCCTGCCCGAGGGC
AACTTTTCCGAGACCATGACCATAGACCTGATGAACAACGCCATCTTGGAAAAC
TACTTGCAAGTGGGGCGGCAAAATGGCGTGCTGGAGAGCGATATCGGAGTCAAG
TTTGACAGCAGGAATTTCAAGCTGGGCTGGGACCCGGTGACCAAGCTGGTGATG
CCAGGGGTCTACACCTACGAGGCCTTCCACCCGGACGTGGTGCTGCTGCCGGGC
TGCGGGGTGGACTTCACCGAAAGCCGCCTGAGCAACCTCCTGGGCATTCGCAAG
AAGCAACCTTTCCAAGAGGGCTTCAGAATCATGTATGAGGATCTAGAAGGGGGC
AACATCCCTGCCCTGCTGGATGTGGATGCATACCTCAAAAGCAAGAATGATCTG
GAAGAGGCTACCAAGAAAGCGAACACAGCTGCTGCCAATGGAGGTGGTGAAAC
TAGGGGAGATACTTTTCTCACCACCGAACAGCTAAGAGCCGCTGGCAAGGAGCT
GGTTATTAAGCCCATCAAGGAAGATGCTAGCAAGAGGAGCTATAATGTCATAGG |

TABLE 7-continued

Nucleic Acid Sequences of Vectors

SEQ ID NO Sequence

```
GGATACCCATGACACCCTGTACCGAAGCTGGTACCTGTCCTATACCTACGGGGA
CCCCGAGAAGGGGGTGCAGTCGTGGACGCTGCTCACCACCCCGGACGTCACCTG
CGGCGCGGAGCAAGTCTACTGGTCGCTGCCGGACCTCATGCAAGACCCCATCAC
CTTCCGCTCCGCCCAGCAAGTCAGCAACTACCCCGTGGTCGGCGCCGAGCTCAT
GCCCTTCCGCGCCAAGAGCTTTTACAACGACCTCGCCGTCTACTCCCAGCTCATC
CGCAGCTACACTTCCCTCACCCACGTCTTCAACCGCTTCCCCGACAACCAGATCC
TCTGCCGCCCGCCCGCGCCCACCATCACCACCGTCAGTGAAAACGTGCCTGCTCT
CACAGATCACGGGACGCTACCGCTGCGCAGCAGTATCCGCGGAGTCCAGCGAGT
GACCGTCACTGACGCCCGTCGCCGCACCTGTCCCTACGTCTACAAGGCCCTGGGC
ATAGTCGCGCCGCGCGTGCTCTCCAGTCGCACCTTCTAAAAAATGTCTATTCTCA
TCTCGCCCAGCAATAACACCGGCTGGGGTCTTACTAGGCCCAGCACCATGTACG
GAGGAGCCAAGAAGCGCTCCCAGCAGCACCCCGTCCGCGTCCGCGGCCACTTCC
GCGCTCCCTGGGGCGCTTACAAGCGCGGGCGGACTTCCACCGCTGCCGCCGTGC
GCACCACCGTCGACGACGTCATCGACTCGGTGGTCGCCGACGCGCGCAACTACA
CCCCCGCCCCTCGACCGTGGACGCGGTCATCGACAGCGTGGTGGCCGACGCGC
GCGACTATGCCAGACGCAAGAGCCGGCGGCGACGGATCGCCAGGCGCCACCGG
AGCACGCCAGCCATGCGCGCCGCCCGGGCTCTGCTGCGCCGCGCCAGACGCACG
GGCCGCCGGGCCATGATGCGAGCCGCGCGCCGCGCCGCCGCACCCACCCCC
GCAGGCAGGACTCGCAGACGAGCGGCCGCCGCCGCCGCCGCGGCCATCTCTAGC
ATGACCAGACCCAGGCGCGGAAACGTGTACTGGGTGCGCGACTCCGTCACGGGC
GTGCGCGTGCCCGTGCGCACCCGTCCTCCTCGTCCCTGATCTAATGCTTGTGTCC
TCCCCCGCAAGCGACGATGTCAAAGCGCAAAATCAAGGAGGAGATGCTCCAGGT
CGTCGCCCCGGAGATTTACGGACCACCCCAGGCGGACCAGAAACCCCGCAAAAT
CAAGCGGGTTAAAAAAAAGGATGAGGTGGACGAGGGGGCAGTAGAGTTTGTGC
GCGAGTTCGCTCCGCGGCGGCGCGTAAATTGGAAGGGGCGCAGGGTGCAGCGC
GTGTTGCGGCCCGGCACGGCGGTGGTGTTCACGCCCGGCGAGCGGTCCTCGGTC
AGGATGAAACGTAGCTATGACGAGGTGTACGGCGACGACGACATCCTGGACCA
GGCGGCGGAGCGGGCGGGCGAGTTCGCCTACGGGAAGCGGTCGCGCGAAGAGG
AGCTGATCTCGCTGCCGCTGGACGAGAGCAACCCCACGCCGAGCCTGAAGCCCG
TGACCCTGCAGCAGGTGCTGCCCCAGGCGGTGCTGCTGCCGAGCCGCGGGGTCA
AGCGCGAGGGCGAGAGCATGTACCCGACCATGCAGATCATGGTGCCCAAGCGCC
GGCGCGTGGAGGACGTGCTGGACACCGTGAAAATGGATGTGGAGCCCGAGGTC
AAGGTGCGCCCCATCAAGCAGGTGGCGCCGGGCCTGGGCGTGCAGACCGTGGAC
ATTCAGATCCCCACCGACATGGATGTCGACAAAAAACCCTCGACCAGCATCGAG
GTGCAGACCGACCCCTGGCTCCCAGCCTCTACCGCCACCGCCTCTACATCTACGG
TTGCCACGGCTACCGAGCCTCCAAGGAGGCGAAGATGGGGCGCCGCCAGCCGGC
TGATGCCCAACTACGTGTTGCATCCTTCCATCATCCCGACGCCGGGCTACCGCGG
CACCCGGTACTACGCCAGCCGCAGGCGCCCAGCCAGCAAACGCCGCCGCCGCAC
CGCCACCCGCCGCCGTCTGGCCCCCGCCCGCGTGCGCCGCGTGACCACGCGCCG
GGGCCGCTCGCTCGTTCTGCCCACCGTGCGCTACCACCCCAGCATCCTTTAATCC
GTGTGCTGTGATACTGTTGCAGAGAGATGGCTCTCACTTGCCGCCTGCGCATCCC
CGTCCCGAATTACCGAGGAAGATCCCGCCGCAGGAGAGGCATGGCAGGCAGTG
GCCTGAACCGCCGCCGGCGGCGGGCCATGCGCAGGCGCCTGAGTGGCGGCTTTC
TGCCCGCGCTCATCCCCATAATCGCCGCGGCCATCGGCACGATCCCTGGCATAGC
TTCCGTTGCGCTGCAGGCGTCGCAGCGCCGTTGATGTGCGAATAAAGCCTCTTTA
GACTCTGACACACCTGGTCCTGTATATTTTTAGAATGGAAGACATCAATTTTGCG
TCCCTGGCTCCGCGGCACGGCACGCGGCCGTTCATGGGCACCTGGAACGAGATC
GGCACCAGCCAGCTGAACGGGGCGCCTTCAATTGGAGCAGTGTCTGGAGCGGG
CTTAAAAATTTCGGCTCGACGCTCCGGAACTATGGGAACAAGGCCTGGAATAGT
AGCACGGGCAGTTGTTAAGGGAAAAGCTCAAAGACCAGAACTTCCAGCAGAA
GGTGGTGGACGGTCTGGCCTCGGGCATTAACGGGGTGGTGGACATCGCGAACCA
GGCCGTGCAGCGCGAGATAAACAGCCGCCTGGACCCGCGGCCGCCCACGGTGGT
GGAGATGGAAGATGCAACTCTTCCGCCGCCCAAAGGCGAGAAGCGGCCGCGGC
CCGACGCGGAGGAGACGATCCTGCAGGTTGACGAGCCGCCATCGTACGAGGAG
GCCGTCAAGGCCGGCATGCCCACCACGCGCATCATCGCCGCTGGCCACGGGT
GTAATGAAACCCGCCACCCTTGACCTGCCTCCACCACCCACGCCCGCTCCACCGA
AGGCAGCTCCGGTCGTGCAGGCCCCCCGGTGGCGACCGCCGTGCGCCGCGTCC
CCGCCCGCCGCCAGGCCCAGAACTGGCAGAGCACGCTGCACAGTATCGTGGGCC
TGGGAGTGAAAAGTCTGAAGCGCCGCCGATGCTATTGAGAGAGAGGAAAGAGG
ACACTAAAGGGAGAGCTTAACTTGTATGTGCCTTACCGCCAGAGAACGCGCGAA
GATGGCCACCCCCTCGATGATGCCGCAGTGGGCGTACATGCACATCGCCGGGCA
GGACGCCTCGGAGTACCTGAGCCCGGGTCTGGTGCAGTTTGCCCGCGCCACCGA
CACGTACTTCAGCCTGGGCAACAAGTTTAGGAACCCCACGGTGGCTCCCACCCA
CGATGTGACCACGGACCGGTCCCAGCGTCTGACGCTGCGCTTCGTGCCCGTGGA
TCGCGAGGACACCACGTACTCGTACAAGGCGCTTCACTCTGGCCGTGGGCGA
CAACCGGGTGCTAGACATGGCCAGCACTTACTTTGACATCCGCGGCGTCCTGGA
TCGCGGTCCCAGCTTCAAACCCTACTCGGGAACGGCTTACAACAGTCTGGCCCCC
AAGGGCGCCCCAACTCCAGTCAGTGGGTTGCGAAAGACACCAATGCTACCGAT
CAAGCATTAAAAACCCACACACATGGCGTAGCTGCTATGGGGGGAACAGATATC
ACAGCAAAGGGTTTGCAAATTGGTGTTGACACAACTGAAAACAAGAATGAGCCT
ATTTATGCAAATGAAATCTATCAGCCAGAGCCTCAAATAGGAGAAGAAAACTTG
CAAGATGTTGAAAACTTTTATGGCGGCAGAACTCTTAAAAAGGAAACAAAAATG
AAACCCTGCTATGGCTCATTTGCCAGACCCACAAATGAAAAGGCGGTCAAGCC
AAATTTTTAACTGACGGCGATGGTCAGCTAACTAAAAATCATGATATCACAATG
AATTTCTTTGACACTCCTGGAGGAACAGTTGGTCAGGATACTGAACTTGAAGCA
GACATTGTTATGTATGCTGAGAATGTGCATCTGGAAACTCCAGACACGCATGTG
```

TABLE 7-continued

Nucleic Acid Sequences of Vectors

SEQ ID NO Sequence

GTGTACAAACCAGGAACTTCTGATGAGAGTTCTGAAATTAATTTAACTCAGCAG
TCCATGCCAAACAGGCCCAACTACATTGGCTTCAGGGACAACTTTGTGGGTCTCA
TGTATTACAACAGTACTGGCAACATGGGTGTGCTGGCCGGTCAGGCCTCTCAGTT
GAATGCTGTGGTCGACTTGCAAGACAGAAACACCGAGCTGTCTTACCAGCTCTT
GCTAGATTCTCTGGGTGATAGAACCAGATACTTTAGCATGTGGAACTCTGCGGTG
GACAGCTATGATCCCGATGTCAGGATCATTGAGAATCACGGCGTGGAAGATGAA
CTTCCAAACTATTGCTTCCCATTGGATGGAGCTGGCACTAATGCTACATACCAAG
GTGTAAAAGTTAAAAATGGCGAAGATGGAGATGTAAACGCAGATTGGGAAAAA
GATCCAAACCTTGCTTCTCGAAACCAAATATGCAAGGGAAACATCTTCGCCATG
GAGATCAACCTCCATGCCAACCTGTGGAAGAGTTTTCTGTACTCGAACGTGGCCC
TGTACCTGCCCGACTCCTACAAGTACACGCCGGCCAACGTCACGCTGCCCGCCA
ACACCAACACCTACGAGTACATGAACGGCGCGTGGTAGCCCCCTCGCTGGTGG
ACGCCTACATCAACATCGGCGCCCGCTGGTCGTTGGACCCCATGGACAACGTCA
ACCCCTTCAACCACCACCGCAATGCGGGCCTGCGCTACCGCTCCATGCTTCTGGG
CAACGGCCGCTACGTGCCCTTCCACATTCAAGTGCCCCAAAAGTTCTTTGCCATC
AAGAACCTGCTCCTGCTCCCGGGCTCCTACACCTACGAGTGGAACTTCCGCAAG
GACGTCAACATGATCCTGCAGAGTTCCCTCGGAAACGATCTGCGCGTCGACGGC
GCCTCCGTCCGCTTCGACAGCGTCAACCTCTACGCCACCTTCTTCCCCATGGCGC
ACAACACCGCCTCCACCCTGGAAGCCATGCTGCGCAACGACACCAACGACCAGT
CCTTCAACGACTACCTCTCGGCCGCCAACATGCTCTACCCCATCCCGGCCAAGGC
CACCAACGTGCCCATCTCCATCCCCTGCGCAACTGGGCCGCCTTCCGCGGATGG
AGTTTCACCCGGCTCAAGACCAAGGAAACTCCCTCCCTCGGCTCGGGTTTCGACC
CCTACTTTGTCTACTCGGGCTCCATCCCCTATCTCGACGGGACCTTCTACCTCAAC
CACACCTTCAAGAAGGTCTCCATCATGTTCGACTCCTCGGTCAGCTGGCCCGGCA
ACGACCGGCTGCTCACGCCGAACGAGTTCGAAATCAAGCGCAGCGTCGACGGGG
AGGGCTACAACGTGGCCCAATGCAACATGACCAAGGACTGGTTCCTCGTCCAGA
TGCTCTCCCACTACAACATCGGCTACCAGGGCTTCCATGTGCCCGAGGGCTACAA
GGACCGCATGTACTCCTTCTTCCGCAACTTCCAGCCCATGAGCAGGCAGGTGGTC
GATGAGATCAACTACAAGGACTACAAGGCCGTCACCCTGCCCCTTCCAGCACAAC
AACTCGGGCTTCACCGGCTACCTCGCACCCACCATGCGCCAGGGGCAGCCCTAC
CCCGCCAACTTCCCCTACCCGCTCATCGGCTCCACCGCAGTGCCCTCCGTCACCC
AGAAAAAGTTCCTCTGCGACAGGGTCATGTGGCGCATCCCCTTCTCCAGCAACTT
CATGTCCATGGGCGCCCTTACCGACCTGGGTCAGAACATGCTCTACGCCAACTCG
GCCCACGCGCTCGACATGACCTTCGAGGTGGACCCCATGGATGAGCCCACCCTC
CTCTATCTTCTCTTCGAAGTTTTCGACGTGGTCAGAGTGCACCAGCCGCACCGCG
GCGTCATCGAGGCCGTCTACCTGCGCACGCCCTTCTCCGCCGGAAACGCCACCA
CCTAAGCATGAGCGGCTCCAGCGAAAGAGAGCTCACGGCCATCGTGCGCGACCT
GGGCTGCGGGCCCTACTTTTTGGGCACCCACGACAAGCGCTTCCCGGGTTTCCTC
GCCGGCGACAAGCTGGCCTGCGCCATCGTCAACACGGCCGGCCGCGAGACCGGA
GGCGTGCACTGGCTAGCCTTCGGCTGGAACCCGCGCTCGCGCACCTGCTACATGT
TCGACCCCTTTGGGTTCTCGGACCGCCGGCTCAAGCAGATTTACAGCTTCGAGTA
CGAGGCCATGCTGCGTCGCAGCGCCCTGGCCTCCTCGCCCCGACCGCTGTCTCAGC
CTCGAGCAGTCCACCCAGACCGTGCAGGGGCCCGACTCCGCCGCCTGCGGACTT
TTCTGTTGCATGTTCTTGCATGCCTTCGTGCACTGGCCCGACCGACCCATGGACG
GAAACCCCACCATGAACTTGCTGACGGGGGTGCCCAACGGCATGCTACAATCGC
CACAGGTGCTGCCCACCCTCAGGCGCAACCAGGAGGAGCTCTACCGCTTCCTCG
CGCGCCACTCCCCTTACTTTCGCTCCCACCGCGCCGCCATCGAACACGCCACCGC
TTTTGACAAAATGAAACAACTGCGTGTATCTCAATAAACAGCACTTTTATTTTAC
ATGCACTGGAGTATATGCAAGTTATTTAAAAGTCGAAGGGGTTCTCGCGCTCGTC
GTTGTGCGCCGCGCTGGGGAGGGCCACGTTCGGTACTGGAACTTGGGCTGCCA
CTTGAACTCGGGGATCACCAGTTTGGGAACCGGAATCTCGGGGAAGGTCTCGCT
CCACATGCGCCGGCTCATCTGCAGGGCGCCCAATATGTCAGGCGCGGATATCTT
GAAATCGCAGTTGGGACCGGTACTCTGCGCGCGCGAGTTGCGGTACACGGGGTT
GCAGCACTGGAACACCATCAGACTGGGGTGCTTCACACTGGCCAGCACGCTCTT
GTCGCTAATCTGATCCTTGTCCAGGTCCTCGGCGTTGCTCAGGCCGAACGGAGTC
ATCTTGCACAGCTGGCGGCCCAGGAAGGGCACGCTGTGAGGCTTGTGGTTACAC
TCGCAGTGAACGGGCATCAGCATCATCCCCGCGCCGCGCTGCATATTCGGGTAG
AGGGCCTTGACAAAGGCTGAGATCTGCTTGAAAGCTTGCTGGGCCTTGGCCCCC
TCGCTGAAGAACAGCCCGCAGCTCTTCCCGCTGAACTGGTTATTCCCGCACCCGG
CATCATGCACGCAGCAGCGCGCGTCATGGCTGGTCAGTTGCACCACGCTCCGTC
CCCAGCGGTTCTGGGTCACCTTGGCCTTGCTAGGCTGCTCCTTCAACGCGCGCTG
GCCGTTCTCGCTGGTCACATCCATCTCCACCACGTGGTCCTTGTGGATCATCACC
GTCCCGTGCAGACACTTGAGCTGGCCTTCCACCTCGGTGCAGCCGTGATCCCACA
GGGCGCAGCCGGTGCACTCCCAGTTCTTGTGCGCAATCCCGCTGTGGCTGAAGA
TGTAACCTTGCAACATGCGGCCCATGACGGTGCTAAATGATTTACTGGTGCTGAA
GGTCAGTTGCAGGCCGCGGGCCTCCTCGTCAGCCAGGTCTGGCACATCTTCTGG
AAGATCTCGGTCTGCTCGGGCATCAGCTTGTAGGCATCGCGCAGGCCGCTGTCG
ACGCGGTAGCGTTCCATCAGCACGTTCATGGTATCCATGCCCTTCTCCCAGGACG
AGACCAGAGGCAGACTCAGGGGGTTGCGCACGTTCAGGACACCGGGGTCGCG
GGCTCGACGATGCGTTTTCCGTCCTTGCCTTCCTTCAACAGAACCGGAGGCTGGC
TGAATCCCACTCCCACGATCACGGCATCTTCCTGGGGCATCTTCTTCGTCTGGGTC
TACCTTGGTCACATGCTTGGTCTTCCTGGCTTGCTTCTTTTTTGGAGGGCTGTCCA
CGGGGACCACGTCCTCCTCGGAAGACCCGGAGCCCACCCGCTGATACTTTCGGC
GCTTGGTGGCAGAGGAGGTGGCGGCGAGGGGCTCCTCTCCTGCTCCGGCGGAT
AGCGCGCCGACCCGTGGCCCCGGGGCGGAGTGGCCCTCTCGCTCCATGAACCGGC
GCACGTCCTGACTGCCGCCGGCCATTGTTTCCTAGGGGAAGATGGAGGAGCAGC

TABLE 7-continued

Nucleic Acid Sequences of Vectors

| SEQ ID NO | Sequence |
|---|---|
| | CGCGTAAGCAGGAGCAGGAGGAGGACTTAACCACCCACGAGCAACCCAAAATC |
| | GAGCAGGACCTGGGCTTCGAAGAGCCGGCTCGTCTAGAACCCCCACAGGATGAA |
| | CAGGAGCACGAGCAAGACGCAGGCCAGGAGGAGACCGACGCTGGGCTCGAGCA |
| | TGGCTACCTGGGAGGAGAGGAGGATGTGCTGCTGAAACACCTGCAGCGCCAGTC |
| | CCTCATCCTCCGGGACGCCCTGGCCGACCGGAGCGAAACCCCCCTCAGTGTCGA |
| | GGAGCTGTGTCGGGCCTACGAGCTCAACCTCTTCTCGCCGCGCGTGCCCCCCAAA |
| | CGCCAGCCCAACGGCACATGCGAGCCCAACCCGCGTCTCAACTTTTACCCCGTCT |
| | TTGCGGTCCCCGAGGCCCTTGCCACCTATCACATCTTTTTCAAGAACCAAAAGAT |
| | CCCCGTCTCCTGCCGCGCCAACCGCACCCGCGCCGACGCGCTCCTTGCTCTGGGA |
| | CCCGGCGCGCGCATACCTGATATCGCTTCCCTGGAAGAGGTGCCCAAGATCTTC |
| | GAAGGGCTCGGTCGGGACGAGACGCGCGCGGCGAACGCTCTGAAAGAAACAGC |
| | AGAGGAAGAGGGTCATACTAGCGCCCTGGTAGAGTTGGAAGGCGACAACGCCA |
| | GGCTGGCCGTGCTTAAGCGCAGCGTCGAGCTCACCCACTTCGCCTACCCCGCCGT |
| | CAACCTCCCGCCCAAGGTCATGCGTCGCATCATGGATCAGCTCATCATGCCCCAC |
| | ATCGAGGCCCTCGATGAGACCCAAGAGCAGCGCCCAGAGGACACCCGTCCCGTG |
| | GTCAGCGACGAGCAGCTCGCGCGCTGGCTCGGGACCCGCGACCCCCAGACCCTG |
| | GAGCAGCGGCGCAAACTCATGCTGGCCGTGGTCCTGGTCACCCTCGAGCTCGAA |
| | TGCATGCGCCGCTTCTTCAGCGACCCCGAGACCCTGCGCAAGGTCGAGGAGACC |
| | CTGCACTACACTTTCAGGCACGGTTTCGTCAGGCAGGCAAGCAAGATTTCCAAC |
| | GTGGAGCTGACCAACCTGGTCTCCTGCCTGGGGATCCTGCACGAGAACCGCCTG |
| | GGGCAGACCGTGCTCCACTCGACCCTGAAGGGCGAGGCGCGGCGAGACTATGTC |
| | CGCGACTGCGTCTTTCTCTTTCTATGCCACACATGGCAAGCAGCCATGGGCGTGT |
| | GGCAGCAGTGTCTCGAGGACGAGAACCTGAAGGAGCTGGACAAGCTTCTTGCTA |
| | GAAATCTTAAAAAGCTGTGGACGGGCTTCGACGAGCGTACCGTCGCCTCGGACC |
| | TGGCCGAGATCGTCTTCCCCGAGCGCCTGAGGCAGACGCTGAAAGGCGGGCTGC |
| | CCGACTTCATGAGCCAGAGCATGTTGCAAAACTACCGCACTTTCATTCTCGAGCG |
| | ATCTGGGATGCTGCCCGCCACCTGCAACGCCTTCCCCTCCGACTTTGTCCCGCTG |
| | AGCTACCGCGAGTGTCCCCCGCCTCTGTGGAGCCACTGCTACCTCTTGCAGCTGG |
| | CCAACTACATCGCCTACCACTCGGACGTGATCGAGGACGTGAGCGGCGAGGGGC |
| | TTCTCGAGTGCCACTGCCGCTGCAACCTGTGCTCCCCGCACCGCTCCCTGGTCTG |
| | CAACCCCCAGCTCCTCAGCGAGACCCAGGTCATCGGTACCTTCGAGCTGCAAGG |
| | TCCGCAGGAGTCCACCGCTCCGCTGAAACTCACGCCGGGGTTGTGGACTTCCGC |
| | GTACCTGCGCAAATTTGTACCCGAGGACTACCACGCCCATGAGATAAAGTTCTTC |
| | GAGGACCAATCGCGGCCGCAGCACGCGGATCTCACGGCCTGCGTCATCACCCAG |
| | GGCGCGATCCTCGCCCAATTGCATGCCATCCAAAAATCCCGCCAAGAGTTTCTTC |
| | TGAAAAAGGGTAGAGGGGTCTACCTGGACCCCCAGACGGGCGAGGTGCTCAAC |
| | CCGGGTCTCCCCCAGCATGCCGAGGAAGAAGCAGGAGCCGCTAGTGGAGGAGA |
| | TGGAAGAAGAATGGGACAGCCAGGCAGAGGAGGACGAATGGAAGGAGGAGAC |
| | AGAGGAGGAAGAATTGGAAGAGGTGGAAGAGGAGCAGGCAACAGAGCAGCCC |
| | GTCGCCGCACCATCCGCGCCGGCAGCCCCTCCGGTCACGGATACAACCTCCGCA |
| | GCTCCGGCCAAGCCTCCTCGTAGATGGGATCGAGTGAAGGGTGACGGTAAGCAC |
| | GAGCGGCAGGGCTATCGATCATGGAGGGCCCACAAAGCCGCGATCATCGCCTGC |
| | TTGCAAGACTGCGGGGGGAACATCGCTTTCGCCCGCCGCTACCTGCTCTTCCACC |
| | GCGGGGTGAACATCCCCCGCAACGTGTTGCATTACTACCGTCACCTTCACAGCTA |
| | AGAAAAAATCAGAAGTAAGAGGAGTCGCCGGAGGAGGCCTGAGGATCGCGGCG |
| | AACGAGCCCTTGACCACCAGGGAGCTGAGGAACCGGATCTTCCCCACTCTTTAT |
| | GCCATTTTTCAGCAGAGTCGAGGTCAGCAGCAAGAGCTCAAAGTAAAAAACCGG |
| | TCTCTGCGCTCGCTCACCCGCAGTTGCTTGTACCACAAAAACGAAGATCAGCTGC |
| | AGCGCACTCTCGAAGACGCCGAGGCTCTGTTCCACAAGTACTGCGCGCTCACTCT |
| | TAAAGACTAAGGCGCGCCCACCCGGAAAAAAGGCGGGAATTACCTCATCGCCAC |
| | CATGAGCAAGGAGATTCCCACCCCTTACATGTGGAGCTATCAGCCCCAAATGGG |
| | CCTGGCCGCGGGCGCCTCCCAGGACTACTCCACCCGCATGAACTGGCTCAGTGC |
| | CGGCCCCTCGATGATCTCACGGGTCAACGGGGTCCGCAGTCATCGAAACCAGAT |
| | ATTGTTGGAGCAGGCGGCGGTCACCTCCACGCCCAGGGCAAAGCTCAACCCGCG |
| | TAATTGGCCCTCCACCCTGGTGTATCAGGAAATCCCCGGGCCGACTACCGTACTA |
| | CTTCCGCGTGACGCACTGGCCGAAGTCCGCATGACTAACTCAGGTGTCCAGCTG |
| | GCCGGCGGCGCTTCCCGGTGCCCGCTCCGCCCACAATCGGGTATAAAAACCCTG |
| | GTGATCCGAGGCAGAGGCACACAGCTCAACGACGAGTTGGTGAGCTCTTCGATC |
| | GGTCTGCGACCGGACGGAGTGTTCCAACTAGCCGGAGCCGGGAGATCCTCCTTC |
| | ACTCCCAACCAGGCCTACCTGACCTTGCAGAGCAGCTCTTCGGAGCCTCGCTCCG |
| | GAGGCATCGGAACCCTCCAGTTCGTGGAGGAGTTTGTGCCCTCGGTCTACTTCAA |
| | CCCCTTCTCGGGCTCGCCAGGCCTCTACCCGGACGAGTTCATACCGAACTTCGAC |
| | GCAGTGAGAGAAGCGGTGGACGGCTACGACTGAATGTCCCATGGTGACTCGGCT |
| | GAGCTCGCTCGGTTGAGGCATCTGGACCATTGCCGCCGCCTGCGCTGCTTTGCCC |
| | GGGAGAGCTGCGGACTCATCTACTTTGAGTTTCCCGAGGAGCACCCCAACGGCC |
| | CTGCACACGGAGTGCGGATCACCGTAGAGGGCACCACCGAGTCTCACCTGGTCA |
| | GGTTCTTCACCCAGCAACCCTTCCTGGTCGAGCGTGACCGGGGCGCCACCACCTA |
| | CACCGTCTACTGCATCGTCCTACCCCGAAGTTGCATGAGAATTTTTGCTGTACT |
| | CTGTGTGCTGAGTTTAATAAAAGCTAAACTCCTACAATACTCTGGGATCCCGTGT |
| | CGTCGCACTCGCAACGAGACCTTCAACCTTACCAACCAGACTGAGGTAAAACTC |
| | AACTGCAGACCAGGGGACAAATACATCCTCTGGCTCTTTGAGAACACTTCCTTCG |
| | CGGTCTCCAACACCTGCGCCAACGACGGTATTGAAATACCCAACAACCTTACCA |
| | GTGGACTAACTTACACCACCAGAAAGACTAAGCTAGTACTCTACAATCCTTTTGT |
| | AGAGGGAACCTACCACTGCCAGAGCGGACCTTGCTTCCACACTTTCACTTTGGTG |
| | AACGTTACCGGCAGCAGCACAGCCGCTCCAGAAACATCTAACCTTCTTTCTGATA |
| | CTAACACTCCTAAAACCGGAGGTGAGCTCTGGGTTCCCTCTCTAACAGAGGGGG |

TABLE 7-continued

Nucleic Acid Sequences of Vectors

SEQ ID NO Sequence

GTAAACATATTGAAGCGGTTGGGTATTTGATTTTAGGGGTGGTCCTGGGTGGGTG
CATAGCGGTGCTGTATTACCTTCCTTGCTGGATCGAAATCAAAATCTTTATTTGC
TGGGTCATACATTGTTGGGAGGAACCATGAAGAGGCTCTTGCTGATTATCCTTTC
CCTGGTTGGGGGTGTACTGTCATGCCACGAACAGCCACGATGTAACATCACCAC
AGGCAATGAGAGGAGTGTGATATGCACAGTAGTCATCAAATGCGAGCATACATG
TCCTCTCAACATCACATTCAAGAATAAGACCATGGGAAATGCATGGGTGGGCGA
TTGGGAACCAGGAGATGAGCAGAACTACACGGTCACTGTCCATGGTAGCAATGG
AAATCACACTTTCGGTTTCAAATTCATTTTTGAAGTCATGTGTGATATCACACTG
CATGTGGCTAGACTTCATGGCTTGTGGCCCCCTACCAAGGAGAACATGGTTGGG
TTTTCTTTGGCTTTTGTGATCATGGCCTGTGCAATGTCAGGTCTGCTGGTAGGGG
CTATAATATGGTTCCTGAGGCTCAAGCCCAGGTATGGAAATCTGGAAAAGGAAA
AATTGCTATAAATGTTTTTCTTTCCACAGCATCATGAATACAGTGATCCGTATCG
TGCTGCTCTCTCTTCTTGTAGCTTTTAGTCAGGCAGGATTTCATACTATCAATGCT
ACATGGTGGGCTAATATAACTTTAGTGGGACCCTCAGATACGCCAGTCACCTGG
TATGATAAACAGGGAATGCAGTTCTGTGATGGAAATACAGTTAAGAATCCTCAA
ATAAGACATGAGTGTAATGAGCAAAACCTTACACTAATTCATGTGAACAAAACC
CATGAAAGTACATACATGGGTTATAATAGACAGAGTACTCATAAGGAAGACTAT
AAAGTCATAGTTATACCGCCTCCTCCTGCTACTGTAAAGCCACAGTCAGGTCCAG
AGTATGTATATGTTAATATGGGAGAGAATAAAACATTAGTTGGACCTCCGGGAA
TACCAGTTACTTGGTATGACGGAGAAGGAAATAAATTCTGCGATGGAGAAAAAG
TTGAACATGCAGAATTTAATCATACATGTGACGTGCAAAATCTTACACTGTTGTT
TATAAATCTTACACATGATGGGGCTTATCTTGGCTATAATCACCAGGGAACTAAA
AGAACTTGGTATGAGGTTGTAGTGACAGATGGTTTTCCAAAATCAGGGGAGATG
AAAATCGAAGATCAGAGTAGACAAACAGAACAAAAACAAACTGGGCAAAAACA
AAATGAGCATAAACAGGGTGGGCAGAAACAGGAGGGGCAAAAAGAGACAAGT
CAAAAGAAAGCTAATGACAAACAGAAGGCTACACACAGGAGGCCATCAAAACT
AAAGCCGCACACACCTGAAGCAAAACTGATTACAGTTTCTAGTGGGTCTAACTT
AACATTACTTGGGCCAGATGGAAAGGTCACTTGGTATGATGATGATTTAAAAAG
ACCATGTGAACCTGGATATAAGTTAAACTGTAAGTGTGACAATCAAAACCTAAC
CCTAATCAATGTAACTAAACTTTATGAGGGAGTTTACTATGGTACTAATGACGGA
GGCAACGGCAAAAGATACAGAGTAAAAGTAAACACTACGAATTCTCAAAATGT
GAAAATTCAGCCGTACACCAGGCCTACTACTCCTGATCAGAAACACAGATTTGA
ATTGCAAATTGATTATAATCAAGACAATGACAAAATTCCATCAACTACTGTGGC
AATCGTGGTGGGTGTGATTGCGGGCTTCATAACTCTGATCATTGTCATTCTGTGC
TACATCTGCTGCCGCAAGCGTCCAAGGGCATACAATCATATGGTAGACCCACTA
CTCAGCTTCTCTTACTGAGACTCAGTCACTTTCATTTCAGAACAATGAAGGCTTT
CACAGCTTGCGTTCTGATTAGCATAGTCACACTTAGTTCAGCTGCAATGATTAAT
GTTAATGTCACTAGAGGTGGTAAAATTACATTGAATGGGACTTATCCACAAACT
ACATGGACAAGATATCATAAAGATGGATGGAAAATATCTGTGAATGGAATGTT
ACAGCCTATAAATGCTTCAGTAATGGAAGCATTACAATTACTGCCACTGCTAATA
TTACTTCTGGCACAATCAAGGCAGAAAGCTATAAAAATGAAATGAAAAAAATGG
TATATAAAAATAACAAGACAACATTTGAAGATTCTGGAAATTATGAGTATCAGA
AATTATCTTTTTATAATCTGACAATTATTGAGCTGCCAACTACTAAGGCTCCCAC
AGTTAGGACAACGCAGCCTACCACTGTACCCACTACACATCCAACCACCACAGC
CAGTACAACTACTGAGACCACAACTCACACTACACAGTTAGACACTACAGTGCA
GAATAGTACTGTATTGGTTAGGTATTTGTTAAGAGAGGAAAGTACTACTGAACA
GACAGAGGCTACCTCAAGTGCCTTCAGCAGCACTGCAAATTTAACTTCGCTTGCT
TGGACTAATGAAACCGGAGTATCATTGATGCATGGCCAGCCTTACTCAGGTTTG
AATATTCAAATTACTTTTCTGGTTGTTTGTGGGATCTTTATTCTTGTGGTTCTTCT
GTACTTTGTCTGCTGCAAAGCCAGAGAAAAATCTAGGAGGCCCATCTACAGGCC
AGTAATCGGGGATCCTCAGCCTCTCCAAGTGGAAGGGGGTCTAAGGAATCTTCT
CTTCTCTTTTTCAGTATGGTGATTCAGCCATGATTCCTAGGTTCTTCCTATTTAAC
ATCCTTTTCTGTCTATTCAACGTGTGCGCTGCCTTCGCGGCCGTCTCGCACGCCTC
GCCCGACTGTCTCGGGCCCTTCCCCACCTACCTCCTCTTTGCCCTGCTCACCTGCA
CCTGCGTCTGCAGCATTGTCTGCCTGGTCGTCACCTTCCTGCAGCTCATCGACTG
GTGCTGCGCGCTACAATTATCTCCACCACAGTCCCGAATATAGGGACGAGAA
CGTAGCCAGAATCTTAAGGCTCATTTGACCATGCAGACTCTGCTCATACTGCTAT
CCCTCCTCTCCCCTGCCCTCGCTGATGATGATTACTCTAAGTGCAAATTTGTGGA
GCTATGGAATTTCTTAGACTGCTATGATGCTAAAATGGATATGCCATCCTATTAC
TTGGTGATTGTGGGGATAGTCATGGTCTGCTCCTGCACTTTCTTTGCCATCATGAT
CTACCCCTGTTTTGATCTCGGCTGGAACTCTGTTGAGGCATTCACATACACACTA
GAAAGCAGTTCACTAGCCTCCACGCCACCACCCACACCTCCTCCCCGCAGAAAT
CAGTTTCCCCTGATTCAGTACTTAGAAGAGCCCCCTCCCCGACCCCCTTCCACTG
TTAGCTACTTTCACATAACCGGCGGCGATGACTGACCACCTGGACCTCGAGATG
GACGGCCAGGCCTCCGAGCAGCGCATCCTGCAACTGCGCGTCCGTCAGCAGCAG
GAGCGGGCCGCCAAGGAGCTCCTCGATGCCATCAACATCCACCAGTGCAAGAAG
GGCATCTTCTGCCTGGTCAAACAGGCAAAGATCACCTACGAGCTCGTGTCCAAC
GGCAAACAGCATCGCCTCACCTATGAGATGCCCCAGCAGAAGCAGAAGTTCACC
TGCATGGTGGGCGTCAACCCCATAGTCATCACCCAGCAGTCGGGCGAGACCAAC
GGCTGCATCCACTGCTCCTGCGAAAGCCCCGAGTGCATCTACTCCCTCCTCAAGA
CCCTTTGCGGACTCCGCGACCTCCTCCCCATGAACTGATGTTGATTAAAAGCCCA
GAAACCAATCAGCCCCTTCCCTATTTCCCCAGCCCCTTGCCCAATTATTCATAAG
AATAAATCATTGGAATTAATCATTCAATAAAGATCGCTTACTTGAAATCTGAAA
GTATGTCTTTGGTGTAGTTGTTTAGCAGCACCTCGGTACCCTCCTCCCAGCTCTG
GTACTCCAGTCCCCGGCGGGCGGCGAACTTCCTCCACACCTTGAAAGGGATGTC
AAATTCCTGGTCCACAATTTTCATTGTCTTCCCTCTCAGATGGCAAAGAGGCTCC

TABLE 7-continued

Nucleic Acid Sequences of Vectors

| SEQ ID NO | Sequence |
|---|---|
| | GGGTGGAAGATGACTTCAACCCCGTCTACCCCTATGGCTACGCGCGGAATCAGA<br>ATATCCCCTTCCTCACTCCCCCTTTGTCTCCTCCGATGGATTCAAAAACTTCCCC<br>CCTGGGGTCCTGTCACTCAAACTGGCTGACCCAATCACCATCACCAATGGGGAT<br>GTTTCGCTCAAGGTGGGAGGGGGTCTTACTTTGCAAGATGGAACTGGAAAACTA<br>ACAGTCAATACTGAACCACCTTTGCAACTTACAAATAACAAATTAGGTATTGCTT<br>TAGACGCTCCATTTGATGTTATAGGCGATAAGCTCACACTGTTAGCAGGCCATGG<br>CTTGTCTATCATAACAAAAGAAACATCAACACTGCCTGGCTTAATTAATACTCTT<br>GTAGTATTAACTGGAAAGGGTATTGGAACAGAATCAACAGATAATGATGTGGGAGC<br>ATATGCGTTAGAGTTGCAGAAGGCGGAGGCTTATCATTTAATGATGATGGAGAC<br>TTGGTAGCATTTAATAAAAAAGAAGATAAGCGCACCCTATGGACAACTCCAGAT<br>CCATCTCCAAATTGCAAATACTTGAGGATAAAGACTCAAAACTAACGTTAGTT<br>CTTACAAAGTGTGGTAGTCAAATTCTAGGAAATGTGTCTTTGTTGGTAGTTAAGG<br>GAAAGTTTAGTAATATCAATAATACCACAAACCCAAATGACACCGATAAACAAA<br>TAACAATTAAGTTGTTGTTTGATGCAAACGGAGTTCTTAAACAGGGCTCTACTAT<br>GGATTCTTCATATTGGAATTATAGAAGTGATAATTCCAATTTATCCCAACCATAC<br>AAACAAGCAGTTGGATTCATGCCTAGTAAGACTGCTTATCCTAAGCAAACCAAA<br>CCCGCCAACAAAGAAATAAGTCAGGCAAAAAATAAAATTATAAGCAATGTTTAC<br>CTTGGAGGTAAAATTGATCAACCGTGTGTTATTATAATTACTTTTAATGAAGAAG<br>CTGACAGCGAGTATTCTATTGTGTTTTACTTTAAATGGTACAAAACTTATGAAAA<br>TGTTCAGTTCGACTCTTCATCCTTTACCTTCTCCTACATCGCCCAAGAATGAAAG<br>ACCAATAAACGTGTTTTTCATTTAAAATTTCATGTATCTTTATTGATTTTTACACC<br>AGCACGGGTAGTCAGTCTCCCACCACCAGCCCATTTCACAGTGTACACGGTTCTT<br>TCAGCACGGGTGGCCTTAAATAGGGGAATGTTCTGATTAGTGCGGGAACTGGAC<br>TTGGGGTCTATAAGCCACACAGTTTCCTGGCGAGCCAAACGGGGGTCGGTGATT<br>GAGATGAAGCCGTCCTCTGAAAAGTCTTCCAAGCGGGCCTCACAGTCCAAGGTC<br>ACAGTCTGGTGGAATGAGAAGAACGCACAGATTCATACTCGGAAAACAGGATG<br>GGTCTGTGCCTCTCCATCAGTGCCCTCAACAGTCTCTGCCGCCGGGGCTCGGTGC<br>GGCTGCTGCAGATGGGATCGGGATCGCAAGTCTCTCGACTATGATCCCCACAG<br>CCTTCAGCATCAGTCTCCTGGTGCGACGGGCACAGCACCGCATCCTGATCTCGGC<br>CAGGTTCTCACAGTAAGTGCAACATAGAATCACCATGTTATTCAGCAGCCCATA<br>ATTCAGGGCGCTCCAGCCAAAGCTCATGTTGGGGATGATGGAACCCACGTGACC<br>ATCGTACCAGATGCGGCAGTATATCAGGTGC |
| SEQ ID<br>NO: 1423 | CATCATCAATAATATACCCCACAAAGTAAACAAAAGTTAATATGCAAATGAGCT<br>TTTGAATTTTAACGGTTTTGGGGCGGAGCCAACGCTGATTGGACGAGAAGCGGT<br>GATGCAAATAACGTCACGACGCACGGCTAACGGCCGGCGCGGAGGCGTGGCCT<br>AGGCCGGAAGCAAGTCGCGGGGCTAATGACGTATAAAAAAGCGGACTTTAGAC<br>CCGGAAACGGCCGATTTTCCCGCGGCCACGCCCGGATATGAGGTAATTCTGGGC<br>GGATGCAAGTGAAATTAGGTCATTTTGGCGCCAAAACTGAATGAGGAAGTGAAA<br>AGTGAAAAATACCTGTCCCGCCCAGGGCGGAATATTTACCGAGGGCCGAGAGAC<br>TTTGACCGATTACGTGGGGTTTCGATTGCGGTGTTTTTTCGCGAATTTCCGCGTC<br>CGTGTGAAAGTCCGGTGTTTATGTCACAGATCAGCTGATCCACAGGGTATTTAAA<br>CCAGTTGAGCCCGTCAAGAGGCCACTCTTGAGTGCCAGCGAGTAGAGATTTCTC<br>TGAGCTCCGCTCCCAAAGTGTGAGAAAAATGAGACACCTGCGCCTCCTGTCTTC<br>AACTGTGCCTATTAACATGGCCGCATTATTGCTGGAGGACTATGTGAGTACAGTA<br>TTGGAGGACGAACTACATCCATCTCCATTTGAGCTGGGACCTACACTTCAGGACC<br>TTTATGATTTGGAGGTAGATGCCCATGATGACGACCCAAACGAAGAGGCTGTGA<br>ATTTAATATTTCCAGAATCTCTGATTCTTCAGGCTGACATAGCCAGCGAAGCTGT<br>ACCTACACCACTTCATACACCGACTTTGTCACCCATACCTGAATTGGAAGAGGA<br>GGACGAGTTAGACCTCCGATGTTATGAGGAAGGTTTTCCTCCCAGCGATTCAGA<br>GGACGAACAGGGTGAGCAGAGCATGGCTCTAATCTCAGAATATGCTTGTGTGGT<br>TGTGGAAGAGCATTTTGTGTTGGACAATCCTGAGGTGCCCGGGCAAGGCTGTAG<br>ATCCTGCCAGTACCACCGGGATAAGACCGGAGACACAAACGCCTCCTGCGCTCT<br>GTGTTACATGAAAAAGAACTTCAGCTTTATTTACAGTAAGTGGAGTGAATGTGA<br>GAGAGGCTGAGTGCTTAACACATAACTGGGTGATGCTTAAACAGCTGTGCTAAG<br>TGTGGTTTATTTTTGTTTCTAGGTCCGGTGTCAGAGGATGAGTCATCACCCTCAG<br>AAGAAAACCACCCGTGTCCCCCTGAGCTGTCAGGCGAAACGCCCCTGCAAGTGC<br>ACAAACCCACCCCAGTCAGACCCAGTGGCGAGAGGCGAGCAGCTGTTGAAAAA<br>ATTGAGGACTTGTTACATGACATGGGTGGGGATGAACCTTTGGACCTGAGCTTG<br>AAACGCCCCAGGAACTAGGCGCAGCTGTGCTTAGTCATGTGTAAATAAAGTTGT<br>ACAATAAAAGTATATGTGACGCATGCAAGGTGTGGTTTATGACTCATGGCGGG<br>GCTTAGTCCTATATAAGTGGCAACACCTGGGCACTGGGCACAGACCTTCAGGGA<br>GTTCCTGATGGATGTGTGGACTATCCTTGCAGACTTTAGCAAGACACGCCGGCTT<br>GTAGAGGATAGTTCAGACGGGTGCTCCGGGTTCTGGAGACACTGGTTTGGAACT<br>CCTCTATCTCGACTGGTGTACACAGTTAAGAAGGATTATAACGAGGAATTTGAA<br>AATCTTTTTGCTGATTGCTCTGGCCTGCTAGATTCTCTGAATCTCGGCCACCAGTC<br>CCTTTTCCAGGAAAGGGTACTCCACAGCCTTGATTTTTCCAGCCCAGGGCGCACT<br>ACAGCCGGGGTTGCTTTTGTGGTTTTTCTGGTTGACAAATGGAGCCAGAACACCC<br>AACTGAGCAGGGCTACATTCTGGACTTCGCAGCCATGCACCTGTGAGGGCAT<br>GGGTGAGGCAGCGGGACAGAGAATCTTGAACTACTGGCTTATACAGCCAGCAG<br>CTCCGGGTCTTCTTCGTCTACACAGACAAACATCCATGTTGGAGGAACACGCCAG<br>GGCAGGCCATGGACGAGAACCCGAGGAGCGGCCTGGACCCTCCGTCGGAAGAG<br>GAGCTGAATTGAATCAGGTATCCAGCTTGTACCCAGAGCTTAGCAAGGTGCTGA<br>CATCCATGGCTAGGGGAGTGAAGAGGGAGAGGAGCGATGGGGCAATACCGGG<br>ATGATGACCGAGCTGACGGCCAGCCTGATGAATCGCAAGCGCCCAGAGCGCATT<br>ACCTGGCACGAGCTACAGATGGAGTGCAGGGATGAGTTGGGCCTGATGCAGGAT |

TABLE 7-continued

Nucleic Acid Sequences of Vectors

| SEQ ID NO | Sequence |
|---|---|
| | AAATATGGCCTGGAGCAGATAAAAACACATTGGTTGAACCCAGATGAGGATTGG
GAGGAGGCCATTAAGAAATATGCCAAGATAGCCCTGCGCCCAGATTGCAAGTAC
ATAGTGACCAAGACCGTGAATATTAGACATGCCTGCTACATTTCAGGGAACGGG
GCAGAGGTGGTCATCGATACCCTGGACAAGGCCGCCTTCAGGTGTTGCATGATG
GGAATGAGAGCAGGAGTGATGAATATGAATTCCATGATCTTCATGAACATGAAG
TTCAATGGAGAGAAGTTTAATGGGGTGCTGTTCATGGCCAACAGCCACATGACC
CTGCATGGCTGCAGTTTCTTTGGCTTCAACAATATGTGCGCCGAGGTCTGGGCG
CTTCCAAGATCAGGGGATGTAAGTTTTATGGCTGCTGGATGGGCGTGGTCGGAA
GACCTAAGAGCGAGATGTCTGTGAAGCAGTGTGTGTTTGAGAAATGCTACCTGG
GAGTCTCTACCGAGGGCAATGCTAGAGTGAGACACTGCTCTTCCCTGGATACGG
GCTGCTTCTGCCTGGTGAAGGGTACGGCCTCTCTGAAGCATAATATGGTGAAGG
GCTGCACAGATGAGCGCATGTACAACATGCTAACATGCGACTCGGGGGTCTGTC
ATATCCTGAAGAACATCCATGTGACCTCCCACCCCAGAAAGAAGTGGCCAGTGT
TTGAGAATAACCTGATGATCAAGTGCCATATGCACCTGGGTGCCAGAAGGGGCA
CCTTCCAGCCGTACCAGTGCAACTTTAGCCAGACCAAGCTGCTGTTGGAAAACG
ATGCCTTCTCCAGGGTGAACCTGAACGGCATCTTTGACATGGATGTCTCGGTGTA
CAAGATCCTGAGATACGATGAGACCAAGTCCAGGGTGCGCGCTTGCGAGTGCGG
GGGCAGACACACCAGGATGCAGCCAGTGGCCCTGGATGTGACCGAGGAGCTGA
GACCAGACCACCTGGTGATGGCCTGTACCGGGACCGAGTTCAGCTCCAGTGGGG
AGGACACAGATTAGAGGTAGGTTTGAGTAGTGGGCGTGGCTAATGTGAGTATAA
AGGCGGGTGTCTTACGAGGGTCTTTTTGCTTTTCTGCAGACATCATGAACGGGAC
CGGCGGGGCCTTCGAAGGGGGGCTTTTTAGCCCTTATTTGACAACCCGCCTGCCG
GGATGGGCCGGAGTTCGTCAGAATGTGATGGGATCTACGGTGGATGGGCGTCCA
GTGCTTCCAGCAAATTCCTCGACCATGACCTACGCGACCGTGGGGAGCTCGTCG
CTTGACAGCACCGCCGCAGCCGCGGCAGCCGCAGCCGCCATGACAGCGACGAG
ACTGGCCTCGAGCTATATGCCCAGCAGCGGTAGCAGCCCCTCTGTGCCCAGTTCC
ATCATCGCCGAGGAGAAACTGCTGGCCCTGCTGGCCGAGCTGGAAGCCCTGAGC
CGCCAGCTGGCCGCCCTGACCCAGCAGGTGTCCGATCTCCGCGAGCAACAGCAG
CAGCAAAATAAATGATTCAAACAGCAAAGCATCTTTATTATTTATTTTTTCGCGC
GCGGTAGGCCCTGGTCCACCTCTCCCGATCATTGAGAGTGCGGTGGATTTTTTCC
AGGACCCGGTAAAGGTGGGATTGGATGTTGAGGTACATGGGCATGAGCCCGTCC
CGGGGGTGGAGGTAGCACCACTGCATGGCCTCGTGCTCTGGGGTCGTGTTGTAG
ATAATCCAGTCATAGCAGGGGCGCTGGGCGTGGTGCTGGATGATGTCCTTGAGG
AGGAGACTGATGGCCACGGGGAGCCCCTTGGTGTAGGTGTTGGCAAAGCGGTTA
AGCTGGGAGGGATGCATGCGGGGGGAGATGATGTGCAGTTTGGCCTGGATCTTG
AGGTTGGCGATGTTGCCACCCAGATCCCGCCGGGGGTTCATATTGTGCAGGACC
ACCAGAACGGTGTAGCCCGTGCACTTGGGGAACTTATCATGCAACTTGGAAGGG
AATGCGTGGAAGAATTTGGAGACGCCCTTGTGCCCGCCCAGGTTTTCCATGCACT
CATCCATGATGATGGCAATGGGCCCGTGGGCTGCGGCTTTGGCAAAAACGTTTC
TGGGGTCAGAGACATCATAATTATGCTCCTGGGTGAGATCATCATAAGACATTTT
AATGAATTTGGGGCGAAGGGTGCCAGATTGGGGACGATCGTTCCCTCGGGCCC
CGGGGCGAAGTTCCCCTCGCAGATCTGCATCTCCCAGGCTTTCATCTCGGAGGGG
GGGATCATGTCCACCTGCGGGGCGATGAAAAAAACGGTTTCCGGGCGGGGGTG
ATGAGCTGCGAGGAGAGCAGGTTTCTTAACAGCTGGGACTTGCCGCACCCGGTC
GGGCCGTAGATGACCCCGATGACGGGTTGCAGGTGGTAGTTCAAGGAGATGCAG
CTGCCGTCGTCCCGGAGGAGGGGGCCACCTCGTTGAGCATGTCTCTCACTTGG
AGGTTTTCCCGGACGAGCTCGCCGAGGAGGCGGTCCCCGCCCAGCGAGAGCAGC
TCTTGCAGGGAAGCAAAGTTTTTCAGGGGCTTGAGCCCGTCGGCCATGGGCATC
TTGGCAAGGGTCTGCGAGAGGAGCTCCAGGCGGTCCCATAGCTCGGTGACGTGC
TCTACGGCATCTCGATCCAGCAGACTTCCTCGTTTCGGGGGTTGGGACGACTGCG
ACTGTAGGGCACGAGACGATGGGCGTCCAGCGCGGCCAGCGTCATGTCCTTCCA
GGGTCTCAGGGTCCGAGTGAGGGTGGTCTCCGTCACGGTGAAGGGGTGGGCCCC
GGGCTGGGCGCTTGCAAGGGTGCGCTTGAGACTCATCCTGCTGGTGCTGAAACG
GGCACGGTCTTCGCCCTGCGCGTCGGCGAGATAGCAGTTGACCATGAGCTTGTA
GTTAAGGGCCTCGGCGGCGTGGCCCTTGGCACGGAGCTTGCCTTTTGGAAGAGCG
CCCGCAGGCGGGACAGAGGAGGGATTGCAGGGCGTAGAGCTTGGGTGCGAGAA
AGACGGACTCGGGAGCGAAGGCGTCCGCTCCGCAGTGGGCGCAGACGGTCTCGC
ACTCGACGAGCCAGGTGAGCTCGGGCTGCTCGGGGTCAAAAACCAGTTTTCCCC
CGTTCTTTTTGATGCGCTTCTTACCTCGCGTCTCCATGAGTCTGTGTCCGCGTTCG
GTGACAAACAGGCTGTCTGTGTCCCCGTAGACGGACTTGATTGGCCTGTCCTGCA
GGGGCGTCCCGCGGTCCTCCTCGTAGAGAAACTCGGACCACTCTGAGACAAAGG
CGCGCGTCCACGCCAAGACAAAGGAGGCCACGTGCGAGGGGTAGCGGTCGTTGT
CCACCAGGGGGTCCACCTTTTCCACCGTGTGCAGACACATGTCCCCCTCCTCCGC
ATCCAAGAAGGTGATTGGCTTGTAGGTGTAGGCCACGTGACCGGGGTCCCCGA
CGGGGGGGTATAAAAGGGGGCGGGTCTGTGCTCGTCCTCACTCTCTTCCGCGTC
GCTGTCCACGAGCGCCAGCTGTTGGGGTAGGTATTCCCTCTCGAGAGCGGGCAT
GACCTCGGCACTCAGGTTGTCAGTTTCTAGAAACGAGGAGGATTTGATGTTGGC
CTGCCCTGCCGCAATGCTTTTTAGGAGACTTTCATCCATCTGGTCAGAAAAGACT
ATTTTTTTATTGTCAAGCTTGGTGGCAAAGGAGCCATAGAGGGCGTTGGAGAGA
AGCTTGGCGATGGATCTCATGGTCTGATTTTTGTCACGGTCGGCGCGTTCCTTGG
CCGCGATGTTGAGCTGGACATACTCGCGCGCGACACACTTCCATTCTGGGAAGA
CGGTGGTGCGCTCGTCGGGCACGATCCTGACGCGCCAGCCGCGATTATGCAGGG
TGACCAGGTCCACGCTGGTGGCCACCTCGCCGCGCAGGGGCTCGTTGGTCCAGC
AGAGGCGTCCGCCCTTGCGCGAGCAGAACGGGGGCAGCACATCAAGCAGATGC
TCGTCAGGGGGGTCCGCATCGATGGTGAAGATGCCCGGACAGAGTTCCTTGTCA
AAATAATCGATTTTTGAGGATGCATCATCCAAGGCCATCTGCCACTCGCGGGCG |

TABLE 7-continued

Nucleic Acid Sequences of Vectors

SEQ ID NO Sequence

```
GCCAGCGCTCGCTCGTAGGGGTTGAGGGGCGGACCCCAGGGCATGGGATGCGTG
AGGGCGGAGGCGTACATGCCGCAGATGTCGTAGACATAGATGGGCTCCGAGAG
GATGCCGATGTAGGTGGGATAACAGCGCCCCCCGCGGATGCTGGCGCGCACATA
GTCATACAACTCGTGCGAGGGGGCCAAGAAAGCGGGGCCGAGATTGGTGCGCT
GGGGCTGCTCGGCGCGGAAGACGATCTGGCGAAAGATGGCATGCGAGTTGGAG
GAGATGGTGGGCCGTTGGAAGATGTTAAAGTGGGCGTGGGGCAAGCGGACCGA
GTCGCGGATGAAGTGCGCGTAGGAGTCTTGCAGCTTGGCAACGAGCTCGGCGGT
GACAAGGACGTCCATGGCGCAGTAGTCCAGCGTTTCACGGATGATGTCATAACC
CGCCTCTTCTTTCTTCTCCCACAGCGCGCGGTTGAGGGCGTACTCCTCGTCATCCT
TCCAGTACTCCCGGAGCGGGAATCCTCGATCGTCCGCACGGTAAGAGCCCAGCA
TGTAGAAATGGTTCACGGCCTTGTAGGGACAGCAGCCCTTCTCCACGGGGAGGG
CGTAAGCTTGAGCGGCCTTGCGGAGCGAGGTGTGCGTCAGGGCGAAGGTATCCC
TAACCATGACTTTCAAGAACTGGTACTTGAAATCCGAGTCGTCGCAGCCGCCGT
GCTCCCAGAGCTCGAAATCGGTGCGCTTCTTCGAGAGGGGGTTAGGCAGAGCGA
AAGTGACGTCATTGAAGAGAATCTTGCCTGCCCGCGGCATGAAATTGCGGGTGA
TGCGGAAAGGGCCCGGAACGGAGGCTCGGTTGTTGATGACCTGGGCGGCGAGG
ACGATCTCGTCGAAGCCGTTGATGTTGTGCCCGACGATGTAGAGTTCCATGAATC
GCGGGCGGCCTTTGATGTGCGGCAGCTTTTTGAGTTCCTCGTAGGTGAGGTCCTC
GGGGCATTGCAGGCCGTGCTGCTCGAGCGCCCACTCCTGGAGATGTGGGTTGGC
TTGCATGAATGAAGCCCAGAGCTCGCGGGCCATGAGGGTCTGGAGCTCGTCGCG
AAAGAGGCGGAACTGCTGGCCCACGGCCATCTTTTCTGGGGTGACGCAGTAGAA
GGTGAGGGGGTCCCGCTCCCAGCGATCCCAGCGTAAGCGCACGGCGAGATCGCG
AGCGAGGGCGACCAGCTCGGGGTCCCCGGAGAATTTCATGACCAGCATGAAGG
GGACGAGCTGCTTGCCGAAGGACCCCATCCAGGTGTAGGTTTCTACATCGTAGG
TGACAAAGAGCCGCTCCGTGCGAGGATGAGAGCCGATTGGGAAGAACTGGATTT
CCTGCCACCAGTTGGTCGAGTGGCTGTTGATGTGATGAAAGTAGAAATCCCGCC
GGCGAACCGAGCACTCGTGCTGATGCTTGTAAAAGCGTCCGCAGTACTCGCAGC
GCTGCACGGGCTGTACCTCATCCACGAGATACACAGCGCGTCCCTTGAGGAGGA
ACTTCAGGAGTGGCGGCCCTGGCTGGTGGTTTTCATGTTCGCCTGCGTGGGACTC
ACCCTGGGGCTCCTCGAGGACGGAGAGGCTGACGAGCCCGCGCGGGAGCCAGG
TCCAGATCTCGGCGCGGCGGGGGCGGAGAGCGAAAACGAGGGCGCGCAGTTGG
GAGCTGTCCATGGTGTCGCGGAGATCCAGGTCCGGGGGCAGGGTTCTGAGGTTG
ACCTCGTAGAGGCGGGTGAGGGCGTGCTTGAGATGCAGATGGTACTTGATCTCC
ACGGGTGAGTTGGCGGTCGTGTCCACGCATTGCATGAGCCCGTAGCTGCGCGGG
GCCACGACCGTGCCGCGGTGCGCTTTTAGAAGCGGTGTCGCGGACGCGCTCCCG
GCGGCAGCGGCGGTTCCGGCCCCGCGGGCAGTGGCGGTAGAGGCACGTCGGCGT
GGCGCTCGGGCAGGTCCCGGTGCTGCGCCCTGAGAGCGCTGGCGTGCGCGACGA
CGCGGCGGTTGACATCCTGGATCTGCCGCCTTTGCGTGAAGACCACGGGCCCG
TGACTTTGAACCTGAAAGACAGTTCAACAGAATCAATCTCGGCGTCATTGACGG
CGGCCTGACGCAGGATCTCTTGCACGTCGCCCGAGTTGTCCTGGTAGGCGATCTC
GGACATGAACTGCTCGATTTCCTCCTCCTGGAGATCGCCGCGGCCCGCGCGCTCT
ACGGTGGCGGCAAGGTCATTCGAGATGCGACCCATGAGCTGCGAGAAGGCGCCC
AGGCCGCTCTCGTTCCAGACGCGGCTGTAAACCACGTCCCCGTCGGCGTCGCGC
GCGCGCATGACCACCTGCGCGAGGTTGAGCTCCACGTGCCGCGTAAAGACGGCG
TAGTTGCGCAGGCGCTGGAAGAGGTAGTTGAGGGTGGTGGCGATGTGCTCGGTG
ACGAAGAAGTACATAATCCAGCGGCGCAGGGGCATTTCGCTGATGTCGCCAATG
GCCTCCAGCCTTTCCATGGCCTCGTAGAAATCCACGGCGAAGTTGAAAAACTGG
GCGTTGCGGGCCGAGACCGTGAGCTCGTCTTCCAGGAGCCTGATGAGTTCGGCG
ATGGTGGCGCGCACCTCGCGCTCGAAATCCCCGGGGGCCTCCTCCTCTTCCTCTT
CTTCCATGACGACCTCTTCTTCTATTTCTTCCTCTGGGGGCGTGGTGGCGGCGG
GGCCCGACGACGACGGCGACGCACCGGGAGACGGTCGACGAAGCGCTCGATCA
TCTCCCCGCGGCGGCGACGCATGGTTTCGGTGACGGCGCGACCCCGTTCGCGAG
GACGCAGCGTGAAGACGCCGCCGGTCATCTCCCGGTAATGGGGTGGGTCCCCGT
TGGGCAGCGATAGGGCGCTGACAATGCATCTTATCAATTGCGGTGTAGGGCACG
TGAGCGCGTCGAGATCGACCGGATCGGAGAATCTTTCGAGGAAAGCGTCTAGCC
AATCGCAGTCGCAAGGTAAGCTCAAACACGTAGCAGCCCTGTGGACGCTGTTAG
AATTGCGGTTGCTGATGATGTAATTGAAGTAGGCGTTTTTGAGGCGGCGGATGG
TGGCGAGGAGGACCAGGTCCTTGGGTCCCGCTTGCTGGATGCGGAGCGCTCGG
CCATGCCCCAGGCCTGCCCTGACACCGGCTCAGGTTCTTGTAGTAGTCATGCAT
GAGCCTCTCGATGTCATCACTGGCGGAGGCGGAGTCTTCCATGCGGGTGACCCC
GACGCCCCTGAACGGCTGCACGAGCGCCAGGTCGGCGACGACGCGCTCGGCGA
GGATGGCCTGTTGCACGCGGGTGAGGGTGTCCTGGAAGTCGTCCATGTCGACGA
AGCGGTGGTAGGCCCCTGTGTTGATGGTGTAAGTGCAGTTGGCCATAAGCGACC
AGTTGACGGTCTGCAGGCCGGGTTGCACGACCTCGGAGTACCTGAGCCGCGAGA
AGGCGCGCGAGTCGAAGACATAGTCGTTGCAGGTGCGCACGAGGTACTGGTATC
CGACTAGAAAGTGCGGCGGCGGCTGGCGGTAGAGCGGCCAGCGCTGGGTGGCC
GGCGCGCCCGGGGCCAGGTCCTCAAGCATGAGTCGGTGGTAGCCGTAGAGGTAG
CGGGACATCCAGGTGATGCCGGCGGCGGTGGTGGAGGCGCGCGGGAACTCGCG
GACGCGGTTCCAGATGTTGCGCAGGGGCAGGAAATAGTCCATGGTCGGCACGGT
CTGGCCGGTGAGACGCGCGCAGTCATTGATGCTCTAGAGGCAAAAACGAAAGCG
GTTGAGCGGGCTCTTCCTCCGTAGCCTGGCGGAACGCAAACGGGTTAGGCCGCG
TGTGTACCCCGGTTCGAGTCCCCTCGATTCAGGCTGGAGCCGCGACTAACGTGGT
ATTGGCACTCCCGTCTCGACCCAAGCCCGATAGCCGCCAGGATACGGCGGAGAG
CCCTTTTTGTCGGCCGAGGGGAGTCGCTAGACTTGAAAGCGGCCGAAAACCCTG
CCGGGTAGTGGCTCGCGCCCGTAGTCTGGAGAAGCATCGCCAGGGTTGAGTCGC
GGCAGAACCCGGTTCAAGGACGGCCGCGGCGAGCGGGACTTGGTCACCCCGCCG
```

TABLE 7-continued

Nucleic Acid Sequences of Vectors

| SEQ ID NO | Sequence |
|---|---|
| | ATTTAAAGACCCACAGCCAGCCGACTTCTCCAGTTACGGGAGCGAGCCCCCTTTT<br>TTCTTTTTGCCAGATGCATCCCGTCCTGCGCCAAATGCGTCCCACCCCCCGGCG<br>ACCACCGCGACCGCGGCCGTAGCAGGCGCCGGCGCTAGCCAGCCACAGCCACA<br>GACAGAGATGGACTTGGAAGAGGGCGAAGGGCTGGCGAGACTGGGGGCGCCGT<br>CCCCGGAGCGACATCCCCGCGTGCAGCTGCAGAAGGACGTGCGCCCGGCGTACG<br>TGCCTGCGCAGAACCTGTTCAGGGACCGCAGCGGGGAGGAGCCCGAGGAGATG<br>CGCGACTGCCGGTTTCGGGCGGGCAGGGAGCTGCGCGAGGGCCTGGACCGCCAG<br>CGCGTGCTGCGCGACGAGGATTTCGAGCCGAACGAGCAGACGGGGATCAGCCCC<br>GCGCGCGCGCACGTGGCGGCGGCCAACCTGGTGACGGCCTACGAGCAGACGGT<br>GAAGCAGGAGCGCAACTTCCAAAAGAGTTTCAACAACCACGTGCGCACCCTGAT<br>CGCGCGCGAGGAGGTGGCCCTGGGCCTGATGCACCTGTGGGACCTGGCGGAGGC<br>CATCGTGCAGAACCCGGACAGCAAGCCTCTGACGGCACAGCTGTTCCTGGTGGT<br>GCAGCACAGCAGGGACAACGAGGCGTTCAGGGAGGCACTGCTGAACATCGCCG<br>AGCCCGAGGGTCGCTGGCTGCTGGAGCTGATTAACATCTTGCAGAGCATCGTAG<br>TGCAGGAGCGCAGCCTGAGCCTGGCCGAGAAGGTGGCGGCGATCAACTACTCGG<br>TGCTGAGCCTGGGCAAGTTTTACGCGCGCAAGATTTACAAGACGCCGTATGTGC<br>CCATAGACAAGGAGGTGAAGATAGACAGCTTTTACATGCGCATGGCGCTCAAGG<br>TGCTGACGCTGAGCGACGACCTGGGCGTGTACCGCAACGACCGCATCCACAAGG<br>CCGTGAGCACAAGCCGGCGGCGCGAGCTGAGCGACCGCGAGCTGATGCTGAGTC<br>TGCGCCGGGCGCTGGTAGGAGGCGCCACCGGCGGTGAGGAGTCCTACTTCGACA<br>TGGGGGCGGACCTGCATTGGCAGCCGAGCCGACGCGCCTTGGGAGGCCGCCTACG<br>GTCCAGAGGACTTGGATGAGGAAGAGGAAGAGGAGGAGGATGCACCCGCTGCG<br>GGGTACTGACGCCTCCGTGATGTGTTTTTAGATGCAGCAAGCCCCGGACCCCGCC<br>ATAAGGGCGGCGCTGCAAAGCCAGCCGTCCGGTATAGCATCGGACGACTGGGA<br>GGCCGCGATGCAACGCATCATGGCCCTGACGACCCGCAACCCCGAGTCCTTTAG<br>ACAACAGCCGCAGGCCAACAGACTCTCGGCCATTCTGGAGGCGGTGGTCCCCTC<br>TCGGACCAACCCCACGCACGAGAAGGTGCTGGCGATCGTGAACGCGCTGGCGGA<br>GAACAAGGCCATCCGTCCCGACGAGGCCGGGCTGGTGTACAACGCCCTGCTGGA<br>GCGCGTGGGCCGCTACAACAGCACGAACGTGCAGTCCAACCTGGACCGGCTGGT<br>GACGGACGTGCGCGAGGCCGTGGCGCAGCGCGAGCGGTTCAAGAACGAGGGCC<br>TGGGCTCGCTGGTGGCGCTGAACGCCTTCCTGGCGACGCAGCCGGCGAACGTGC<br>CGCGCGGGCAGGATGATTATACCAACTTTATAAGCGCGCTGCGGCTGATGGTGA<br>CCGAGGTTCCCCAGAGCGAGGTGTACCAGTCTGGCCCGGACTACTTTTTCCAGAC<br>GAGCAGACAGGGCCTGCAGACGGTGAACCTGAGTCAGGCTTTCAAGAACCTGCG<br>CGGGCTGTGGGGCGTGCAGGCGCCCGTGGGCGACCGGTCGACGGTGAGCAGCTT<br>GCTGACGCCCAACTCGCGGCTGCTGCTGCTGCTGATCGCGCCCTTCACCGACAGT<br>GGCAGCGTGAACCGCAACTCGTACCTGGGCCATCTGCTGACGCTGTACCGCGAG<br>GCCATAGGCCAGGCGCAGGTGGACGAGCAGACCTTCCAGGAGATCACTAGCGTG<br>AGCCGCGCGCTGGGGCAGAACGACACCGACAGTCTGAGGGCCACCCTGAACTTC<br>TTGCTGACCAATAGACAGCAGAAGATCCCGGCGCAATATGCGCTGTCGGCCGAG<br>GAGGAAAGGATCCTGAGATATGTGCAGCAGAGCGTAGGGCTGTTCCTGATGCAG<br>GAGGGGGCCACCCCCAGCGCCGCGCTGGACATGACCGCGCGCAACATGGAACCT<br>AGCATGTACGCCGCCAACCGGCCGTTCATCAATAAGCTGATGGACTACCTGCAC<br>CGCGCGGCGTCCATGAACTCGGACTACTTTACCAATGCCATCCTGAACCCGCACT<br>GGCTCCCGCCGCCGGGGTTCTACACGGGCGAGTACGACATGCCCGACCCCAACG<br>ACGGGTTCCTGTGGGACGACGTGGACAGCGTGGTGTTCTCGCCGACCTTTCAAA<br>AGCGCCAGGAGGCGCCGCCGAGCGAGGGCGCGGTGGGGAGGAGCCCCTTTCCT<br>AGCTTAGGGAGTTTGCATAGCTTGCCGGGCTCGGTGAACAGCGGCAGGGTGAGC<br>CGGCCGCGCTTGCTGGGCGAGGACGAGTACCTGAACGACTCGCTGCTGCAGCCG<br>CCACGGGCCAAGAACGCCATGGCCAATAACGGTATAGAGAGTCTGGTGGACAA<br>ACTGAACCGTTGGAAGACCTACGCTCAGGACCATAGGGATGCGCCCGCGCCGCG<br>GCGACAGCGCCACGACCGGCAGCGGGGCCTGGTGTGGGACGACGAGGACTCGG<br>CCGACGATAGCAGCGTGTTGGACTTGGGCGGGAGCGGTGGGGTCAACCCGTTCG<br>CGCATCTGCAGCCCAAACTGGGGCGACGGATGTTTTGAAATGCAAAATAAAACT<br>CACCAAGGCCATAGCGTGCGTTCTCTTCCTTGTTAGAGATGAGGCGTGCGGTGGT<br>GTCTTCCTCTCCTCCTCCCTCGTACGAGAGCGTGATGGCGCAGGCGACCCTGGAG<br>GTTCCGTTTGTGCCTCCGCGGTATATGGCTCCTACGGAGGGCAGAAACAGCATTC<br>GTTACTCGGAGCTGGCTCCGCAGTACGACACCACTCGCGTGTACTTGGTGGACA<br>ACAAGTCGGCGGACATCGCTTCCCTGAACTACCAAAACGACCACAGCAACTTCC<br>TGACCACGGTGGTGCAGAACAACGATTTCACCCCCGCCGAGGCCAGCACGCAGA<br>CGATAAATTTTGACGAGCGGTCGCGGTGGGCGGTGATCTGAAGACCATTCTGC<br>ACACTAACATGCCCAATGTGAACGAGTACATGTTCACCAGCAAGTTTAAGGCGC<br>GGGTGATGGTGGCTAGGAAGCATCCAGAGGGGGTAGTTGAAACAGATTTGAGTC<br>AGGATAAGCTTGAATATGAGTGGTTTGAGTTTACCCTGCCCGAGGGAAACTTTTC<br>CGAGACCATGACCATAGACCTGATGAACAACGCCATCTTGGAAAACTACTTGCA<br>AGTGGGGCGGCAAAATGGCGTGCTGGAGAGCGATATCGGAGTCAAGTTTGACA<br>GCAGAAATTTCAAGCTGGGCTGGGACCCGGTGACCAAGCTGGTGATGCCAGGGG<br>TCTACACCTACGAGGCCTTCCACCCGGACGTGGTGCTGCTGCCGGGCTGCGGGG<br>TGGATTTCACCGAGAGCCGCCTGAGCAACCTCCTGGGCATTGCAAGAAGCAAC<br>CTTTCCAAGAGGGCTTCAGAATCATGTATGAGGATCTAGAAGGTGGCAACATCC<br>CCGCCCTCCTTGATGTGCCCAAGTACTTGGAAAGCAAGAAGAAAGTTGAAGACG<br>AAACTAAAAATGCAGCTGCGGCTACAGCCGATACAACCACTAGGGGTGATACAT<br>TTGCAACTCCAGCGCAAGAGACAGCAGCTGATAAGAAGGTAGAAGTCTTGCCCA<br>TTGAAAAGGATGAGAGTGGTAGAAGTTACAACCTGATCCAGGGGACCCACGAC<br>ACGCTGTACCGCAGTTGGTACCTGTCCTATACCTACGGGGACCCCGAGAAGGGG<br>GTGCAGTCGTGGACGCTGCTCACCACCCCGGACGTTACCTGCGGCGCGGAGCAA |

TABLE 7-continued

Nucleic Acid Sequences of Vectors

SEQ ID NO Sequence

GTCTACTGGTCACTGCCGGACCTCATGCAAGACCCCGTCACCTTCCGCTCCACCC
AGCAAGTCAGCAACTACCCCGTGGTCGGCGCCGAGCTCATGCCCTTCCGCGCCA
AGAGCTTTTACAACGACCTCGCCGTCTACTCCCAGCTCATCCGCAGCTACACCTC
CCTCACCCACGTCTTCAACCGCTTCCCCGACAACCAGATCCTCTGCCGCCCGCCC
GCGCCCACCATCACCACCGTCAGTGAAAACGTGCCTGCTCTCACAGATCACGGG
ACGCTACCGCTGCGCAGCAGTATCCGCGGAGTCCAGCGAGTGACCGTCACTGAC
GCCCGTCGCCGCACCTGTCCCTACGTCTACAAGGCCCTGGGCATAGTCGCGCCGC
GCGTGCTTTCCAGTCGCCACCTTCTAAAAAAATGTCTATTCTCATCTCGCCCAGCA
ATAACACCGGCTGGGGTCTTACTAGACCCAGCACCATGTACGGAGGAGCCAAGA
AGCGCTCCCAGCAGCACCCCGTCCGCGTCCGCGGCCACTTCCGCGCTCCCTGGG
GCGCTTACAAGCGCGGGCGGACTTCCACCGCCGTGCGCACCACCGTCGACGACG
TCATCGACTCGGTGGTCGCCGACGCGCGCAACTACACTCCCGCCCCCTCCACCGT
GGACGCGGTCATCGACAGCGTGGTGGCCGACGCGCGCGACTATGCCAGACGCAA
GAGCCGGCGGCGACGGATCGCCAGGCGCCACCGGAGCACGCCCGCCATGCGCG
CCGCCCGGGCTCTGCTGCGCCGCGCCAGACGCACGGGCCGCCGGGCCATGATGC
GAGCCGCGCGCCGCGCTGCCACTGCACCCACCCCCGCAGGCAGGACTCGCAGAC
GAGCGGCCGCCGCCGCCTGCGGCCATCTCTAGCATGACCAGACCCAGGCGCG
GAAACGTGTACTGGGTGCGCGACTCCGTCACGGGCGTGCGCGTGCCCGTGCGCA
CCCGTCCTCCTCGTCCCTGATCTAATGCTTGTGTCCTCCCCCGCAAGCGACGATG
TCAAAGCGCAAAATCAAGGAGGAGATGCTCCAGGTCGTCGCCCCGGAGATTTAC
GGACCACCCCAGGCGGACCAGAAACCCCGCAAAATCAAGCGGGTTAAAAAAAA
GGATGAGGTGGACGAGGGGGCAGTAGAGTTTGTGCGCGAGTTCGCTCCGCGGCG
GCGCGTAAATTGGAAGGGGCGCAGGGTGCAGCACGTGTTGCGGCCCGGCACGG
CGGTGGTGTTCACGCCCGGCGAGCGGTCCTCGGTCAGGAGCAAGCGTAGCTATG
ACGAGGTGTACGGCGACGACGACATCCTGGACCAGGCGGCGGAGCGGGCGGGC
GAGTTCGCCTACGGGAAGCGGTCGCGCGAAGAGGAGCTGATCTCGCTGCCGCTG
GACGAAAGCAACCCCACGCCGAGCCTGAAGCCCGTGACCCTGCAGCAGGTGCTG
CCCCAGGCGGTGCTGCTGCCGAGCCGCGGGGTCAAGCGCGAGGGCGAGAGCAT
GTACCCGACCATGCAGATCATGGTGCCCAAGCGCCGCGCGTGGAGGACGTGCT
GGACACCGTGAAAATGGATGTGGAGCCCGAGGTCAAGGTGCGCCCCATCAAGC
AGGTGGCGCCGGGCCTGGGCGTGCAAACCGTGGACATTCAGATCCCCACCGACA
TGGATGTCGACAAAAAACCCTCGACCAGCATCGAGGTGCAAACCGACCCCTGGC
TCCCAGCCTCCACAGCTACCGTCTCCACTTCTACCGCCGCCACGGCTACCGAGCC
TCCCAGGAGGCGAAGATGGGGCGCCGCCAGCCGGCTGATGCCCAACTACGTGTT
GCATCCTTCCATCATCCCGACGCCGGGCTACCGCGGCACCCGGTACTACGCCAG
CCGCCGGCGCCCAGCCAGCAAACGCCGCCGCCGCACCGCCACCCGCCGCCGTCT
GGCCCCCGCCCGCGTGCGCCGCGTGACCACGCGCGGGGCCGCTCGCTCGTTCT
GCCCACCGTGCGCTACCACCCCAGCATCCTTTAATTCGTGTGCTGTGATACTGTT
GCAGAGAGATGGCTCTCACTTGCCGCCTGCGCATCCCCGTCCCGAATTACCGAG
GAAGATCCCGCCGCAGGAGAGGCATGGCAGGCAGCGGCCTGAACCGCCGCCGG
CGGCGGGCCATGCGCAGGCGCCTGAGTGGCGGCTTTCTGCCCGCGCTCATCCCC
ATAATCGCCGCGGCCATCGGCACGATCCCGGGCATAGCTTCGTTGCGCTGCAG
GCGTCGCAGCGCCGTTGATGTGCGAATAAAAGCCTCTTTAGACTCTGACACACCT
GGTCCTGTATATTTTTAGAATGGAAGACATCAATTTTGCGTCCCTGGCTCCGCGG
CACGGCACGCGGCCGTTCATGGGCACCTGGAACGAGATCGGCACCAGCCAGCTG
AACGGGGGCGCCTTCAATTGGAGCAGTGTCTGGAGCGGGCTTAAAAATTTCGGC
TCGACGCTCCGGACCTATGGGAACAAGGCCTGGAATAGTAGCACGGGGCAGTTG
CTAAGGGAAAAGCTCAAAGACCAGAACTTTCAGCAGAAGGTGGTGGACGGGCT
GGCCTCGGGCATTAACGGGGTGGTGGACATCGCGAACCAGGCCGTGCAGCGCGA
GATAAACAGCCGCCTGGACCCGCGGCCGCCCACGGTGGTGGAGATGGAAGATG
CAACTCTTCCGCCGCCCAAAGGCGAGAAGCGGCCGCGGCCCGACGCGGAGGAG
ACGATCCTGCAGGTGGACGAGCCGCCCTCGTACGAGGAGGCCGTCAAGGCCGGC
ATGCCCACCACGCGCATCATCGCGCCGCTGGCCACGGGTGTAATGAAACCCGCC
ACCCTTGACCTGCCTCCACCACCCGCGCCCGCTCCACCGAAGGCAACTCCGGTTG
TGCAGGCCCCCCCGGTGGCGACCGCCGTGCGCCGCGTCCCCGCCCGCCGCCAGG
CCCAGAACTGGCAGAGCACGTTGCACAGTATCGTAGGCCTGGGAGTGAAAAGTC
TGAAGCGCCGCCGATGCTATTGAAAGAGAGGAAAGAGGACACTAAAGGGAGAG
CTTAACTTGTATGTGCCTTACCGCCAGAGAACGCGCGAAGATGGCCACCCCCTC
GATGATGCCGCAGTGGGCGTACATGCACATCGCCGGGCAGGACGCCTCGGAGTA
CCTGAGCCCGGGTCTGGTGCAGTTTGCCCGCGCCACCGACACGTACTTCAGCCTG
GGCAACAAGTTTAGGAACCCCACGGTGGCCCCGACCCACGATGTGACCACGGAC
CGGTCCCAGCGTCTGACGCTGCGCTTCGTGCCCGTGGATCGCGAGGACACCACG
TACTCGTACAAGGCGCGCTTCACTCTGGCCGTGGGCGACAACCGGGTGCTAGAC
ATGGCCAGCACTTACTTTGACATCCGCGGCGTCCTGGACCGCGGTCCCAGCTTCA
AACCCTACTCGGGCACAGCTTACAACAGCCTGGCCCCCAAGGGCGCCCCCAACT
CCAGTCAGTGGGAACAGAAAAAGGCCAATGCTGGAGAACAAAAGGAAACACAT
ACTTATGGTGTAGCTCCTATGGGTGGAGAAAACATTACAATTAGCGGTTTGCAA
ATTGGAACAGATACTCAAATGGCAAACAAGACCCGATATATGCTAATAAGCTG
TATCAACCAGAGCCTCAAGTAGGAGAAGAAACTGGCAGGAAACAGAAGCCTT
CTATGGAGGAAGGGCTCTTAAAAAGGAAACCAAGATGAAACCATGCTATGGCTC
ATTTGCCAGACCCACAAATGAAAAAGGAGGACAGGCAAAACTAAGAGACCCTG
AAAAAAGTCAAGAAGATTTTGACATAGACCTAGCATTCTTTGATACTCCGGGAG
GAACTTTAACAGGTGGTGGAACGGAATACAAAGCAGACATTGTTATGTGCACTG
AAAATGTTAATCTTGAAACCCCGGACACCCACGTGGTGTATAAACCAGGCAAAG
ATGATGACAGTTCAGAAATCAACTTGGTTCAGCAGTCCATGCCCAACAGACCTA
ACTACATCGGCTTCAGGGACAACTTTGTGGGTCTCATGTACTACAACAGCACTGG

TABLE 7-continued

Nucleic Acid Sequences of Vectors

SEQ ID NO Sequence

```
CAACATGGGTGTGCTGGCCGGTCAGGCTTCTCAGTTGAATGCTGTGGTCGACTTG
CAAGACAGAAACACAGAGCTGTCTTACCAGCTCTTGCTAGATTCTCTGGGCGAC
AGAACCAGGTACTTTAGCATGTGGAACTCTGCGGTGGACAGCTATGATCCCGAT
GTCAGGATCATTGAGAATCACGGTGTGGAAGATGAACTTCCCAACTATTGCTTCC
CATTGGATGGGTCTGGCACCAATGCTGCTTATGAAGGTGTAAAAGTTAAAAATG
GACAAGATGGGGATCAAGAGAGCGAATGGGAAAAAGACACCAATGTGGCAGAT
CGAAACCAAATATGCAAGGGCAACATCTACGCCATGGAGATCAACCTCCAGGCC
AACCTGTGGAAGAGTTTTCTGTACTCGAACGTGGCGCTGTACCTGCCCGACTCCT
ACAAGTACACGCCGGCCAACGTCACGCTGCCCACCAACACCAACACCTACGAGT
ACATGAATGGCCGCGTGGTAGCCCCCTCGCTGGTGGACGCCTACATTAACATCG
GCGCCCGCTGGTCGCTGGACCCCATGGACAACGTCAACCCCTTTAACCACCACC
GCAACGCGGGCCTGCGCTACCGCTCCATGCTTCTGGGCAACGGCCGCTACGTGC
CCTTCCACATCCAAGTGCCCCAAAAGTTCTTTGCCATCAAGAACCTGCTCCTGCT
TCCCGGCTCCTACACCTACGAGTGGAACTTCCGCAAGGATGTCAACATGATCCTG
CAAAGTTCCCTCGGCAACGACCTGCGCGTCGACGGCGCCTCCGTCCGCTTCGAC
AGCGTCAACCTCTACGCCACCTTCTTCCCCATGGCGCACAACACCGCCTCCACCC
TGGAAGCCATGCTGCGCAACGACACCAACGACCAGTCCTTCAACGACTACCTCT
CGGCCGCCAACATGCTCTACCCCATCCCGGCCAAGGCCACCAACGTGCCCATTTC
CATCCCCTCGCGCAACTGGGCCGCCTTCCGCGGCTGGAGTTTCACCCGGCTCAAG
ACCAAGGAAACTCCCTCCCTTGGCTCGGGTTTTGACCCCTACTTTGTCTACTCGG
GTTCCATCCCCTACCTCGACGGGACCTTCTACCTCAACCACACCCTTCAAGAAGGT
CTCCATCATGTTCGACTCCTCGGTCAGCTGGCCCGGCAACGACCGGCTGCTCACG
CCCGAACGAGTTCGAGATTAAGCGCAGCGTCGACGGGGAGGGCTACAATGTGGCC
CAATGCAACATGACCAAGGACTGGTTCCTCGTCCAGATGCTCTCCCACTACAAC
ATCGGCTACCAGGGCTTCCACGTGCCCGAGGGCTACAAGGACCGCATGTACTCC
TTTTTCCGCAACTTCCAGCCCATGAGCAGGCAGGTGGTCGATGAGATCAACTAC
AAGGACTACAAGGCCGTCACCCTGCCATTCCAGCACAACAACTCGGGCTTCACC
GGCTACCTCGCACCCACCATGCGTCAGGGGCAGCCCTACCCCGCCAACTTCCCCT
ACCCGCTCATCGGCTCCACCGCAGTGCCATCCGTCACCCAGAAAAAGTTCCTCTG
CGACAGGGTCATGTGGCGCATCCCCTTCTCCAGCAACTTCATGTCCATGGGTGCC
CTCACCGACCTGGGTCAGAACATGCTCTACGCCAACTCGGCCCACGCGCTCGAC
ATGACCTTCGAGGTGGACCCCATGGATGAGCCCACCCTCCTCTATCTTCTCTTCG
AAGTTTTCGACGTGGTCAGAGTGCACCAGCCGCACCGCGGCGTCATCGAGGCCG
TCTACCTGCGCACGCCCTTCTCCGCCGGCAACGCCACCACCTAAGCATGAGCGGT
TCCAGCGAACGAGAACTCGCGGCCATCGTGCGCGACCTGGGCTGCGGGCCCTAC
TTTTTGGGTACCCACGACAAGCGCTTTCCGGGTTTCCTCGCCGGCGACAAGCTGG
CCTGCGCCATCGTCAACACGGCCGGCCGCGAGACCGGGGCGTGCACTGGCTCG
CCTTCGGCTGGAACCCGCGCTCGCGCACCTGCTACATGTTCGACCCCTTTGGGTT
CTCGGACCGCCGGCTCAAGCAGATTTACAGCTTCGAGTACGAGGCCATGCTGCG
CCGCAGCGCCCTGGCCTCCTCGCCCGATCGCTGTCTCAGCCTCGAACAGTCCACC
CAGACCGTGCAGGGGCCCGACTCCGCCGCCTGCGGACTCTTCTGTTGCATGTTCT
TGCATGCCTTCGTGCACTGGCCCGACCGACCCATGGACGGGAACCCCACCATGA
ACTTGCTGACGGGGGTGCCCAACGGCATGCTACAATCGCCACAGGTGCTGCCCA
CCCTCCGGCGCAACCAGGAGGAGCTCTACCGCTTCCTCGCGCGCCACTCCCCTTA
CTTTCGCTCCCACCGCGCCGCCATCGAACACGCCACCGCTTTTGACAAAATGAAA
CAACTGCGTGTATGACTCAAATAAACAGCACTTTTATTTTACACATGCACTGGAG
TATATGCAAGTTATTTAAAAGTCGAAGGGGTTCTCGCGCTCGTCGTTGTGCGCCG
CGCTGGGGAGGGCCACGTTGCGGTACTGGAACTTGGGCTGCCACTTGAACTCGG
GGATCACCAGTTTGGGCACTGGGGTCTCGGGGAAGGTCTCGCTCCACATGCGCC
GGCTCATCTGCAGGGCGCCCAGCATGTCAGGGCCGGAGATCTTGAAATCGCAGT
TGGGGCCGGTGCTCTGCGCGCGCGAGTTGCGGTACACGGGGTTGCAGCACTGGA
ACACCATCAGACTGGGGTACTTCACACTGGCCAACACGCTCTTGTCGCTGATCTG
ATCCTTGTCCAGGTCCTCGGCGTTGCTCAGGCCGAACGGGGTCATCTTGCACAGC
TGGCGGCCCAGGAAGGGCACGCTCTGAGGCTTGTGGTTACACTCGCAGTGCACG
GGCATCAGCATCATCCCCGCGCCGCGCTGCATATTCGGGTAGAGGGCCTTGACG
AAGGCCGCGATCTGCTTGAAAGCTTGCTGGGCCTTGGCCCCCTCGCTGAAAAAC
AGGCCGCAGCTCTTCCCGCTGAACTGGTTATTCCCGCACCCGGCATCATGCACGC
AGCAGCGCGCGTCATGGCTGGTCAGTTGCACCACGCTCCGTCCCCAGCGGTTCTG
GGTCACCTTAGCCTTGCTGGGCTGCTCCTTCAGCGCGCGCTGTCCGTTCTCGCTG
GTCACATCCATCTCCACCACGTGGTCCTTGTGAATCATCACCGTTCCATGCAGAC
ACTTGAGCTGACCTTCCACCTCGGTGCAGCCGTGATCCCACAGGACGCAGCCGG
TGCACTCCCAATTCTTGTGCGCGATCCCGCTGTGGCTGAAATGTAACCTTGCAA
CAGGCGACCCATAATGGTGCTAAATGCTTTCTGGGTGGTGAATGTCAGTTGCATC
CCGCGGGCCTCCTCGTTCATCCAGGTCTGGCACATCTTCTGGAAGATCTCGGTCT
GCTCCGGCATGAGCTTGTAAGCATCGCGCAAGCCGCTGTCGACGCGGTAGCGTT
CCATCAGCACGTTCATGGTATCCATGCCCTTCTCCCATGACGAGACCAGAGGCA
GACTCAGGGGGTTGCGCACGTTCAGGACACCAGGGGTCGCGGGCTCGACGATGC
GTTTTCCGTCCTTGCCTTCCTTCAACAGAACCGGAGGCTGGCTGAATCCCACTCC
CACGATCACGGCGTCTTCCTGGGGCATCTCTTCGTCGGGGTCTACCTTGGTCACA
TGCTTGGTCTTTCTGGCTTGCTTCTTTTTTGGAGGGCTGTCCACGGGGACCACGTC
CTCCTCGGAAGACCCGGAGCCCACCCGCTGATACTTTCGGCGCTTGGTGGGCAG
AGGAGGTGGCGGCGGCGAGGGGCTCCTCTCCTGCTCCGGCGGATAGCGCGCCGA
CCCGTGGCCCCGGGCGGAGTGGCCTCTCGCTCCATGAACCGGCGCACGTCCTG
ACTGCCGCCGGCCATTGTTTCCTAGGGGAAGATGGAGGAGCAGCCGCGTAAGCA
GGAGCAGGAGGAGGACTTAACCACCCACGAGCAACCCAAAATCGAGCAGGACC
TGGGCTTCGAAGAGCCGGCTCGTCTAAAACCCCCACAGGATGAACAGGAGCACG
```

TABLE 7-continued

Nucleic Acid Sequences of Vectors

SEQ ID NO Sequence

AGCAAGACGCAGGCCAGGAGGAGACCGACGCTGGGCTCGAGCATGGCTACCTG
GAAGGAGAGGAGGATGTGCTGCTAAAACACCTGCAGCGCCAGTCCCTCATCCTC
CGGGACGCCCTGGCCGACCGGAGCGAAACCCCCCTCAGCGTCGAGGAGCTGTGT
CGGGCCTACGAGCTCAACCTCTTCTCGCCGCGCGTGCCCCCCAAACGCCAGCCC
AACGGCACCTGCGAGCCCAACCCGCGTCTCAACTTCTATCCCGTCTTTGCGGTCC
CCGAGGCCCTTGCCACCTATCACATCTTTTTCAAGAACCAAAAGATCCCCATCTC
CTGTCGCGCCAATCGCACTCGCGCCGACGCGCTCCTCGCTTTGGGGCCCGGCGCG
CGCATACCTGATATCGCTTCCCTGGAAGAGGTGCCCAAGATCTTCGAAGGGCTC
GGTCGGGACGAGACGCGCGCGGCAAACGCTCTGAAAGAAACAGCAGAGGAAGA
GGGTTACACTAGCGCCCTGGTAGAGTTGGAAGGCGACAACGCCAGGCTGGCCGT
GCTTAAGCGCAGCGTCGAGCTCACCCATTTCGCCTACCCCGCCGTCAACCTCCCG
CCCAAGGTCATGCGTCGCATCATGGATCAGCTCATCATGCCCCACATCGAGGCC
CTTGATGAAAGTCAGGAACAGCGCCCCGAGAACGCCCAGCCCGTGGTCAGCGAC
GAGATGCTCGCGCGCTGGCTCGGGACCCGCGACCCCCAGGCCCTGGAGCAGCGG
CGCAAGCTCATGCTGGCCGTGGTCCTGGTCACCCTTGAGCTCGAATGCATGCGCC
GCTTTTTTACCGACCCCGAGACCCTGCGCAAGGTCGAGGAGACCCTGCACTACA
CTTTCAGACACGGTTTCGTCAGGCAGGCCTGCAAGATCTCCAACGTGGAGCTGA
CCAACCTGGTCTCCTGCCTGGGGATCCTACACGAGAACCGCTTGGGACAGACCG
TGCTCCACTCTACCCTGAAGGGCGAGGCGCGGCGGGACTACATCCGCGACTGCG
TCTTTCTCTTTCTCTGCCACACATGGCAAGCGGCCATGGGCGTGTGGCAGCAGTG
TCTCGAGGACGAGAACCTGAAGGAGCTGGACAAGCTTCTTGCTAGAAACCTTAA
AAAGCTGTGGACGGGCTTCGACGAGCGCACCGTCGCCTCGGACCTGGCCGAGAT
CGTCTTCCCCGAGCGCCTGAGGCAGACGCTGAAAGGAGGGCTGCCCGACTTCAT
GAGCCAGAGCATGTTGCAAAACTACCGCACTTTCATTCTCGAGCGATCTGGGAT
GCTGCCCGCCACCTGCAACGCCTTCCCCTCCGACTTTGTCCCGCTGAGCTACCGC
GAGTGTCCCCCGCCGCTGTGGAGCCACTGCTACCTCTTGCAGCTGGCCAACTACA
TTGCCCACCACTCGGATGTGATCGAGGACGTGAGCGGCGAGGGGCTGCTCGAGT
GCCACTGTCGCTGCAACCTATGCTCCCCGCACCGCTCCCTGGTCTGCAACCCCCA
GCTACTGAGCGAGACCCAGGTCATCGGTACCTTTGAGCTGCAAGGTCCGCAGGA
GTCCACCGCTCCGCTGAAACTCACGCCGGGGTTGTGGACTTCCGCGTACCTGCGC
AAATTTGTACCCGAGGACTACTACGCCCATGAGATAAAGTTCTTCGAGGACCAA
TCGCGTCCGCAGCACGCGGATCTCACGGCCTGCGTCATCACCCAGGGCGCGATC
CTCGCCCAATTGCACGCCATCCAAAAATCCCGCCAAGAGTTTCTTCTGAAAAAG
GGTAGAGGGGTCTACCTGGAACCCCAGACGGGCGAGGTGCTCAACCCGGGTCTC
CCCCAGCATGCCGAGGAAGAAGCAGGAGCCGCTAGTGGAGGAGATGGAAGAAG
AATGGGACAGCCAGGCAGAGGAGGACGAATGGGAGGAGGAGACAGAGGAGGA
AGACTTGGAAGAGGTGGAAGAGGAGCAGGCAACAGAGCAGCCCGTCGCCGCAC
CATCCGCGCCGGCAGCCCCTCCGGTCACGGATACAACCTCCGCAGCTCCGGCCA
AGCCTCCTCGTAGATGGGATCGAGTGAAGGGTGACGGTAAGCACGAGCGACAG
GGCTACCGATCATGGAGGGCCCACAAAGCCGGATCATCGCCTGCTTGCAAGAC
TGCGGGGGGAACATCGCTTTCGCCCGCCGCTACCTGCTCTTCCACCGCGGGGTGA
ACATCCCCCGCAACGTGTTGCATTACTACCGTCACCTTCACAGCTAAGAAAAAG
CAAGTCAAAGGAGTCGCCGGAGGAGGAGGCCTGAGGATCGCGGCGAACGAGCC
CTTGACCACCAGGGAGCTGAGGAACCGGATCTTCCCCACTCTTTATGCCATTTTT
CAGCAAAGTCGAGGTCAGCAGCAAGAGCTCAAAGTAAAAAACCGGTCTCTGCG
CTCGCTCACCCGCAGTTGCTTGTACCACAAAAACGAAGATCAGCTGCAGCGCAC
TCTTGAAGACGCCGAGGCTCTGTTCCACAAGTACTGCGCGCTGACTCTTAAAGAC
TAAGGCGCGCCCACCCGGAAAAAAGGCGGGAATTACCTCATCGCCACCATGAGC
AAGGAGATTCCCACCCCTTACATGTGGAGCTATCAGCCCCAGATGGGCCTGGCC
GCGGGCGCCTCCCAGGACTACTCCACCCGCATGAACTGGCTTAGTGCCGGCCCC
TCGATGATCTCACGGGTCAACGGGGTCCGTAACCATCGAAACCAGATATTGTTG
CAGCAGGCGGCGGTCACCTCCACGCCCAGGGCAAAGCTCAACCCGCGTAATTGG
CCCTCCACCCTGGTGTATCAGGAAATCCCCGGGCCGACTACCGTACTACTTCCGC
GTGACGCACTGGCCGAAGTCCGCATGACTAACTCAGGTGTCCAGCTGGCCGGCG
GCGCTTCCCGGTGCCCGCTCCGCCCACAATGGGTATAAAAACCCTGGTGATCC
GAGGCAGAGGCACACAGCTCAACGACGAGTTGGTGAGCTCTTCAATCGGTCTGC
GACCGGACGGAGTGTTCCAACTAGCCGGAGCCGGGAGATCGTCCTTCACTCCCA
ACCAGGCCTACCTGACCTTGCAGAGCAGCTCTTCGCAGCCTCGCTCGGGAGGCA
TCGGAACCCTCCAGTTCGTGGAGGAGTTTGTGCCCTCGGTCTACTTCAACCCCTT
CTCGGGCTCGCCAGGCCTCTACCCGGACGAGTTTATACCGAACTTCGACGCAGT
GAGAGAAGCGGTGGACGGCTACGACTGAATGTCCTATGGTGACTCGGCTGAGCT
CGCTCGGTTGAGGCATCTGGACCACTGCCGCCGCCTGCGCTGCTTTGCCCGGGAG
AGCTACGGCCTCATCTACTTTGAGCTGCCCGAGGAGCACCCCAACGGCCCTGCA
CACGGAGTGCGGATCACCGTAGAGGGCACCACCGAGTCTCACCTGGTCAGGTTC
TTCACCCAGCAACCCTTCCTGGTCGAGCGGGACCGGGCGCCACCACCTACACC
GTCTACTGCATTTGTCCTACCCCGAAGTTGCATGAGAATTTTTGTTGTACTCTTTG
TGGTGAGTTTAATAAAAGCTAAACTCTTGCAATACTCTGGACCTTGTCGTCATCA
ACTCAACGAGACCGTCTACCTCACCAACCAGACTGAGGTAAAACTTACCTGCAG
ACCACACAAGACCTATATCATCTGGTTCTTCGAGAACACCTCATTTGCAGTCTCC
AACACTCACTGCAACGACGGTGTTGAACTTCCCAACAACCTTTCCAGTGGACTG
AGTTACAATACACGTAGAGCTAAGCTCATCCTCTACAATCCTTTTGTAGAGGGAA
CCTACCAGTGCCAGAGCGGACCTTGCTTCCACAGTTTTACTTTGGTGAACGTTAC
CGGCAGCAGCACAGCCGCTCCAGAAACTAACCTTCCTTCTGATACTATCAAACCT
TGTTTCGGAGGTGAGCTAAGGCTTCCCCCTTCTCAGGAGGGGGTTAGCCCATACG
AAGTGGTCGGGTATTTGATTTTAGGGGTGGTCCTGGGTGGGTGCATAGCGGTGCT
AGCTCAGCTGCCTTGCTGGGTGGAAATCAAAATCTTTATATGCTGGGTAAGACAT

TABLE 7-continued

Nucleic Acid Sequences of Vectors

| SEQ ID NO | Sequence |
|---|---|
| | TGTGGGAGGAACTATGAAGGGGCTCTTGCTGATTATCCTTTCCCTGGTGGGGG |
| | GTGTGCTGTCATGCCACGAACAGCCACGATGTAACATCACCACAGGCAATGAGA |
| | GGAACGACTGCTCTGTAGTTATCAAATGCGAGCACCATTGTCCTCTCAACATTAC |
| | ATTCAAAAATAAGACCATGGGAAATGTATGGGTGGGATTCTGGCAACCAGGAGA |
| | TGAGCAGAACTACACGGTCACTGTCCATGGTAGCAATGGCAATCACACTTTCGG |
| | TTTCAAATTCATTTTTGAAGTCATGTGTGATATCACACTACATGTGGCTAGACTT |
| | CATGGCTTGTGGCCCCCTACCAAGGATAACATGGTGGGTTTTTCTTTGGCTTTTG |
| | TGATCATGGCCTGCTTGATGTCAGGTCTGCTGGTAGGGGCTCTAGTGTGGTTTCT |
| | GAAACGCAAGCCCAGGTATGGAAATGAAGAGAAGGAAAAATTGCTATAAATTC |
| | TTTTTCTTTTTCGCAGAACCATGAATACAGTGATCCGTATCGTGCTGCTCTCTCTT |
| | CTTGTAGCTTTTAGTCAGGCAGGATTTCATACTATCAATGCTACATGGTGGGCTA |
| | ATATAACTTTAGTGGGACCCCCAGACACACCAGTCACTTGGTATGATACTCAAG |
| | GATTGTGGTTTTGCAATGGCAGTAGAGTTAAGAATCCTCAAATCAGACATACAT |
| | GTAATGATCAAAACCTTACTTTGATCCATGTGAACAAAACTTATGAAAGAACAT |
| | ACATGGGTTATAATAGACAAGGGACTAAAAAAGAAGACTACAAAGTTGTAGTTA |
| | TACCACCTCCTCCTGCTACTGTAAAACCACAGCCAGAGCCAGAGTATGTGTTTGT |
| | TTATATGGGAGAGAACAAAACTCTAGAAGGTCCTCCGGGAACTCCAGTCACATG |
| | GTTTAATCAGGATGGAAAGAAATTTTGTGAAGGAGAAAAAGTTCTTCATCCAGA |
| | ATTTAACCACACCTGTGACAAACAAAACCTTATCTACTGTTTGTGAATTTTACA |
| | CATGATGGAGCTTACCTTGGGTACAATCATCAAGGAACCCAGAGAACACACTAT |
| | GAAGTTACAGTATTAGATCTTTTTCCAGATTCTGGCCAAATGAAAATTGAACATC |
| | ATAACTGGCAGAAACAGGGTGGGCAAAAACAGGGTGGGCAAAAAACAAATCAA |
| | ACAAAAGTTAATGACAGGAGAAAAACAGCGCAAAAAAGACCATCAAAGCTAAA |
| | GCCGGCAACTATTGAGGCAATGCTGGTTACAGTGACTGCCGGGTCTAACTTAAC |
| | TTTGGTTGGACCTAAAGCAGAAGGAAAAGTTACTTGGTTTGATGGAGATTTAAA |
| | AAGACCATGTGAGCCTAATTACAGACTAAGACACGAATGTAATAATCAAACTT |
| | AACTCTGATTAATGTAACTAAAGATTATGAGGGAACTTACTATGGTACAAATGA |
| | CAAAGATGAGGGCAAAAGGTACAGAGTGAAAGTAAATACTACAAATTCTCAAT |
| | CTGTGAAAATTCAGCCATATACCAGACAAACTACTCCTGATCAAGAGCACAAAT |
| | TTGAATTACAGTTCGAAACTAATGGAAATTATGATTCAAAAATTCCCTCAACCAC |
| | TGTGGCAATCGTGGTGGGTGTGATTGCGGGCTTCATAACTCTGATCATTGTCTTC |
| | ATATGCTACATCTGCTGCCGCAAGCGTCCCAGGGCATACAATCATATGGTAGAC |
| | CCACTACTCAGCTTCTCTTACTAAGACTCAGTCACTTTCATTTCAGAACCATGAA |
| | GGTTTTCACAGCTTGCGTTCTGATTAGCCTAGTCACACTTAGTGTAGCTATTAAA |
| | AATCAATATCATGTTCATAATGTTACCAGAGATGGATATATCACATTAAATGTAA |
| | CAATTGATAATACTACCTGGACAAGATATCATTTAAATAAGTGGCATCAAATTTG |
| | TACGTGGTCAGACCCATCATACAAATGTCACAGCAATGGCAGCATTACCATTCA |
| | TGCTTTCAATATTACTTCTGGCCAGTACAAAGCTGAAAGTTTTACTAACTGGTTT |
| | AGATATTACGGTAATCATAAACATGAAATTCATATTTTTAACATAACTGTAATTG |
| | AGCATCCTACAACAAAAGCACCCACCACTGCTAATACAGCTACATCAATTAAAT |
| | CAACAACCACACAGCCTACTACTAGGGAGACAACTACTGAGACCACTACTCAAA |
| | CTACACAGCTAGACACAACAGTGCAGAATAGCACTGTGTTGGTTAGGTATCTGT |
| | TGAGGGAGGAAAGTACTACTGAACAGACAGAGGCTACCTCAAGTGCCTTTAGCA |
| | GCACTGCAAATTTAACTTCGCTTGCTTGGACTAATGAAACCGGAGTATCATTGAT |
| | GAATCATCAGCCTTTCTCAGGTTTGGATATTCAAATTACTTTTCTGGTTGTTTGTG |
| | GGATCTTTATTCTTGTGGTTCTTCTGTACTTTGTCTGCTGCAAAGCCAGAGAGAA |
| | ATCTAGGAGGCCCATCTACAGGCCAGTAATCGGGGAACCTCAGCCACTCCAAGT |
| | GGAAGGGGGTCTAAGGAATCTTCTTTTCTCTTTTTCAGTATGGTGATCAGCCATG |
| | ATTCCTAGGTTCTTCCTATTTAACATCCTCTTCTGTCTCTTCAACATCTGCGCTGC |
| | CTTTGCAGCCGTCTCGCACGCCTCGCCCGACTGTCTCGGGCCCTTCCCAACCTAC |
| | CTCCTCTTTGCCCTGCTCACCTGCACCTGCGTCTGCAGCATTGTCTGCCTGGTCAT |
| | CACCTTCCTGCAGCTTATCGACTGGTGCTGTGCGCGCTACAATTATCTCCATCAC |
| | AGTCCCGAATACAGGGACAAGAACGTAGCCAGAATCTTAAGGCTCATCTGACCA |
| | TGCAGACTCTGCTCATGCTGCTATCCCTCCTATCCCCTGCCCTAGCCACTTATGCT |
| | GATTACTCTAAATGCAAATTCGCAGACATATGGAATTTCTTAGATTGCTATCAGG |
| | AAAAAATTGATATGCCCTCCTATTACTTGGTGATTGTGGGAATAGTCATGGTCTG |
| | CTCCTGCACTTTCTTTGCCATCATGATTTACCCCTGTTTTGATCTCGGCTGGAACT |
| | CTGTTGAAGCATTCACATACACACTAGAAAGCAGTTCACTAGCCTCCACGCCAC |
| | CACCCACACCGCCTCCTCGCAGAAATCAGTTCCCCCTGATACAGTACTTAGAAG |
| | AGCCCCCTCCCCGACCCCCTTCCACTGTTAGCTACTTTCACATAACCGGCGGCGA |
| | TGACTGACCACCACCTGGACCTCGAGATGGACGGCCAGGCCTCCGAGCAGCGCA |
| | TCCTGCAACTGCGCGTCCGTCAGCAGCAGGAGCGGGCCGCCAAGGAGCTCCTTG |
| | ATGCCATCAACATCCACCAGTGCAAGAAGGGCATCTTCTGCCTGGTCAAACAGG |
| | CAAAGATCACCTACGAGCTCGTGTCCAACGGCAAACAGCATCGCCTTACCTATG |
| | AGATGCCCAGCAGAAGCAGAGTTCACCTGCATGGTGGCGTCAACCCCATAG |
| | TCATCACCCAGCAGTCGGGCGAGACCAACGGCTGCATCCACTGCTCCTGCGAAA |
| | GCCCCGAGTGCATCTACTCCCTTCTCAAGACCCTTTGCGGACTCCGCGACCTCCT |
| | CCCCATGAACTGATGTTGATTAAAAGCCCAGAAACCAATCAGACCCTTCCTCATT |
| | TCCCCATCCCAATACTCATAAGAATAAATCATTGGAATTAATCATTCAATAAAGA |
| | TCACTTACTTGAAATCTGAAAGTATGTCTCTGGTGTAGTTGCTCAGCAACACCTC |
| | GGTACCCTCCTCCCAGCTCTGGTACTCCAGTCCCGGCGGGCGGCGAACTTTCTC |
| | CACACCTTGAAAGGGATGTCAAATTCCTGGTCCACAATTTTCATTGTCTTCCCTC |
| | TTAGATGTCAAAGAGGCTCCGGGTGGAAGATGACTTCAACCCCGTCTACCCCTA |
| | TGGCTACGCGCGGAATCAGAATATCCCCTTCCTCACTCCCCCTTTGTCTCCTCC |
| | GATGGATTCAAAAACTTCCCCCCTGGGGTACTGTCACTCAAACTGGCTGATCCAA |
| | TCACCATTACCAATGGGGATGTATCCCTCAAGGTGGGAGGTGGTCTCACTTTGCA |

TABLE 7-continued

Nucleic Acid Sequences of Vectors

| SEQ ID NO | Sequence |
|---|---|
| | AGATGGAAGCCTAACTGTAAACCCTAAGGCTCCACTGCAAGTTAATACTGATAA<br>AAAACTTGAGCTTGCATATGATAATCCATTTCAAAGTAGTGCTAATAAACTTAGT<br>TTAAAAGTAGGACATGGATTAAAAGTATTAGATGAAAAAAGTGCTGCGGGGTTA<br>AAAGATTTAATTGGCAAACTTGTGGTTTTAACAGGAAAAGGAATAGGCACTGAA<br>AATTTAGAAAATACAGATGGTAGCAGCAGAGGAATTGGTATAAATGTAAGAGC<br>AAGAGAAGGGTTGACATTTGACAATGATGGATACTTGGTAGCATGGAACCCAAA<br>GTATGACACGCGCACACTTTGGACAACACCAGACACATCTCCAAACTGCACAAT<br>TGCTCAAGATAAGGACTCTAAACTCACTTTGGTACTTACAAAGTGTGGAAGTCA<br>AATATTAGCTAATGTGTCTTTGATTGTGGTCGCAGGAAAGTACCACATCATAAAT<br>AATAAGACAAATCCAAAAATAAAAAGTTTTACTATTAAACTGCTATTTAATAAG<br>AACGGAGTGCTTTTAGACAACTCAAATCTTGGAAAAGCTTATTGGAACTTTAGA<br>AGTGGAAATTCCAATGTTTCGACAGCTTATGAAAAAGCAATTGGTTTTATGCCTA<br>ATTTGGTAGCGTATCCAAAACCCAGTAATTCTAAAAAATATGCAAGAGACATAG<br>TTTATGGAACTATATATCTTGGTGGAAAACCTGATCAGCCAGCAGTCATTAAAAC<br>TACCTTTAACCAAGAAACTGGATGTGAATACTCTATCACATTTAACTTTAGTTGG<br>TCCAAAACCTATGAAAATGTTGAATTTGAAACCACCTCTTTTACCTTCTCCTATA<br>TTGCCCAAGAATGAAAGACCAATAAACGTGTTTTTCATTTGAAATTTTCATGTAT<br>CTTTATTGATTTTTACACCAGCACGAGTAGACAGTCTCCCACCACCAGCCCATTT<br>TACAGTGTACACCGGTTCTCTCAGCACGGGTAGCCTTAAATAGGGAAATATTCTCA<br>TTAGTGCGGGAATTGGACTTGGGGTCTATAATCCACACAGTTTCCTGGCGAGCCA<br>AACGGGGGTCGGTGATTGAAATAAAGCCGTCCTCTGAAAAGTCATCCAAGCGGG<br>CCTCACAGTCCAAGGTCACAGTCTGGTGGAACAAGAAGAACGCACAGATTCATA<br>CTCGGAAAACAGGATGGGTCTGTGCCTCTCCATCAGCGCCCTCAGCAGTCTCTGC<br>CGCCGGGGCTCGGTGCGGCTGCTGCAAATGGGATCGGATCACAAGTCTCTCTG<br>ACTATGATCCCAACAGCCTTCAGCATCAGTCTCCTGGTGCGACGGGCACAGCAC<br>CGCATCCTGATCTCTGCCATGTTCTCACAGTAAGTGCAGCACATAATCACCATGT<br>TATTCAGCAGCCCATAATTCAGGGCGCTCCAGCCAAAGCTCATGTTGGGAATGA<br>TGGAACCCACGTGACCATCGTACCAGATGCGACAGTATATCAGGTGCCTGCCCC<br>TCATGAACACACTGCCCATGTACATGATCTCTTTGGGCATGTTTCTGTTTACAAT<br>CTGGCGGTACCAGGGGAAGCGCTGGTTGA |
| SEQ ID<br>NO: 1424 | CATCATCAATAATATACCCCACAAAGTAAACAAAAGTTAATATGCAAATGAGCT<br>TTTGAATTTAGGGCGTGGCCAACGCTGATTGGCCGTTGCAACGACCGTTAGTGAC<br>GTCACGACGCACGGCGTCAACGGTCGGCGCGGAGGCGTGGCCTAGGCCGGAAG<br>CAAGTCGCGGGTCTGATGACGTCTAAAAAAGCGGACTTTAGACCCGGAAATGGC<br>CGATTTTCCCGCGGCCACGCCCGGATATGAGGTAATTCTGGGCGGATGCAAGTG<br>AAATTAGGTCATTTGGCGCGAAAACTGAATGAGGAAGTGAAAAGCGAAAAAT<br>ACCGGTCCCGCCCAGGGCGGAATATTTACCGAGGGCCGAGAGACTTTGACCGAT<br>TACGTGGGGGTTTCGATTGCGGTGTTTTTTTCGCGAATTTCCGCGTCCGTGTCAA<br>AGTCCGGTGTTTATGTCACCTGGTCAGCTGATCCACAGGGTATTTAAACCAGTCG<br>AGACCGTCAAGAGGCCACTCTTGAGTGCCAGCGAGTAGAGATTTCTCTGAGCTC<br>CGCTCCCAGAGTCTGAGAAAAATGAGACACCTGCCGCCTCCTGCCAGCAACTGTG<br>CCTATGGACATGGCTGTGCTTCTGCTGGACGACTTTGTGAATACAGTATTGGAGG<br>ACGAACTGCATCCAAGTCCGTTCGAGCTGGGACCCACACTTCAGGACCTCTATG<br>ATCTGGAGGTAGATGCCCATGAGGACGACCCGAACGAAGAGGCTGTGAATTTAA<br>TATTTCCAGAATCTATGATTCTTCAGGCTGACATAGCCAACGAATCTATTCCTAC<br>TCCACTTCATACTCCAACTCTGTCACCCATACCTGAATTGGAAGAGGAGGACGA<br>GTTAGACCTCCGGTGCTACGAGGAAGGTTTTCCTCCCAGCGATTCAGAGGACGA<br>ACAGGGTGAGCAGAGCATGGCTCTAATCTCAGACTATGCTTGTGTGGTTGTGGA<br>AGAGCATTTTGTGTTGGACAATCCTGAGGTGCCCGGGGAAGGCTGTAGATCCTG<br>CCAATATCACCGGGATCAGACCGGAGACCCTAATGCCTCCTGCGCTCTGTGTTAC<br>ATGAAAACCACTTTCAGCTTTATTTACAGTAAGTGGAGTGAATGTGAGAGAGGC<br>TGAGTGCTTAACACATCTCTGTGTGATGCTTGAACAGCTGTGCTAAGTGTGGTTT<br>ATTTTTGTTACTAGGTCCGGTGTCAGAGGATGAGTCATCACCCTCAGAAGAAGA<br>CCACCCGTCACCCCCTGATCTCACAGATGACACGCCCCTGCAAGTGTACAGACC<br>CACCCCAGTCAGACCCAGTGGCGAGAGGCGAGCAGCTGTTGACAAAATTGAGG<br>ACTTGTTGCAGGACATGGGTGGGGATGAACCTTTGGACCTGAGCTTGAAACGCC<br>CCAGGAACTAGGCGCAGCTGCGCTGAGTCATGTGTAAATAAAGCTGTATAATAA<br>AAGTATATGTGACGCATGCAAGGTGTGGTTTATGACTCATGGGCGGGGCTTAGA<br>CCTATATAAGTGGCAACACCTGGACACTCAGACACAGACCTTCAGGGAGCTCCT<br>GATGGAGGTGTGGACTATCCTTGGGGACTTTAACAAGACACGCCGGCTTGTGGA<br>GGATAGTTCAGACGGGTGCTCCGGTTTCTGGAGACACTGGTTTGGAACTCCTCTA<br>TCTCGCCTGGTGTACACAGTTAAGAAGGATTATAGCGAGGAATTTGAAAATCTTT<br>TTTCCGACTGCTCTGGCCTGCTTGATTCACTGAATTTTGGCCACCAGTCCCTTTTC<br>CAGGAAAGGGTCCTCCACAGCCTTGATTTTTCCAGCCCAGGGCGCACTACAGCC<br>GGGGTTGCTTTTGTGGTTTTTCTGTTGACAAATGGAGCCAGAACACCCAACTGA<br>GCAGGGGCTACATCCTGGACTTCGCGGCCATGCACCTGTGGAGGGCCTGGATCA<br>GGCAGCGGGACAGAGAATCTTGAACTACTGGCTTCTACAGCCAGCAGCTCCGG<br>GTCTTCTTCATCTACACAGACAAACATCCATGTTGGAGGAAGAGATGAGGGAGG<br>CCATGGACGACAACCCGAGGAGCGGCCTGGACCCTCCGTCGGAAGAGGAGCTG<br>GATTGAATCAGGTATCCAGCCTGTACCCAGAGCTTAGCAGGGTGCTGACATCCA<br>TGGCCAGGGGAGTGAAGCGGGAGAGGAGCGATGGGGCAATACCGGGATGATG<br>ACCGAGCTGACGGCCAGCCTGATGAATCGCAAGCGCCCAGAGCGCATTACCTGG<br>CATGAGCTACAGCTGGAGTGCAGGGATGAGGTCGGCCTGATGCAGGATAAATAT<br>GGCCTGGAGCAGATAAAAACCCACTGGTTGAACCCAGATGAGGATTGGGAGGA<br>GGCCATTAAGAAGTATGCCAAGATTGCCCTGCGCCCAGATTGCAAGTACAGGGT |

TABLE 7-continued

Nucleic Acid Sequences of Vectors

SEQ ID NO Sequence

GACCAAGACGGTGAATATCAGACATGCCTGCTACATCTCAGGGAACGGGGCAGA
GGTGGTCATCGATACCCTGGACAAGGCCGCCTTCAGGTGTTGCATGATGGGAAT
GAGAGCCGGAGTGATGAATATGAATTCCATGATCTTCATGAACATGAAGTTCGA
TGGAGAGAAGTTTAATGGGGTGCTGTTCATGGCCAACAGCCACATGACCCTGCA
TGGCTGTGATTTCTTCGGCTTCAACAATATGTGTGCAGAGGTCTGGGGCGCCGCT
AAGATCAGGGGATGTAAGTTTTATGGCTGTTGGATGGGCGTGGTCGGAAGACCC
AAGAGCGAGATGTCTGTGAAGCAGTGTGTGTTTGAGAAATGCTACCTGGGAGTC
TCTACCGAGGGCAATGCTCGAGTGAGACACTGCTCTTCCATGGAGACGGGCTGC
TTCTGCCTGGTGAAGGGCACAGCCTCGATCAAGCATAATATGGTGAAGGGCTGC
ACGGATGAGCGCATGTACAACATGCTGACCTGCGACTCGGGGGTCTGCCATATC
CTGAAGAACATCCATGTGACCTCCCACCCCAGGAAGAAGTGGCCAGTGTTTGAG
AATAACCTGCTGATCAAGTGCCATATGCACCTGGGTGTCAGAAGGGGTACCTTC
CAGCCGTACCAGTGCAACTTTAGCCAGACCAAGCTGCTGTTGGAGAACGATGCC
TTCTCCAGGGTGAACCTGAACGGCATCTTTGACATGGATGTCTCGGTGTACAAGA
TCCTGAGATACGATGAGACCAAGTCCAGGGTGCGCGCTTGCGAGTGCGGGGGCA
GACACACCAGGATGCAACCGGTGGCCCTGGATGTGACCGAGGATCTGCGACCCG
ACCACCTGGTGATGGCCTGTACCGGGACCGAGTTCAGCTCCAGTGGGGAGGACA
CAGATTAGAGGTAGGTTTGAGTAGTGGGCGTGGCTAAGGCGACTATAAAGGTGG
GTGTCTTACGAGGGTCTTTTTGCTTTTCTGCAGACATCATGAACGGGACCGGCGG
GCACTTCGAAGGGGGGCTTTTTAGCCCTTATTTGACAACCCGCCTGCCGGGATGG
GCCGGAGTTCGTCAGAATGTGATGGGATCGACGGTGGACGGGCGCCCAGTGCTT
CCAGCAAATTCCTCGACCATGACCTACGCGACCGTGGGGACGAGCTCGTCGCTC
GACAGCACCGCCGCAGCCGCGGCAGCCGCAGCCGCCATGACAGCGACGAGACT
GGCCTCGAGCTACATGCCAAGCAGCAACAGCAGCCCCTCCGTCCCCAGTTCCAT
CATCGCCGATGAGAAACTGCTGGCCCTGCTGGCAGAGCTGGAAGCCCTGAGCCG
CCAGTTGGCCGCCCTGACCCAGCAGGTGTCCGATCTCCGCGAGCAACAGCAGCA
GCAAAAATAAATGATTCAATAAACACAGATTCTGATTCAAACAGCAAAGCATCT
TTATTATTTATTTTTTCGCGCGCGGTAGGCCCTGGTCCACCTCTCCCGATCATTGA
GAGTGCGGTGGATTTTTTCCAGGACCCGGTAGAGGTGGGATTGGATGTTGAGGT
ACATGGGCATGAGCCCGTCCCGGGGGTGGAGGTAGCACCACTGCATGGCCTCGT
GCTCTGGGGTCGTGTTGTAGATGATCCAGTCATAGCAGGGGCGCTGGGCGTGGT
GCTGGATGATGTCCTTGAGGAGGAGACTGATGGCCACGGGGAGCCCCTTGGTGT
AGGTGTTGGCGAAGCGGTTGAGCTGGGAGGGATGCATGCGGGGGGAGATGATG
TGGAGTTTGGCCTGGATCTTGAGGTTGGCGATGTTGCCGCCCAGATCCCGCCGGG
GGTTCATGTTGTGCAGGACCACCAGGACGGTGTAGCCCGTGCACTTGGGGAACT
TGTCATGCAACTTGGAAGGGAATGCGTGGAAGAATTTGGAGACGCCCTTGTGCC
CGCCCAGGTTTTCCATGCACTCATCCATGATGATGGCAATGGGCCCGTGGGCTGC
GGCTTTGGCAAAGACGTTTCTGGGGTCAGAGACATCGTAATTATGCTCCTGGGTG
AGATCATCATAAGACATTTTAATGAATTTGGGGCGGAGGGTGCCAGATTGGGGG
ACGATGGTTCCCTCGGGACCCGGGGCGAAGTTCCCCTCGCAGATCTGCATCTCCC
AGGCTTTCATCTCGGAGGGGGGGATCATGTCCACCTGCGGGGCGATGAAAAAAA
CGGTTTCCGGGGCGGGGTGATGAGCTGCGAGGATAGCAGGTTTCTCAACAGCT
GGGACTTGCCGCACCCGGTCGGGCCGTAGATGACCCCGATGACGGGTTGCAGGT
GGTAGTTCAAGGAGATGCAGCTGCCGTCGTCCCGGAGGAGGGGGCCACCTCGT
TGAGCATGTCCCTGACTTGGAGGTTTTCCCGGACGAGCTCGCCAAGGAGGCGGT
CCCCGCCCAGCGAGAGCAGCTCTTGCAGGGAAGCAAAGTTTTTCAGGGGCTTGA
GCCCGTCGGCCATGGGCATCTTGGCGAGGGTCTGCGAGAGGAGCTCGAGGCGGT
CCCAGAGCTCGGTGACGTGCTCTACGGCATCTCGATCCAGCAGACTTCCTCGTTT
CGGGGGTTGGGACGACTGCGACTGTAGGGCACGAGACGATGGGCGTCCAGCGCT
GCCAGCGTCATGTCCTTCCAGGGTCTCAGGGTCCGCGTGAGCGTGGTCTCCGTCA
CGGTGAATGGGTGGGCCCCGGGCTGGGCGCTTGCAAGGGTGCGCTTGAGACTCA
TCCTGCTGGTGCTGAAACGGGCACGGTCTTCGCCCTGCGCGTCGGCGAGATAGC
AGTTGACCATGAGCTCGTAGTTGAGTGCCTCGGCGGCGTGGCCCTTGGCGCGGA
GCTTGCCCTTGGAAGAGCGCCCGCAGGCGGGACAGAGGAGGGATTGCAGGGCG
TAGAGCTTGGGTGCAAGAAAGACGGACTCGGGGGCAAAGGCGTCCGCTCCGCA
GTGGGCGCAGACGGTCTCGCACTCCACGAGCCAGGTGAGCTCGGGCCGCTCGGG
GTCAAAAACCAGTTTTCCCCCGTTCTTTTTGATGCGCTTCTTACCTCGCGTCTCCA
TGAGTCTGTGTCCGCGTTCGGTGACAAACAAGCTGTCTGTGTCCCCGTAGACGGA
CTTGATGGGCCTGTCCTGCAAGGGCGTCCCGCGGTCCTCCTCGTAGAGAAACTCG
GACCACTCTGAGACAAAGGCGCGCGTCCACGCCAAGACAAAGGAGGCCACGTG
CGAGGGGTAGCGGTCGTTGTCCACCAGGGGGTCCACCTTTTTCCACGGTATGCAG
ACACATGTCCCCCTCCTCCGCATCCAGGAAGGTGATTGGCTTGTAGGTGTAGGCC
ACGTGACCCGGGGTCCCCGACGGGGGGGTATAAAAGGGGCGGGTCTGTGCTCG
TCCTCACTCTCTTCCGCGTCGCTGTCCACGAGCGCCAGCTGTTGGGGTAGGTATT
CCCTCTCGAGAGCGGGCATGACCTCGGCACTCAGGTTGTCAGTTTCTAGAAACG
AGGAGGATTTGATGTTGGCCTGCCCTGCCGCGATGCTTTTGAGTAGACTTTCATC
CATCTGGTCAGAAAAGACTATTTTTTATTGTCAAGCTTGGTGGCGAAGGAGCCA
TAGAGGGCGTTTGAGAGAAGCTTGGCGATGGATCTCATGGTCTGATTTTTGTCAC
GGTCGGCGCGCTCCTTGGCCGCGATGTTGAGCTGGACATACTCGCGCGCGACAC
ACTTCCATTCGGGGAAGACGGTGGTGCGCTCGTCGGGCACGATCCTGACGCGCC
AGCCGCGGTTATGCAGGGTGACCAGGTCCACACTGGTGGCCACCTCGCTCGGCA
GGGGCTCGTTGGTCCAGCAGAGTCGCCCGCCCTTGCGCGAACAGAACGGGGCA
GCACATCAAGCAGGTGCTCGTCAGGGGGGTCCGCATCGATGGTGAAGATGCCCG
GACAGAGTTCCTTGTCAAAATAGTCTATTTTTGAGGATGCATCATCCAAGGCCAT
CTGCCACTCGCGGGCGGCCAGCGCTCGCTCGTAGGGGTTGAGGGCGGACCCCA
TGGCATGGGATGCGTGAGCGCGGAGGCGTACATGCCGCAGATGTCGTAGACATA

TABLE 7-continued

Nucleic Acid Sequences of Vectors

SEQ ID NO Sequence

GATGGGCTCCGCGAGGATGCCGATGTAGGTGGGATAACAGCGCCCCCCGCGGAT
GCTGGCGCGCACGTAGTCATACAACTCGTGTGAGGGGGCCAAGAAGGCGGGGC
CGAGATTGGTGCGCTGGGGCTGCTCGGCGCGGAAGACGATCTGGCGAAAGATGG
CATGCGAGTTTGAGGAGATGGTGGGCCGTTGGAAGATGTTAAAGTGGGCGTGGG
GCAAGCGGACCGAGTCGCGGATGAAGTGCGCGTAGGAGTCTTGCAGCTTGGCGA
CGAGCTCGGCGGTGACGAGGACGTCCATGGCGCAGTAGTCCAGCGTTTCGCGGA
TGATGTCATAACCCGTCTCTCCTTTCTTCTCCCACAGCTCGCGGTTGAGGGCGTA
CTCCTCGTCATCCTTCCAGTACTCCCGGAGCGGGAATCCTCGATCGTCCGCACGG
TAAGAGCCCAGCATGTAGAAATGGTTCACGGCCTTGTAGGGACAGCAGCCCTTC
TCCACGGGGAGGGCGTAAGCTTGTGCGGCCTTGCGGAGCGAGGTGTGCGTCAGG
GCGAAGGTGTCCCTGACCATGACTTTCAAGAACTGGTACTTGAAATCCGAGTCG
TCGCAGCCGCCGTGCTCCCAGAGCTCGAAATCGGTGCGCTTCTTCGAGAGGGGG
TTAGGCAGAGCGAAAGTGACGTCATTGAAGAGAATCTTGCCTGCCCGCGGCATG
AAATTGCGGGTGATGCGGAAAGGGCCCGGCACGGAGGCTCGGTTGTTGATGACC
TGGGCGGCGAGGACGATCTCGTCGAAGCCGTTGATGTTGTGCCCGACGATGTAG
AGTTCCATGAATCGCGGGCGGCCTTTGATGTGCGGCAGCTTTTTGAGCTCCTCGT
AGGTGAGGTCCTCGGGGCATTGCAGGCCGTGCTGCTCTAGCGCCCACTCCTGGA
GATGTGGGTTGGCTTGCATGAAGGAAGCCCAGAGCTCGCGGGCCATGAGGGTCT
GGAGCTCGTCGCGAAAGAGGCGGAACTGCTGGCCCACGGCCATCTTTTCTGGGG
TGACGCAGTAGAAGGTGAGGGGGTCCCGCTCCCAGCGATCCCAGCGTAAGCGCA
CGGCTAGATCGCGAGCGAGGGCGACCAGCTCTGGGTCCCCGGAGAATTTCATGA
CCAGCATGAAGGGGACGAGCTGCTTGCCGAAGGACCCCATCCAGGTGTAGGTTT
CTACATCGTAGGTGACAAAGAGCCGCTCCGTGCGAGGATGAGAGCCGATTGGGA
AGAACTGGATTTCCTGCCACCAGTTGGACGAGTGGCTGTTGATGTGATGAAAGT
AGAAATCCCTCCGGCGAACCGAGCACTCGTGCTGATGCTTGTAAAAGCGTCCGC
AGTACTCGCAGCGCTGCACGGGCTGTACCTCATCCACGAGATACACAGCGCGTC
CCTTGAGGAGGAACTTCAGGAGTGGCGGCCCTGGCTGGTGGTTTTCATGTTCGCC
TGCGTGGGACTCACCCTGGGGCTCCTCGAGGACGGAGAGGCTGACGAGCCCGCG
CGGGAGCCAGGTCCAGATCTCGGCGCGGCGGGGGCGGAGAGCGAAGACGAGGG
CGCGCAGTTGGGAGCTGTCCATGGTGTCGCGGAGATCCAGGTCCGGGGCAGGG
TTCTGAGGTTGACCTCGTAGAGGCGGGTGAGGGCGTGCTTGAGATGCAGATGGT
ACTTGATCTCCACGGGTGAGTTGGTGGCCGTGTCCACGCATTGCATGAGCCCGTA
GCTGCGCGGGGCCACGACCGTGCCGCGGTGCGCTTTTAGAAGCGGTGTCGCGGA
CGCGCTCCCGGCGGCAGCGGCGGTTCCGGCCCCGCGGGCAGGGGCGGCAGAGG
CACGTCGGCGTGGCGCTCGGGCAGGTCCCGGTGCTGCGCCCTGAGAGCGCTGGC
GTGCGCGACGACGCGGCGGTTGACATCCTGGATCTGTCGCCTCTGCGTGAAGAC
CACGGGCCCCGTGACTTTGAACCTGAAAGACAGTTCAACAGAATCAATCTCGGC
GTCATTGACGGCGGCTTGACGCAGGATCTCTTGCACGTCGCCCGAGTTGTCCTGG
TAGGCGATCTCGGACATGAACTGCTCGATCTCCTCCTCCTGGAGATCGCCGCGGC
CCGCGCGCTCGACGGTGGCGGCGAGGTCATTCGAGATGCGACCCATGAGCTGCG
AGAAGGCGCCCAGGCCGCTCTCGTTCCAGACGCGGCTGTAGACCACGTCCCCGT
CGACGTCGCGCGCGCGCATGACCACCTGCGCGAGGTTGAGCTCCACGTGCCGCG
TGAAGACGCGTAGTTGCGCAGGCGCTGGAAGAGGTAGTTGAGGGTGGTGGCG
ATGTGCTCGGTGACGAAGAAGTACATGATCCAGCGACGCAGGGGCATCTCGCTG
ATGTCGCCGATGGCCTCCAGCCTTTCCATGGCCTCGTAGAAGTCCACGGCGAAGT
TGAAAAACTGGGCGTTGCGGGCCGAGATCGTGAGCTCGTCTTCCAGGAGCCTGA
TGAGTTCGGCGATGGTGGCGCGCACCTCGCGCTCGAAATCCCCGGGGGCCTCCT
CCTCTTCCTCTTCTTCCATGACGACCTCTTCTTCTATTTCCTCCTCTGGGGGCGGT
GGTGGTGGCGGGGCCCGACGACGACGGCGACGCACCGGGAGACGGTCGACGAA
GCGCTCGATCATCTCCCCGCGGCGGCGACGCATGGTTTCGGTGACGGCGCGACC
CCGTTCGCGAGGACGCAGCGTGAAGACGCCGCCGGTCATCTCCCGGTAATGGGG
CGGGTCCCCGTTGGGCAGCGAGAGGGCGCTGACGATGCATCTTATCAATTGCGG
TGTAGGGGACGTGAGCGCGTCGAGATCGACAGGATCGGAGAATCTTTCGAGGAA
AGCGTCTAGCCAATCGCAGTCGCAAGGTAAGCTCAAACACGTAGCAGCCCTGTG
GACGCTGTTAGAATTGCGGTTGCTGATGATGTAATTGAAGTAGGCGTTTTTAAGG
CGGCGGATGGTGGCGAGGAGGACCAGGTCCTTGGGTCCCGCTTGCTGGATGCGG
AGCCGCTCGGCCATGCCCCAGGCCTGGCCCTGACACCGGCTCAGGTTCTTGTAGT
AATCATGCATGAGCCTTTCAATGTCATCACTGGCGGAGGCGGAGTCTTCCATGCG
GGTGACCCCGACGCCCTGAGCGGTTGCACGAGCGCCAGGTCGGCGACGACGCG
CTCGGCGAGGATGGCCTGTTGCACGCGGGTGAGGGTGTCCTGAAAGTCGTCCAT
GTCGACGAAGCGGTGGTAGGCCCCGGTGTTGATGGTGTAGGTGCAGTTGGCCAT
GAGCGACCAGTTGACGGTCTGCAGGCCGGGCTGCACGACCTCGGAGTACCTGAG
CCGCGAGAAGGCGCGCAGTCGAAGACGTAGTCGTTGCAGGTGCGCACGAGGT
ACTGGTAGCCGACTAGGAAGTGCGGCGGCGGCTGGCGGTAGAGCGGCCAGCGC
TGGGTGCCGGCGCGCCCGGGGCCAGGTCCTCGAGCATGAGGCGGTGGTAGCCG
TAGAGGTAGCGGGACATCCAGGTGATTCCGGCGGCGGTGGTGGAGGCGCGCGG
GAACTCGCGGACGCGGTTCCAGATGTTGCGCAGCGGCAGGAAATAGTCCATGGT
CGGCACGGTCTGGCCGGTGAGACGCGCGCAGTCATTGACGCTCTAGAGGCAAAA
ACGAAAGCGGTTGAGCGGGCTCTTCCTCCGTAGCCTGGCGGAACGCAAACGGGT
TAGGCCGCGTGTGTACCCCGGTTCGAGTCCCCTCGAATCAGGCTGGAGCCGCGA
CTAACGTGGTATTGGCACTCCCGTCTCGACCCGAGCCCGATAGCCGCCAGGATA
CGGCGGAGAGCCCTTTTTGCCGGCCGAGGGGGGTCGCTAGACTTGAAAGCGGCC
GAAAACCCTGCCGGGTAGTGGCTCGCGCCCGTAGTCTGGAGAAGCATCGCCAGG
GTTGAGTCGCGGCAGAACCCGGTTCGAGGACGGCCGCGGCGAGCGGGACTTGGT
CACCCCGCCGATTTAAAGACCCACAGCCAGCCGACTTCTCCAGTTACGGGAGCG
AGCCCCCTTTTTTCTTTTTGCCAGATGCATCCCGTCCTGCGCCAAATGCGTCCCAC

TABLE 7-continued

Nucleic Acid Sequences of Vectors

| SEQ ID NO | Sequence |
|---|---|
| | CCCCCCGGCGACCACCGCGACCGCGGCCGTAGCAGGCGCCGGCGCTAGCCAGCC |
| | ACAGACAGAGATGGACTTGGAAGAGGGCGAAGGGCTGGCGAGACTGGGGGCGC |
| | CGTCCCCGGAGCGACATCCCCGCGTGCAGCTGCAGAAGGACGTGCGCCCGGCGT |
| | ACGTGCCTGCGCAGAACCTGTTCAGGGACCGCAGCGGGGAGGAGCCCGAGGAG |
| | ATGCGCGACTGCCGGTTTCGGGCGGGCAGGGAGCTGCGCGAGGGCCTGGACCGC |
| | CAGCGCGTGCTGCGCGACGAGGATTTCGAGCCGAACGAGCAGACGGGGATCAG |
| | CCCCGCGCGCGCACGTGGCGGCGGCCAACCTGGTGACGGCCTACGAGCAGAC |
| | GGTGAAGCAGGAGCGCAACTTCCAAAAGAGTTTCAACAACCACGTGCGCACCCT |
| | GATCGCGCGCGAGGAGGTGGCCCTGGGCCTGATGCACCTGTGGGACCTGGCGGA |
| | GGCCATCGTGCAGAACCCGGACAGCAAGCCTCTGACGGCGCAGCTGTTCCTGGT |
| | GGTGCAGCACAGCAGGGACAACGAGGCGTTCAGGGAGGCGCTGCTAAACATCG |
| | CCGAGCCCGAGGGCCGCTGGCTGCTGGAGCTGATCAACATCTTGCAAAGCATCG |
| | TAGTGCAGGAGCGCAGCCTGAGCTTGGCCGAGAAGGTGGCGGCGATCAATTACT |
| | CGGTGCTAAGCCTGGGCAAGTTTTACGCGCGCAAGATTTACAAGACGCCGTACG |
| | TGCCCATAGACAAGGAGGTGAAAATAGACAGCTTTTACATGCGCATGGCGCTCA |
| | AGGTGCTGACGCTGAGCGACGACCTGGGCGTGTACCGCAACGACCGCATCCACA |
| | AGGCCGTAAGCACGAGCCGGCGGCGCGAGCTGAGCGACCGCGAGCTGATGCTA |
| | AGCCTGCGCCGGGCGCTGGTAGGGGGCGCCGCCGGCGGCGAGGAGTCCTACTTC |
| | GACATGGGGGCGGACCTGCATTGGCAGCCGAGCCGGCGCGCCTTGGAGGCCGCC |
| | TACGGTCCAGAGGACTTGGATGAGGATGAGGAAGAGGAGGAGGATGCACCCGT |
| | TGCGGGGTACTGACGCCTCCGTGATGTGTTTTAGATGCAGCAAACCCCGGACCC |
| | CGCCATAAGGGCGGCGCTGCAAAGCCAGCCGTCCGGTCTAGCATCGGACGACTG |
| | GGAGGCCGCGATGCAACGCATCATGGCCCTGACGACCCGCAACCCCGAGTCCTT |
| | TAGACAACAGCCGCAGGCCAACAGACTCTCGGCCATTCTGGAGGCGGTGGTCCC |
| | CTCTCGGACCAACCCCACGCACGAGAAGGTGCTGGCGATCGTGAACGCGCTGGC |
| | GGAGAACAAGGCCATCCGTCCCGACGAGGCCGGGCTGGTGTACAACGCCCTGCT |
| | GGAGCGCGTGGGCCGATACAACAGCACGAACGTGCAGTCCAACCTGGACCGGCT |
| | GGTGACGGACGTGCGCGAGGCCGTGGCGCAGCGCGAGCGGTTCAAGAACGAGG |
| | GCTTGGGCTCGCTGGTGGCGCTGAATGCCTTCCTGGCGACGCAGCCGGCGAACG |
| | TGCCGCGCGGGCAGGACGATTACACCAACTTTATCAGCGCGCTGCGGCTGATGG |
| | TGACCGAGGTGCCCCAGAGCGAGGTGTACCAGTCTGGCCCGGACTACTTTTTCC |
| | AGACGAGCCGGCAGGGCTTGCAGACGGTGAACCTGAGCCAGGCTTTCAAGAACC |
| | TGCGCGGGCTGTGGGGCGTGCAGGCGCCCGTGGGCGACCGGTCGACGGTGAGCA |
| | GCTTGCTGACGCCCAACTCGCGGCTGCTGCTGCTGATCGCGCCCTTCACCGA |
| | CAGCGGCAGCGTGAACCGCAACTCGTACCTGGGCCACCTGCTGACGCTGTACCG |
| | CGAGGCCATAGGCCAGGCGCAGGTGGACGAGCAGACCTTCCAGGAGATCACGA |
| | GCGTGAGTCGCGCGCTGGGTCAGAACGACACCGACAGTCTGAGGGCCACCCTGA |
| | ACTTCTTGCTGACCAATAGACAGCAGAAGATCCCGGCGCAGTCGCGCTGTCGG |
| | CCGAGGAGGAAAGGATCCTGAGATATGTGCAGCAGAGCGTAGGGCTGTTCCTGA |
| | TGCAGGAGGGCGCCACCCCCAGCGCCGCGCTGGACATGACCGCGCGCAACATGG |
| | AACCTAGCATGTACGCCGCCAACCGGCCGTTCATCAATAAGCTGATGGACTACC |
| | TGCACCGCGCGGCGTCCATGAACACGGACTACTTTACTAATGCTATACTAAACCC |
| | GCACTGGCTCCCGCCGCGGGGTTCTACACGGGCGAGTACGACATGCCTGACCC |
| | CAACGACGGGTTTTTGTGGGACGACGTGGACAGCGCGGTGTTCTCACCGACCTT |
| | GCAAAAGCGCCAGGAGGCGGTGCGCACGCCCGCAAGCGAGGGCGCGGTGGGTC |
| | GGAGCCCCTTTCCTAGCTTAGGGAGTTTGCATAGCTTGCCGGGCTCGGTGAACAG |
| | CGGCAGGGTGAGCCGGCCGCGCTTGCTGGGCGAGGACGAGTACCTGAACGACTC |
| | GCTGCTGCAGCCGCCGCGGGTCAAGAACGCCATGGCCAATAACGGGATAGAGA |
| | GTCTGGTGGACAAACTGAACCGCTGGAAGACCTACGCTCAGGACCATAGGGAGC |
| | CTGCGCCCGCGCCGCGGCGACAGCGCCACGACCGGCAGCGGGGCCTGGTGTGGG |
| | ACGACGAGGATTCGGCCGACGATAGCAGCGTGTTGGACTTGGGCGGGAGCGGTG |
| | GGGTCAACCCGTTCGCGCATCTGCAGCCCAAACTGGGGCGACGGATGTTTTGAA |
| | TGCAAAATAAAACTCACCAAGGCCATAGCGTGCGTTCTCTTCCTTGTTAGAGATG |
| | AGGCGTGCGGTGGTGTCTTCCTCTCCTCCTCCCTCGTACGAGAGCGTGATGGCGC |
| | AGGCGACCCTGGAGGTTCCGTTTGTGCCTCCGCGGTATATGGCTCCTACGGAGG |
| | GCAGAAACAGCATTCGTTACTCAGAGCTGGCTCCGCTGTACGACACCACTCGCG |
| | TGTACTTGGTGGACAACAAGTCGGCGGACATCGCTTCCCTGAACTACCAAAACG |
| | ACCACAGCAACTTCCTGACCACGGTGGTGCAGAACAACGATTTCACCCCCGCCG |
| | AGGCTAGCACGCAGACGATAAATTTTGACGAGCGGTCGCGGTGGGGCGGTGATC |
| | TGAAGACCATTCTGCACACCAACATGCCCAATGTGAACGAGTACATGTTTACCA |
| | GCAAGTTTAAGGCGCGGGTGATGGTGTCTAGGAAGCGGCCAGAGGGGCGACA |
| | GATGCAAGTCAGGATATCTTAAAGTATGAGTGGTTTGAGTTTACCCTTCCCGAGG |
| | GCAACTTTTCCGAGACCATGACCATAGACCTGATGAACAACGCCATCTTGGAAA |
| | ACTACTTGCAAGTGGGCGGCAGAATGGCGTGCTGGAGAGCGATATCGGAGTCA |
| | AGTTTGACAGCAGGAATTTCAAGCTGGGCTGGGACCCGGTGACCAAGCTGGTGA |
| | TGCCAGGGGTCTACACCTACGAGGCCTTCCACCCGGACGTGGTGCTGCTGCCGG |
| | GCTGCGGGGTGGACTTCACCGAGAGCCGCCTGAGCAACCTCCTGGGCATTCGCA |
| | AGAAGCAACCTTTCCAAGAGGGCTTCAGAATCATGTATGAGGATCTAGAAGGGG |
| | GCAACATCCCCGCTCTGCTTGATGTGGAAGCATACCTCAACAGCAAGAATGATA |
| | AGGAGGAGGCTACCAAGAATGCAAACAGAGCTGCTGACAATGGAGGTGGTGAA |
| | ACTAGGGGAGATACTTTCTCACCACCGAACAGCTAAGAGCTGCTGGCAAGGAG |
| | CTGGTTATTAAGCCCATCAAGGAAGATGCTAGCAAGAGGAGCTATAATGTCATA |
| | GATGGCACCCATGACACCCTGTACCGAAGCTGGTACCTGTCCTATACCTACGGG |
| | GACCCCGAGAAGGGGGTGCAGTCGTGGACGCTGCTCACCACCCCGGACGTCACC |
| | TGCGGCGCGAGCAAGTCTACTGGTCGCTGCCGGACCTCATGCAAGACCCCGTC |
| | ACCTTCCGCTCTACCCAGCAAGTCAGCAACTACCCCGTGGTCGGCGCCGAGCTC |

TABLE 7-continued

Nucleic Acid Sequences of Vectors

SEQ ID NO Sequence

ATGCCCTTCCGCGCCAAGAGCTTTTACAACGACCTCGCCGTCTACTCCCAGCTCA
TCCGCAGCTACACCTCCCTCACCCACGTCTTCAACCGCTTCCCCGACAACCAGAT
CCTCTGCCGCCCGCCCGCGCCCACCATCACCACCGTTAGTGAAAACGTGCCTGCT
CTCACAGATCACGGGACGCTACCGCTGCGCAGCAGTATCCGCGGAGTCCAGCGA
GTGACCGTCACTGACGCCCGTCGCCGCACCTGTCCCTACGTCTACAAGGCCCTGG
GCATAGTCGCGCCGCGCGTGCTTTCCAGTCGCACCTTCTAAAAAATGTCTATTCT
CATCTCGCCCAGCAATAACACCGGCTGGGGTATTACTAGGCCCAGCACCATGTA
CGGAGGAGCCAAGAAGCGCTCCCAGCAGCACCCCGTCCGCGTCCGCGGCCACTT
CCGCGCTCCCTGGGGCGCTTACAAGCGCGGGCGGACTTCCACCGCCGTGCGCAC
CACCGTTGACGACGTCATCGACTCGGTGGTCGCCGACGCGCGCAACTACACCCC
CGCCCCCTCCACCGTGGACGCGGTCATCGACAGCGTGGTGGCCGACGCGCGCGA
CTATGCCAGACGCAAGAGCCGGCGGCGACGGATTGCCAGGCGCCACCGGAGCA
CGCCCGCCATGCGCGCCGCTCGGGCTCTGCTGCGCCGCGCCAGACGCACGGGCC
GCCGGGCCATGATGCGAGCCGCGCGCCGCGCTGCCGCTGCACCCACCCCCGCAG
GCAGGACTCGCAGACGAGCGGCCGCCGCCGCCGCCGCGGCCATTTCTAGCATGA
CCAGACCCAGGCGCGGAAACGTGTACTGGGTGCGCGACTCCGTCACGGGCGTGC
GCGTGCCCGTGCGCACCCGTCCTCCTCGTCCCTGATCTAATGCTTGTGTCCTCCCC
CGCAAGCGACGATGTCAAAGCGCAAAATCAAGGAGGAGATGCTCCAGGTCGTC
GCCCCGGAGATTTACGGACCACCCCAGGCGGACCAGAAACCCCGCAAAATCAA
GCGGGTTAAAAAAAAGGATGAGGTGGACGAGGGGGCAGTAGAGTTTGTGCGCG
AGTTCGCTCCGCGGCGGCGCGTAAATTGGAAGGGGCGCAGGGTGCAGCGCGTGT
TGCGGCCCGGCACGGCGGTGGTGTTCACGCCCGGCGAGCGGTCCTCGGTCAGGA
GCAAGCGTAGCTATGACGAGGTGTACGGCGACGACGACATCCTGGACCAGGCG
GCGGAGCGGGCGGGCGAGTTCGCCTACGGGAAGCGGTCGCGCGAAGAGGAGCT
GATCTCGCTGCCGCTGGACGAAAGCAACCCCACGCCGAGCCTGAAGCCCGTGAC
CCTGCAGCAGGTGCTGCCCCAGGCGGTGCTGCTGCCGAGCCGCGGGGTCAAGCG
CGAGGGCGAGAGCATGTACCCGACCATGCAGATCATGGTGCCCAAGCGCCGGCG
CGTGGAGGACGTGCTGGACACCGTGAAAATGGATGTGGAGCCCGAGGTCAAGG
TGCGCCCCATCAAGCAGGTGGCGCCGGGCCTGGGCGTGCAGACCGTGGACATTC
AGATCCCCACCGACATGGATGTCGACAAAAAACCCTCGACCAGCATCGAGGTGC
AGACCGATCCCTGGCTCCCAGCCTCCACCGCTACCGTCTCCACTTCTACCGCCGC
CACGGCTACCGAGCCTCCCAGGAGGCGAAGATGGGGCGCCGCCAGCCGGCTGAT
GCCCAACTACGTGTTGCATCCTTCCATCATCCCGACGCCTGGCTACCGCGGCACC
CGGTATTACGCCAGCCGCAGGCGCCCAGCCAGCAAACGCCGCCGCCGCACCGCC
ACCCGCCGCCGTCTGGCCCCCGCCCGCGTGCGCCGCGTAACCACGCGCCGGGGC
CGCTCGCTCGTTCTGCCCACCGTGCGCTACCACCCCAGCATCCTTTAATTCGTGT
GCTGTGATACTGTTGCAGAGAGATGGCTCTCACTTGCCGCCTGCGCATCCCCGTC
CCGAATTACCGAGGAAGATCCCGCCGCAGGAGAGGCATGGCAGGCAGCGGCCT
GAACCGCCGCCGGCGGCGGGCCATGCGCAGGCGCCTGAGTGGCGGCTTTCTGCC
CGCGCTCATACCCATAATCGCCGCGGCCATCGGCACGATCCCGGGCATAGCTTC
CGTTGCGCTGCAGGCGTCGCAGCGCCGTTGATGTGCGAATAAAGCCTCTTTAGA
CTCTGACACACCTGGTCCTGTATATTTTTAGAATGGAAGACATCAATTTTGCGTC
CCTGGCTCCGCGGCACGGCACGCGGCCGTTCATGGGCACCTGGAACGAGATCGG
CACCAGCCAGCTGAACGGGGGCGCCTTCAATTGGAGCAGTGTCTGGAGCGGGCT
TAAAAATTTCGGCTCGACGCTCCGGACCTATGGGAACAAGGCCTGGAATAGTAG
CACGGGGCAGTTGCTAAGGGAAAAGCTCAAAGACCAGAACTTTCAGCAGAAGG
TGGTGGACGGGCTGGCCTCGGGCATTAACGGGGTGGTGGACATCGCGAACCAGG
CCGTGCAGCGCGAGATAAACAGCCGCCTGGACCCGCGGCCGCCCACGGTGGTGG
AGATGGAAGATGCAACTCCTCCGCCGCCCAAGGGCGAGAAGCGGCCGCGGCCC
GACGCGGAGGAGACGATCCTGCAGGTGGACGAGCCGCCCTCGTACGAGGAGGC
CGTGAAGGCCGGCATGCCCACCACGCGCATCATCGCGCCGCTGGCCACGGGTGT
AATGAAACCCGCCACCCTTGACCTGCCTCCACCACCCACGCCCGCTCCACCGAA
GGCAGCTCCGGTTGTGCAGGCCCCCCGGTGGCGACCGCCGTGCGCCGCGTCCC
CGCCCGCCGCCAGGCCCAGAACTGGCAGAGCACGCTGCACAGTATCGTGGGCCT
GGGAGTGAAAAGTCTGAAGCGCCGCCGATGCTATTGAGAGAGAGGAAAGAGGA
CACTAAAGGGAGAGCTTAACTTGTATGTGCCTTACCGCCAGAGAACGCGCGAAG
ATGGCCACCCCTCGATGATGCCGCAGTGGGCGTACATGCACATCGCCGGGCAG
GACGCCTCGGAGTACCTGAGCCCGGGTCTGGTGCAGTTTGCCCGCGCCACCGAC
ACGTACTTCAGCCTGGGCAACAAGTTTAGGAACCCCACGGTGGCCCCGACCCAC
GATGTGACCACGGACCGGTCCCAGCGTCTGACGCTGCGCTTCGTGCCCGTGGAT
CGCGAGGACACCACGTACTCGTACAAGGCGCGCTTCACTCTGGCCGTGGGCGAC
AACCGGGTGCTAGACATGGCCAGCACTTACTTTGACATCCGCGGCGTCCTGGAC
CGCGGTCCCAGCTTCAAACCCTACTCGGGCACGGCTTACAACAGTCTGGCCCCC
AAGGGCGCCCCAATCCCAGTCAGTGGGAAGAGAAAAAGAATGGAGGAGGAAG
CGATGCTAATCAAATGCAAACTCACACGTTTGGAGTTGCTGCCATGGGTGGCATT
GAAATTACAGCTAAGGGTCTTCAAATTGGCATTGATGCAACCAAAGAGGAAGAT
AATGGAAAGGAAATATATGCCGACAAAACATTCCAGCCAGAGCCTCAAATAGG
AGAAGAAACTGGCAGGATAGTGATAATTACTATGGAGGCAGAGCCATCAAGA
AAGAAACCAAGATGAAGCCATGCTATGGCTCATTTGCCAGACCTACCAATGAAA
AAGGCGGCCAGGCTAAATTCAAACACCTGAAAAAGAAGGTGAAGAACCCAAA
GAACTTGACATAGATTTGAATTTCTTTGATATTCCCAGTACTGGCACAGGTGGTA
ATGGAACAAATGTTAATTTCAAACCAGACATGATAATGTATGCAGAAAATGTGA
ACTTGGAAACCCCAGACACTCATATTGTATACAAGCCAGGCAAGGAAGATGCAA
GTTCTGAATCTAACCTCACACAACAGTCCATGCCCAACAGACCCAACTACATTG
GATTTAGGGACAACTTTGTAGGGCTCATGTACTACAACAGCACTGGCAACATGG
GTGTGCTGGCTGGTCAGGCATCTCAGTTGAATGCTGTGGTCGACTTGCAAGACA

TABLE 7-continued

Nucleic Acid Sequences of Vectors

SEQ ID NO Sequence

GAAACACCGAGCTGTCTTACCAGCTATTGCTAGATTCTCTGGGTGACAGAACCA
GATACTTTAGTATGTGGAACTCTGCGGTGGACAGTTACGATCCCGATGTCAGGAT
CATTGAGAATCACGGTGTGGAAGATGAACTTCCCAACTATTGCTTCCCCTTGGAT
GGCGCTGGAACTAACGCAGTGTACCAAGGTGTAAAAGTTAAAACTACTAACAAT
ACAGAATGGGAAAAAGACACTGCAGTATCTGAACACAATCAGATATGCAAAGG
CAACGTGTATGCCATGGAGATCAACCTCCAGGCCAACCTGTGGAAGAGTTTTCT
GTACTCGAACGTGGCCCTGTACCTGCCCGACTCCTACAAGTACACGCCGGCCAA
CGTCACGCTGCCCACCAACACCAACACCTACGAGTACATGAACGGCCGCGTGGT
AGCCCCCTCGCTGGTGGACGCTTACATCAACATTGGCGCCCGCTGGTCGCTGGAC
CCCATGGACAACGTCAACCCATTCAACCACCACCGCAACGCGGGCCTGCGCTAC
CGTTCCATGCTTCTGGGCAACGGCCGCTACGTGCCCTTCCACATCCAAGTGCCCC
AAAAGTTCTTTGCCATCAAGAACCTGCTCCTGCTCCCGGGCTCCTACACCTACGA
GTGGAACTTCCGCAAGGACGTCAACATGATCCTGCAGAGTTCCCTCGGAAACGA
CCTGCGCGTCGACGGCGCCTCCGTCCGCTTCGACAGCGTCAACCTCTACGCCACC
TTCTTCCCCATGGCGCACAACACCGCCTCCACCCTGGAAGCCATGCTGCGCAACG
ACACCAACGACCAGTCTTTCAACGACTACCTCTCGGCCGCCAACATGCTCTACCC
CATCCCGGCCAAGGCCACCAACGTGCCCATTTCCATCCCCTCGCGCAACTGGGCC
GCCTTCCGCGGCTGGAGTTTCACTCGTCTGAAAACCAAGGAAACTCCCTCCCTCG
GCTCGGGTTTCGACCCCTACTTTGTCTACTCGGGCTCCATCCCCTACCTCGACGG
GACCTTCTACCTCAACCACACCTTCAAGAAGGTCTCCATCATGTTCGACTCCTCG
GTCAGCTGGCCCGGCAACGACCGGCTGCTCACGCCGAACGAGTTCGAGATCAAG
CGCAGCGTCGACGGGGAGGGCTACAACGTGGCCCAATGCAACATGACCAAGGA
CTGGTTCCTCGTCCAGATGCTCTCTCATTACAACATCGGCTACCAGGGCTTCCAC
GTGCCCGAGGGCTACAAGGACCGCATGTACTCCTTCTTCCGCAACTTCCAGCCCA
TGAGCAGGCAGGTGGTCGATGAGATCAACTACAAGGACTACAAGGCCGTCACCC
TGCCCTTCCAGCACAACAACTCGGGCTTCACCGGCTACCTCGCACCCACCATGCG
CCAGGGGCAGCCCTACCCCGCCAACTTCCCCTACCCGCTCATCGGCCAGACAGC
CGTGCCCTCCGTCACCCAGAAAAAGTTCCTCTGCGACAGGGTCATGTGGCGCAT
CCCCTTCTCCAGCAACTTCATGTCCATGGGCGCCCTCACCGACCTGGGTCAGAAC
ATGCTCTACGCCAACTCGGCCCACGCGCTCGACATGACCTTCGAGGTGGACCCC
ATGGATGAGCCCACCCTCCTCTATCTTCTCTTCGAAGTTTTCGACGTGGTCAGAG
TGCACCAGCCGCACCGCGGCGTCATCGAGGCCGTCTACCTGCGCACGCCCTTCTC
CGCCGGCAACGCCACCACCTAAGCATGAGCGGCTCCAGCGAACGAGAGCTCGCG
GCCATCGTGCGCGACCTGGGCTGCGGGCCCTACTTTTTGGGCACCCACGACAAG
CGCTTCCCGGGCTTCCTCGCCGGCGACAAGCTGGCCTGCGCCATCGTCAACACG
GCCGGCCGCGAGACCGGAGGCGTGCACTGGCTCGCCTTTGGCTGGAACCCGCGC
TCGCGCACCTGCTACATGTTCGACCCCTTTGGGTTCTCGGACCGCCGGCTGAAGC
AGATTTACAGCTTCGAGTACGAGGCCATGCTGCGCCGCAGCGCCCTGGCCTCCTC
GCCCGACCGCTGTCTCAGCCTCGAGCAGTCCACCCAGACCGTGCAGGGGCCTGA
CTCTGCCGCCTGCGGACTTTTTTGTTGCATGTTCTTGCATGCCTTCGTGCACTGGC
CCGACCGACCCATGGACGGAAACCCCACCATGAACTTGCTGACGGGGTACCCA
ACGGCATGCTACAATCGCCACAGGTGCTACCCACCCTCCGGCGCAACCAGGAGG
AGCTCTACCGCTTCCTCGCGCGCCACTCCCCTTACTTTCGATCCCACCGCGCCGC
CATCGAACACGCCACCGCTTTTGATAAAATGAAACAACTGCGTGTATCTCAATA
AACAGCACTTTTATTTTACATGCACTGGAGTATATGCAAGTTATTTAAAAGTCGA
AGGGGTTCTCGCGCTCGTCGTTGTGCGCCGCGCTGGGAGGGCCCACGTTGCGGT
ACTGGTACTTTGGGCTGCCACTTGAATTCGGGGATCACCAGTTTGGGCACTGGAAT
CTCGGGGAAGGTCTCGCTCCACATGCGCCGGCTCATCTGCAGGGCGCCCAGCAT
GTCGGGCGCGGAGATCTTGAAATCGCAGTTGGGACCGGTGCTCTGCGCGCGCGA
GTTGCGGTACAGGGGTTGCAGCACTGGAACACCATCAGACTGGGGTGCTTCAC
ACTGGCCAGCACGCTCTTGTCGCTGATCTGATCCTTGTCCAGGTCCTCGGCGTTG
CTCAGGCCGAACGGGGTCATCTTGCACAGCTGGCGGCCCAGGAAGGGCACGCTC
TGAGGCTTGTGATTACACTCGCAGTGCACGGGCATCAGCATCATCCCCGCGCCG
CGCTGCATATTCGGGTAGAGGGCCTTGACGAAGGCCGAGATCTGCTTGAAAGCT
TGCTGGGCCTTGGCCCCCTCGCTGAAAAACAGCCCGCAGCTCTTCCCGCTGAACT
GGTTATTCCCGCAACCGGCATCTTGGACGCAGCAGCGCGCGTCATGGCTGGTCA
GTTGCACCACGCTCCGTCCCCAGCGGTTCTGGGTTACCTTGGCCTTGCTGGGTTG
CTCCTTCAACGCGCGCTGCCCGTTCTCGCTGGTCACATCCATCTCCACCACGTGG
TCCTTGTGGATCATCACCGTTCCATGCAGACACTTGAGCTGGCCTTCCACCTCGG
TACAGCCGTGATCCCACAGGGCACTGCCGGTGCACTCCCAGTTCTTGTGCGCGAT
CCCGCTGTGGCTGAAGATGTAACCTTGCAACAGGCGGCCCATGATGGTGCTAAA
GCTCTTCTGGGTGGTGAAGGTCAGTTGCAGACCGCGGGCCTCCTCGTTCATCCAG
GTCTGGCACATCTTCTGGAAGATCTCGGTCTGCTCGGGCATGAGCTTGTAAGCAT
CGCGCAGGCCGCTGTCGACGCGGTAGCGTTCCATCAGCACGTTCATGGTATCCAT
GCCCTTCTCCCAGGACGAGACCAGAGGCAGACTCAGGGGTTGCGCACGTTCAG
GACACCGGGGTCGCGGCTCGACGATGCGTTTTCCGTCCTTGCCTTCCTTCAAC
AGAACCGGCGGCTGGCTGAATCCCACTCCCACGATCACGGCTTCTTCCTGGGGC
ATCTCTTCGTCGGGGTCTACCTTGGTCACATGCTTGGTCTTTCTGGCTTGCTTCTT
TTTTAAAGGGCTGTCCACGGGGACCACGTCCTCCTCGGAAGACCCGGAGCCCAC
CCGCTGATACTTTCGGCGCTTGGTGGGCAGAGGAGGTGGCGGCGGCGAGGGGCT
CCTCTCCTGCTCCGGCGGATAGCGCGCGACCCGTGGCCCCGGGCGGAGTGGC
CTCTCGCTCCATGAACCGGCGCACGTCCTGACTGCCGCCGGCCATTGTTTCCTAG
GGGAAGATGGAGGAGCAGCCGCGTAAGCAGGAGCAGGAGGAGGACTTAACCAC
CCACGAGCAACCCAAAATCGAGCAGGACCTGGGCTTCGAAGAGCCGGTCGTCT
AGAACCCCCACAGGATGAACAGGAGCACGAGCAAGACGCAGGCCAGGAGGAGA
CCGACGCTGGGCTCGAGCATGGCTACCTGGGAGGAGAGGAGGATGTGCTGCTGA

TABLE 7-continued

Nucleic Acid Sequences of Vectors

SEQ ID NO Sequence

AACACCTGCAGCGCCAGTCCCTCATCCTCCGGGACGCCCTAGCCGACCGGAGCG
AAACCCCCTCAGCGTCGAGGAGCTGTGTCGGGCCTACGAGCTCAACCTCTTCTC
GCCGCGCGTGCCCCCCAAACGCCAGCCCAACGGCACATGCGAGCCCAACCCGCG
TCTCAACTTCTATCCCGTCTTTGCGGTCCCCGAGGCCCTGGCCACCTATCACATCT
TTTTCAAGAACCAAAAGATCCCCGTCTCCTGCCGCGCCAACCGCACCCGCGCCG
ACGCGCTCCTCGCTCTGGGGCCCGGCGCGCGCATACCTGATATCGCTTCCCTGGA
AGAGGTGCCCAAGATCTTCGAAGGGCTCGGTCGGGACGAGACGCGCGCGGCGA
ACGCTCTGAAAGAAACAGCAGAGGAAGAGGGTCACACTAGCGCCCTGGTAGAG
TTGGAAGGCGACAACGCCAGGCTGGCCGTGCTCAAGCGCAGCGTCGAGCTCACC
CACTTCGCCTACCCCGCCGTCAACCTCCCGCCCAAGGTCATGCGTCGCATCATGG
ATCAGCTCATTATGCCCCACATCGAGGCCCTCGATGAAAGTCAGGAGCAGCGGC
CCGAGGACGCCCGGCCCGTGGTCAGCGACGAGATGCTCGCGCGCTGGCTCGGGA
CCCGCGACCCCCAGGCTTTGGAACAGCGGCGCAAGCTGATGCTGGCCGTGGTCC
TGGTCACCCTCGAGCTCGAATGCATGCGCCGCTTCTTCAGCGACCCCGAGACCCT
GCGCAAGGTCGAGGAGACCCTGCACTACACTTTCAGACACGGTTTCGTCAGGCA
GGCCTGCAAGATCTCCAACGTGGAGCTGACCAACCTGGTCTCCTGCCTGGGGAT
CCTGCACGAGAACCGCCTGGGGCAGACCGTGCTCCACTCCACCCTGAAGGGCGA
GGCGCGTCGGGACTATGTCCGCGACTGCGTCTTTCTCTTTCTCTGCCACACCTGG
CAGTCGGCCATGGGCGTGTGGCAGCAGTGTCTCGAGGACGAGAACCTGAAGGA
GCTGGACAAGCTTCTTGCTAGAAACCTTAAAAAGCTGTGGACGGGCTTCGACGA
GCGCACCGTCGCCTCGGACCTGGCCGAGATCGTCTTCCCCGAGCGCCTGAGGCA
GACGCTGAAAGGCGGGCTGCCCGACTTCATGAGCCAGAGCATGTTGCAAAATTA
CCGCACTTTCATTCTCGAGCGATCTGGGATGCTGCCCGCCACCTGCAACGCCTTT
CCCTCCGACTTTGTCCCGCTGAGCTACCGCGAGTGTCCCCCGCCGCTGTGGAGCC
ACTGCTACCTCTTGCAGCTGGCCAACTACATCGCCTACCACTCGGACGTGATCGA
GGACGTGAGCGGCGAGGGGCTGCTCGAGTGCCACTGCCGATGCAACCTGTGCTC
CCCGCACCGCTCCCTGGTCTGTAACCCCCAGCTCCTGAGCGAAACCCAGGTCATC
GGTACCTTCGAGCTGCAAGGTCCGCAGGAGTCCACCGCTCCGCTGAAACTCACG
CCGGGGGTTGTGGACTTCTGCGTACCTGCGCAAATTTGTACCCGAGGACTACCACG
CCCACGAGATAAAGTTCTTCGAGGACCAATCGCGCCCGCAGCACGCGGATCTCA
CGGCCTGCGTCATCACCCAGGGCGCGATCCTCGCCCAATTGCACGCCATCCAAA
AATCCCGCCAAGAGTTTCTTCTGAAAAAGGGTAGAGGGGTCTACCTGGACCCCC
AGACGGGCGAGGTGCTCAATCCGGGTCTCCCCCAGCATGCCGAGGAAGAAGCCG
ATAGTGGAGGAGGAGATGAAGAAGAATGGGACAGCCAGGCAGGAGGAGGAGG
ACGAATGGGAGGAGGAGACAGAGGAGGAAGAATTGGAAGAGGTGGAAGAGGA
GCAGGCAACAGAGCAGCCCGTCGCCGCACCATCCGCGCCGGCAGCCCCGGCGGT
CACGGATACAACCTCCGCAGCACCTCCGGCCAAGCCTCCTCGTAGATGGGATCG
AGTGAAGGGTGACGGTAAGCACGAGCGGCAGGGCTACCGGTCATGGAGGGCCC
ACAAAGCCGCGATCATCGCCTGCTTGCAAGACTGCGGGGGGAACATCGCTTTCG
CCCGCCGCTACCTGCTCTTCCACCGCGGGGTGAACATCCCCCGCAACGTGTTGCA
TTACTACCGTCACCTTCACAGCTAAGAAAAAGCCAGTAAGAGGAGTCGCCGGAG
GAGGAGGCCTGAGGATCGCGGCGAACGAGCCCTCGACCACCAGGGAGCTGAGG
AACCGGATCTTCCCCACTCTTTATGCCATTTTTTCAGCAGAGTCGAGGTCAGCAGC
AAGAGCTCAAAGTAAAAAATCGGTCTCTGCGCTCGCTCACCCGCAGTTGCTTGT
ACCACAAAAACGAAGATCAGCTGCAGCGCACTCTCGAAGACGCCGAGGCTCTGT
TCCACAAGTACTGCGCGCTCACTCTTAAAGACTAAGGCGCGCCACCCGGAAAA
AAGGCGGGAATTACCTCATCGCCACCATCATGAGCAAGGAGATTCCCACCCCTT
ACATGTGGAGCTATCAGCCCCAGATGGGCCTGGCCGCGGGCGCCTCCCAGGACT
ACTCCACCCGCATGAACTGGCTAAGTGCCGGCCCCTCGATGATCTCACGGGTCA
ACGGGGTCCGTAACCATCGAAACCAGATATTGTTGGAGCAGGCGGCGGTCACAT
CCACGCCCAGGGCAAAGCTCAACCCGCGTAATTGGCCCTCCACCCTGGTGTATC
AGGAAATCCCCGGGCCGACTACCGTACTACTTCCGCGTGACGCACTGGCCGAAG
TCCGCATGACTAACTCAGGTGTCCAGCTGGCCGGCGGCGCTTCCCGGTGCCCGCT
CCGCCCACAATGGGTATAAAAACCCTGGTGATCCGAGGCAGAGGCACACAGCT
CAACGACGAGTTGGTGAGCTCTTCGATCGGTCTGCGACCGGACGGAGTGTTCCA
ACTAGCCGGAGCCGGGAGATCCTCCTTCACTCCCAACCAGGCCTACCTGACCTTG
CAGAGCAGCTCTTCGGAGCCTCGCTCCGGAGGCATCGGAACCCTCCAGTTCGTG
GAGGAGTTTGTGCCCTCGGTCTACTTCAACCCCTTCTCGGGATCGCCAGGCCTCT
ACCCGGACGAGTTCATACCGAACTTCGACGCAGTGAGAGAAGCGGTGGACGGCT
ACGACTGAATGCCCATGGTGACTCGGCTGAGCTCGCTCGGTTGAGGCATCTGG
ACCACTGCCGCCGCCTGCGCTGCTTTGCCCGGGAGAGCTGCGGACTCATCTACTT
TGAGTTTCCCGAGGAGCACCCCAACGGCCCTGCACACGGAGTGCGGATCACCGT
AGAGGGCACCACCGAGTCTCACCTGGTCAGGTTCTTCACCCAGCAACCCTTCCTG
GTCGAGCGGGACCGGGGCGCCACCACCTACACCGTCTACTGCATCTGTCCTACC
CCGAAGTTGCATGAGAATTTTTGCTGTACTCTGTGTGCTGAGTTTAATAAAAGCT
AAACTCCTACAATACTCTGGGATCCCGTGTCGTCGCACTCGCAACGAGACCTTCA
ACCTTACCAACCAGACTGAGGTAAAACTCAACTGCAGACCAGGGGACAAATACA
TCCTCTGGCTATTTGAAAACACTTCATTCGCAGTCTCCAACACCTGCGCCAACGA
CGGTATTGAAATACCCAACAACCTTACCAGTGGACTAACTTACACTACCAGAAA
GACTAAGCTAGTACTCTACAATCCTTTTGTAGAGGGAACCTACCACTGCCAGAG
CGGACCTTGCTTCCACACTTTCACTTTGGTGAACGTTACCGGCAGCAGCAGCC
GCTCCAGAAACATCTAACCTTCTTTCTGATACTAACACTCCTAAAACCGGAGGTG
AGCTCTGGGTTCCCTCTCTAACAGAGGGGGTAAACATATTGAAGCGGTTGGGT
ATTTGATTTTAGGGGTGGTCCTGGGTGGGTGCATAGCGGTGCTGTATTACCTTCC
TTGCTGGATCGAAATCAAAATCTTTATTTGCTGGGTCATACATTGTTGGGAGGAA
CCATGAAGGGGCTCTTGCTGATTATCCTTTCCCTGGTTGGGGGTGTACTGTCATG

TABLE 7-continued

Nucleic Acid Sequences of Vectors

SEQ ID NO Sequence

```
CCACGAACAGCCACGATGTAACATCACCACAGGCAATGAGAGGAGTGTGATATG
CACAGTAGTCATCAAATGCGAGCATACATGCCCTCTCAACATCACATTCAAGAA
TAAGACCATGGGAAATGCATGGGTGGGCGATTGGGAACCAGGAGATGAGCAGA
ACTACACGGTCACTGTCCATGGTAGCGATGGAAATCACACTTTCGGTTTCAAATT
CATTTTTGAAGTCATGTGTGATATCACACTGCATGTGGCTAGACTTCATGGCTTG
TGGCCCCCTACCAAGGAGAACATGGTTGGGTTTTCTTTGGCTTTTGTGATCATGG
CCTGCTTTATGTCAGGTCTGCTGGTAGGGGCTTTAGTGTGGTTCCTGAAGCGCAA
GCCTAGGTATGGAAATGAGGAGAAGGAAAAATTGCTATAAATCTTTTTCTCTTC
GCAGAACCATGAATACTTTGACCAGTGTCGTGCTGCTCTCTTCTTGTAGCTCTT
AGTCAGGCAGGATTTCATACTATCAATGCTACATGGTGGGCTAATATAACTTTAG
TGGGACCCTCAGATATTCCAGTCACATGGTATGATAGCACTGGATTACAATTTTG
CGATGGAAGTACAGTTAAGAATCATCAGATCAGACATAGCTGTAATGATCAAAA
CTTAACTCTGATTCATGTGAACAAAACCCATGAAAGAACATACATGGGTTATAA
TAGACAGAGTACTCATAAGGAAGACTATAAAGTCATAGTTATACCGCCTCGTCC
TGTTACTGTAAAGCCACAGTCAGGCCCAGAGTATGTCAATGTTAATATGGGAGA
GAACAAAACCTTAGTTGGACCTCCAGGAATTCCAGTTAGTTGGTTTAATCAGGAT
GGATTACAATTCTGCATTGGGGATAAAGTTCTTCATCCAGAATTTAATCACACCT
GTGACATGCAAAATCTTACACTGTTGTTTATAAATCTTACACATGATGGAGCTTA
TCTTGGTTATAATCGCCAGGGAACTGAAAGAACTTGGTATGAGGTTGTAGTGTC
AGATGGTTTTCCAAAATCAGAAGAGATGAAGGTAGAAGAGCATAGTAAAGAAA
CAGAACAAAAACAAACTGGACAAAAACAGAGTGGCCAAAAAGAAACAAGTCA
AAGAAAACTAATGACACACAAAAGCCATCGCGCAGGAGGCCATCTAAACTAAA
GCCAAACACACCTGACACAAAACTAATTACAGCCACTAGTGGGTCAAACGTAAC
TTTAGTTGGTCCAGCTGGAAAGGTCACTTGGTACGATGATGATTTAAAAAGACC
ATGTGAGACTGGGTATAAGTTAGACTGTAAGTGTGACAAACAAAACCTAACTCT
GATTAATGTAACTAAACTGTACGAAGGAGTTTACTATGGCACTAATGACAAAAG
CGATAGCAAAAGATACAGAATAAAAGTAAACACTACTAATTCTCAAAGTGTGAA
AATTCAGCCGTATACCATACCTACTACTCCTGAAAATAATCACAAATTTGAATTG
CAAATTGATTCTAATCAAGACAATGACAAAATTCCATCAACCACTGTGGCAATC
GTGGTGGGAGTGATTGCGGGCTTTGTTACTCTGATCATTGTCATTCTGTGCTACA
TCTGCTGCCGCAAGCGTCCCAGGTCATACAATACATGGTAGACCCACTGCTCA
GCTTCTCTTACTAAAACTCAGTCACTCTCATTTCAGAACCATGAAGGCTTTCACA
GCTTGCGTTCTGATTAGCCTAGTCACACTTAGTGCAGCTATTAAAAATCAATATC
ATGTTCATAATGTTACCAGAGATGGATATATCACATTAAATGTAACAATTGATAA
TACTACCTGGACAAGATATCATTTAAATAAGTGGCACCAAATTTGTACGTGGTCA
GACCCATCATACAAATGCCACAGTAATGGCAGCATTACTATTCATGCTTTTAATA
TTACTTCTGGCCAATACAAAGCTGAAAGTTTTACTAACTGGTTTAGATATTATGG
TAATCATAAACATGAAATTCATATTTTTAACATAACTGTAATTGAGCATCCTACA
ACAAAATCGCCCACCACTGCTAATACAGCTACATCAATTAAATCAACAACCACA
CAGCCTACAACTGTGCCCACTACACATCCAATCACCACAGTCAGTACAACCACT
GAGACAACTACCCACACTACACAGCTAGACACATCAGTGCAGAGTAGTACTGTG
TTGATTAGGTTTTTGTTGAGGGAGGAAAGTACCACTGAACAGACAGAGGCTACC
TCAAGTGCCTTCAACAGCACTGCAAATTTAACTTCGCTTGCTTCAATAAATGAGA
CCCTCGTGCCGTTGATGCTGGAACAAGATCTAAGAGGTTTGGATATGCAAATTA
CTTTTCTGGTTGTCTGTGGGATCTTTATTCTTGCGGTTCTTCTGTACTTTGTCTGCT
GCAAAGCCAGAGAGAAATCTAGGAGGCCCATCTACAGACCAGTAATCGGGGAG
CCTCAGCCCCTCCAAGTGGATGGAGGCTTAAGAAATCTTCTCTTCTCTTTTACAG
TATGGTGATCAGCCATGATTCCTAGGTTCTTCCTATTTAACATACTCTTCTGTCTA
TTCAACATCTGCGCTGCCTTCGCGGCCGTCTCGCACGCCTCGCCCGACTGTCTAG
GGCCTTTCCCCACCTACCTCCTATTTGCCCTGCTCACCTGCACCTGCGTCTGCAGC
ATTGTCTGCGTGGTCATCACCTTCCTGCAGCTCATCGACTGGTGCTGCGCGCGCT
ACAATTACCTACACCACAGTCCCGAATACAGGGACGAGAACGTGGCCAGAATCT
TAAGGCTCATCTGACCATGCAGACTCTGCTCATACTGCTATCCCTCCTATACCCT
GCCCTTGCTGATGATTACTCTAAGTGCAAATTCGCGGACATATGGAATTTCTTAG
ACTGCTATCAGGAGAAAATGGATATGCCTTCCTATTACTTGGTGATTGTTGGGGT
AGTCATGGTCTGCTCCTGCACTTTCTTTGCCATCATGATCTACCCCTGTTTTGATC
TTGGCTGGAACTCTGTTGAGGCATTCACATACACACTAGAAAGCAGTTCACTAG
CCTCCACGCCACCACCCACACCGCCTCCCCGCAGAAATCAGTTTCCCATGATTCA
GTACTTAGAAGAGCCCCCTCCCCGGCCCCCTTCCACTGTTAGCTACTTTCACATA
ACCGGCGGCGATGACTGACCACCACCTGGACCTCGAGATGGACGGCCAGGCCTC
CGAGCAGCGCATCCTGCAACTGCGCGTCCGTCAGCAGCAGGAGCGGGCCGCCAA
GGAGCTCCTCGATGCCATCAACATCCACCAGTGCAAGAAGGGCATCTTCTGCCT
GGTCAAACAGGCAAAGATCACCTACGAGCTCGTGTCCGGCGGCAAGCAGCATCG
CCTCGCCTATGAGCTACCCCAGCAGAAGCAGAAGTTCACCTGCATGGTGGGCGT
CAATCCCATAGTCATCACCCAGCAGTGGGCGAGACCAGCGGCTGCATCCACTG
CTCCTGCGAAAGCCCCGAGTGCATCTACTCCCTGCTCAAGACCCTTTGCGGACTC
CGCGACCTCCTCCCCATGAACTGATGTTGATTAAAAGCCCAAAAACCAATCAGT
CCCTTCCCCATTTCCCCATACCCAATTAAAATCATTGGAATTAATCATTCAATAA
AGATCACTTACTTGAAATCTGAAAGTATGTCTCTGGTGTAGTTGTTCAGCAGCAC
CTCGGTACCCTCCTCCCAGCTCTGGTACTCCAGTCCCGGCGGGTGGCGAACTTC
CTCCACACCTTGAAAGGGATGTCAAATTCCTGGTCCACAATTTTCATTGTCTTCC
CTCTCAGATGGCAAAGAGGCTCCGGGTGGAAGATGACTTCAACCCCGTCTACCC
CTATGGCTACGCGCGGAATCAGAATATCCCCTTCCTCACTCCCCCCTTTGTCTCA
TCCGATGGATTCCAAAACTTCCCCCCGGGTGTCATGTCACTCAAACTGGCTGACC
CAATCACCATCCGTCAATGGGGATGTCTCCCTTAAGGTTGGAGGGGGACTTGCCTT
GCAAGAAGGAAGTGGAAAGCTGACAGTCAATACTAAGGCTCCATTGCAAGTTGC
```

TABLE 7-continued

Nucleic Acid Sequences of Vectors

| SEQ ID NO | Sequence |
|---|---|
| | AAATGATAAATTAGAATTAGCATTTGATGCGCCATTTCAAGAAAAAAATGGAAA<br>ACTGGTATTGAAAACAGGACATGGTTTAGCTCTTTTAACTGAAGATAACACCCA<br>CATACCAGACTTAATTGGAACCCTTGTAGTACAACTGGAAATGGAATTGGTAC<br>AGGTAGTGTAGCTGGCGGAGGAACCATAGATGTAAGACTTGGAAACGATGGTG<br>GACTCTCATTTGATAAAAAGGGTGACTTAGTAGCCTGGAATAAAAAAGATGACA<br>GGCGCACTCTATGGACAACGCCAGATCCATCGCCAAATTGTAGAATTGAAACCG<br>CAAAGGATGCAAAACTTACTCTTGTCTTAACAAAGTGCGGAAGTCAGATTTTAG<br>CCTCTGTTTCAATTATTGTGCTAAAAGGAACATATGAATATGCAAAAAAGGACA<br>CAACTGTTAAAGAGTTCAGTATTAAGTTACTGTTTGATAAAAATGGAGTACTTTT<br>ACCTGAATCTAATTTGGACAAAGATTATTGGAACTACAGAAGCGATGATTTAAC<br>TATAGCCAAGCCATATGAAAATGCAGTGCCTTTCATGCCAAATTTAAAGGCATA<br>CCCAAGACCTGATACAACTACTCAAACAACTCCAGGAGATAAAAAAAGTAGTGG<br>TAAAAATAAAATTGTTAGTAATGTGTATTTTGGAGGCGAGGTTTATCAGCCAGG<br>AGTTATAGTTATTTATTTTAATCAAGAAAAAGACGCTAACTGTGCTTACTCCATA<br>ACTTTGAAATTTGGATGGGAAAGACATATGAAACACCCGTACCATTTGATACC<br>TCTTCTTTCACCTTCTCATACATTGCCCAAGAAAATGAAGACAAAAACGAATAA<br>AGTGTTTTAAACTGAATTTATGTATCTTTATTGATTTTTACACCAGCACGGGTAGT<br>CAGTCTCCCACCACCAGCCCATTTCACAGTGTACACGGTTCTTTCAGCACGGGTG<br>GCCTTAAATAGGGAAATGTTCTGATTAGTGCGGGAACTGGACTTGGGGTCTATA<br>ATCCACACAGTTTCCTGGCGAGCCAAACGGGGTCGGTGATTGAGATGAAGCCG<br>TCCTCTGGAAAGTCATCCAAGCGGGCCTCACAGTCCAAGGTTACAGTCTGGTGG<br>AATGAGAAGAACGCACAGATTCATACTCGGAAAACAGGATGGGTCTGTGCCTCT<br>CCATCAGCGCCCTCAACAGTCTCTGCCGCCGGGGCTCGGTGCGACTGCTGCAGA<br>TGGGATCGGGATCGCAAGTCTCTTTGACTATGATCCCCACAGCCTTCAGCAACAG<br>TCTCCTGGTGCGACGGGCACAGCACCGCATCCTGATCTCACTCAAGTTCTCACAG<br>TAAGTGCAGCACATAATCACCATGTTATTCAGCAGCCCATAATTCAGGGCGCTCC<br>AGCCAAAGCTCATGTTGGGGATAATGGAACCCACGTGACCATCGTACCAGATGC<br>GGCAGTATATCAGGTGCCTGCCCCTCAT |
| SEQ ID NO: 1425 | CATCATCAATAATATACCTTATAGATGGAATGGTGCCAATATGTAAATGAGGCG<br>ATTTTAAAAAGTGTGGGCTGTGTGGTGATTGGCTGTGGGGTTAACGGCTAAAAG<br>GGGCGGCGCGACCGTGGGAAAATGACGTTCTTTGGGGGTGGAGTTTTCTTGCAA<br>GTTGTCGCGGTAAATGTGACGCATACAAAGGTTTTTTTTCTCACGGAACTACTTA<br>GTTTTCCCACGGTATTTAACAGGAAATGAGGTAGTTTTGGCCGGATGCAAGTGA<br>AAATTGTTCATTTTCGCGCGAAAACTGAATGAGGAAGTGTTTTTCTGAATAATGC<br>GGTCTTTATGGCAGGGTGGAGTATTTGTTCAGGGCCAGGTAGACTTTGACCTATT<br>ACGTGGAGGTTTCGATTACCGTGTTTTTTACCTGAATTTCCGCGTACCGTGTCAA<br>AGTCTTCTGTTTTTACGTAGGTGTCAGCTGATCGCTACGGTATTTATACCTCAGG<br>GTTTGTGTCAAGAGGCCACTCTTGAGTGCCAGCGAGAAGAGTTTTCTCCTCTGCG<br>CCGGCAGTTTAATATTAAAAAAATGAGAAACTTGCGATTTCTGCCTCAGGAAAT<br>AATTTCTGCTGAGACTGGAAACGAAATACTGGAGCTTGTGGTGCACGCCTTAAT<br>GGGAGACGATCCGGAGCCGCCTGTGCAGCTTTTTGAGCCTCCTACGCTTCAGGA<br>ACTGTATGATTTAGAGGTAGAGGGATCGGAGGATTCTAATGAGGAAGCTGTGAA<br>TGGCTTTTTTACCGATTCTATGCTTTTAGCTGCTAATGAAGGATTAGAATTAGAT<br>CCGCCTTTGGACACTTTCGATACTCCAGGGGTGATTGTGGAAAGCGGTACAGGT<br>GTAAGAAAATTACCTGATTTGGGTTCCGTGGACTGTGTGATTTGCACTGCTATGAAG<br>ACGGGTTTCCTCCGAGTGATGAGGAGGACCATGAAACGGAGCAGTCTATGCACA<br>CTGCAGCGGGTGAGGGAGTGAAGGCTGCCAGTGTTGGTTTTCAGTTGGATTGCC<br>CGGAGCTTCCTGGACATGGCTGTAAGTCTTGTGAATTTCACAGGAAAAATACTG<br>GAGTAAAGGAACTGTTATGTTCGCTTTGTTATATGAACGCACTGCCACTTTAT<br>TTACAGTAAGTGTGTTTAAGTTAAAATTTAAAGGAATATGCTGTTTTTCACATGT<br>ATATTGAGTGGGGATTTGTGCTTCTTATTATAGGTCCTGTGTCTGATGCTGATG<br>AGTCACCATCTCCTGATTCTACTACCTCACCTCCTGAGATTCAAGCACCTGTTCCT<br>GTGGACGTGCGCAAGCCCATTCCTGTGAAGCTTAAGCCTGGGAAACGTCCAGCA<br>GTGGAAAAACTTGAGGACTTGTTACAGGGTGGGGACGGACCCTTTGGACTTGAGT<br>ACACGGAAACGTCCAAGACAATAAGTGTTCCATATCCGTGTTTACTTAAGGTGA<br>CGTCAATATTTGTGTGAGAGTGCAATGTAATAAAAATATGTTAACTGTTCACTGG<br>TTTTTATTGCTTTTTGGGCGGGGACTCAGGTATATAAGTAGAAGCAGACCTGTGT<br>GGTTAGCTCATAGGAGCTGGCTTTCATCCATGGAGGTTTGGGCCATTTTGGAAGA<br>CCTTAGAAAGACTAGGCAACTGTTAGAGGACGCTTCGGACGGAGTCTCCGGTTT<br>TTGGAGATTCTGGTTCGCTAGTGAATTAGCTAGGGTAGTTTTTAGGATAAAACAG<br>GACTATAAAGAAGAATTTGAAAAGTTGTTGCTAGATTGCCCAGGACTTTTTGAA<br>GCTCTTAATTTGGGTCATCAAGTTCACTTTAAAGAAAAAGTTTTATCAGTTTTAG<br>ACTTTTCAACCCCAGGTAGAACTGCCGCTGCTGTGGCTTTTCTTACTTTTATATTA<br>GATAAATGGATCCCGCAGACTCATTTCAGCAGGGGATACGTTTTGGATTTCATAG<br>CCACAGCATTGTGGAGAACATGGAAGGTTCGCAAGATGAGGACAATCTTAGGTT<br>ACTGGCCAGTGCAGCCTTTGGGTGTAGCGGGAATCCTGAGGCATCCACCGGTCA<br>TGCCAGCGGTTCTGGAGGAGGAACAGCAAGAGGACAACCCGAGAGCCGGCCTG<br>GACCCTCCAGTGGAGGAGGCGGAGTAGCTGACTTGTCTCCTGAACTGCAACGGG<br>TGCTTACTGGATCTACGTCCACTGGACGGGATAGGGCGTTAAGAGGGAGAGGG<br>CATGTAGTGGTACTGATGCTAGATCTGAGTTGGCTTTAAGTTTAATGAGTCGCAG<br>ACGTCCTGAAACCATTTGGTGGCATGAGGTCCAGAAAGAGGGAAGGGATGAAG<br>TTTCTGTATTGCAGGAAAAATATTCACTGGAACAGGTGAAAACATGTTGGTTGG<br>AGCCTGAGGATGATTGGGAGGTGGCCATTAAAAATTATGCCAAGATAGCTTTGA<br>GGCCTGATAAACAGTATAAGATTACTAGACGGATTAATATCCGGAATGCTTGTT<br>ACATATCTGGAAATGGGGCTGAGGTGGTAATAGATACTCCAGACAAGACAGTTA |

TABLE 7-continued

Nucleic Acid Sequences of Vectors

SEQ ID NO Sequence

TTAGATGCTGCATGATGGATATGTGGCCTGGAGTAGTCGGTATGGAAGCAGTAA
CTTTTGTAAATGTTAAGTTTAGGGGAGATGGTTATAATGGAATAGTGTTTATGGC
CAATACCAAACTTATATTGCATGGTTGTAGCTTTTTTGGTTTCAACAATACCTGT
GTAGATGCCTGGGGACAGGTTAGTGTACGGGGATGTAGTTTCTGTGCGTGTTGG
ATTGCCACAGCTGGCAGAACCAAGAGTCAATTGTCTCTGAAGAAATGCATATTC
CAAAGATGTAACCTGGGCATTCTGAATGAAGGCGAAGCAAGGGTCCGCCACTGC
GCTTCTACAGATACTGGATGTTTTATTTTAATTAAGGGCAATGCCAGCGTAAAGC
ATAACATGATTTGCGGTGCTTCCGATGAGAGGCCTTATCAAATGCTCACTTGTGC
CGGTGGGCATTGTAATATGCTGGCTACTGTGCATATTGTTTCCCATCAACGCAAA
AAATGGCCTGTTTTTGATCACAATGTGTTGACGAAGTGTACCATGCATGCAGGTG
GGCGTAGAGGAATGTTTATGCCTTACCAGTGTAACATGAATCATGTGAAAGTGT
TGTTGGAACCAGATGCCTTTTCCAGAATGAGCCTAACAGGAATCTTTGACATGA
ACATGCAAATCTGGAAGATCCTGAGGTATGATGATACGAGATCGAGGGTGCGCG
CATGCGAATGCGGAGGCAAGCATGCCAGGTTCCAGCCGGTGTGTGTAGATGTGA
CTGAAGATCTGAGACCGGATCATTTGGTTATTGCCCGCACTGGAGCAGAGTTCG
GATCCAGTGGAGAAGAAACTGACTAAGGTGAGTATTGGGAAAACTTTGGGGTGG
GGTTTTCAGATGGACAGATTGAGTAAAAATTTGTTTTTTCTGTCTTTCAGCTGTCA
TGAGTGGAAACGCTTCTTTTAAGGGGGGAGTCTTCAGCCCTTATCTGACAGGGC
GTCTCCCATCCTGGGCAGGAGTTCGTCAGAATGTTATGGGATCTACTGTGGATGG
AAGACCCGTCCAACCCGCCAATTCTTCAACGCTGACCTATGCTACTTTAAGTTCT
TCACCTTTGGACGCAGCTGCAGCCGCCGCCGCCGCCTCTGTTGCCGCTAACACTG
TGCTTGGAATGGGTTACTATGGAAGCATCCTGGCTAATTCCACTTCCTCTAATAA
CCCTTCTACCCTGACTCAGGACAAGTTACTTGTCCTTTTGGCCCAGCTGGAGGCT
TTGACCCAACGTCTGGGTGAACTTTCTCAGCAGGTGGCCGAGTTGCGAGTACAA
ACTGAGTCTGCTGTCGGCACGGCAAAGTCTAAATAAAAAAATTCCAGAATCAAT
GAATAAATAAACGAGCTTGTTGTTGATTTAAAATCAAGTGTTTTTATTTCATTTTT
CGTGCACGGTATGCCCTAGACCACCGATCTCGATCATTGAGAACTCGGTGGATTT
TTTCCAGAATCCTATAGAGGTGGGATTGAATGTTTAGATACATGGGCATTAGGCC
GTCTTTGGGGTGGAGATAGCTCCATTGAAGGGATTCATGCTCCGGGGTAGTGTTG
TAAATCACCCAGTCATAACAAGGTCGCAGTGCATGGTGTTGCACAATATCTTTTA
GAAGTAGGCTGATTGCCACAGATAAGCCCTTGGTGTAGGTGTTTACAAACCGGT
TGAGCTGGGAGGGGTGCATGCGGGTGAAATTATGTGCATTTTTGATTGGATTTT
TAAGTTGGCAATATTGCCGCCAAGATCTCGTCTTGGGTTCATGTTATGAAGGACC
ACCAAGACGGTGTATCCGGTACATTTAGGAAATTTATCGTGCAGCTTGGATGGA
AAAGCGTGGAAAAATTTGGAGACACCCTTGTGTCCTCCGAGATTTTCCATGCACT
CATCCATGATAATAGCAATGGGCCGTGGGCAGCGGCGCGGGCAAACACGTTCC
GTGGGTCTGACACATCATAGTTATGTTCCTGAGTTAAATCATCATAAGCCATTTT
AATGAATTTGGGCGGAGAGTACCCGATTGGGGTATGAATGTTCCTTCGGGCCC
CGGAGCATAGTTCCCCTCACAGATTTGCATTTCCCAAGCTTTCAGTTCCGAGGGT
GGAATCATGTCCACCTGGGGGGCTATAAAGAACACCGTTTCTGGGGCGGGGGTG
ATTAGTTGGGATGATAGCAAGTTTCTGAGCAATTGAGATTTGCCACATCCGGTGG
GGCCATAAATGATTCCGATTACAGGTTGCAGGTGGTAGTTTAGGGAACGGCAAC
TGCCGTCTTCTCGAAGCAAGGGGGCCACCTCGTTCATCATTTCCCTTACATGCAT
ATTTTCCCGCACCAAATCCATTAGGAGGCGCTCTCCTCCTAGTGATAGAAGTTCT
TGTAGTGAGGAAAAGTTTTTCAGCGGTTTTAGACCGTCAGCCATGGGCATTTTGG
AGAGAGTCTGCTGCAAAAGTTCTAGTCTGTTCCACAGTTCAGTGATGTGTTCTAT
GGCATCTCGATCCAGCAGACCTCCTCGTTTCGCGGGTTTGGACGGCTCCTGGAGT
AGGGTATGAGACGATGGGCGTCCAGCGCTGCCAGGGTTCGGTCCTTCCAGGGTC
TCAGAGTTCGAGTCAGGGTTGTTTCCGTCACAGTGAAGGGGTGTGCGCCTGCTTG
GGCGCTTGCCAGGGTGCGCTTCAGACTCATCCTGCTGGTCGAAAACTTCTGCCGC
TTGGCGCCCTGTATGTCGGCCAAGTAGCAGTTTACCATGAGTTCGTAGTTGAGCG
CCTCGGCTGCGTGACCCTTGGCGCGGAGCTTACCTTTGGAAGTTTTCTTGCATAC
CGGGCAGTATAGGCATTTCAGCGCATACAGCTTGGGCGCAAGGAAAATGGATTC
TGGGGAGTATGCATCCGCCGCAGGAGGCGCAAACAGTTTCACATTCCACCAG
CCAGGTTAAATCCGGTTCATTGGGGTCAAAAACAAGTTTTCCGCCATATTTTTG
ATGCGTTTCTTACCTTTGGTCTCCATGAGTTCGTGTCCTCGTTGAGTGACAAACA
GGCTGTCCGTGTCCCCGTAGACTGATTTTACAGGCCTCTTCTCCAGTGGAGTGCC
TCGGTCTTCTTCGTACAGGAACTCTGACCACTCTGATACAAAGGCGCGCGTCCAG
GCCAGCACAAAGGAGGCTATGTGGGAGGGGTAGCGATCGTTGTCAACCAGGGG
GTCCACCTTTTCCAAAGTATGCAAACACATGTCACCCTCTTCAACATCCAGGAAT
GTGATTGGCTTGTAGGTGTATTTCACGTGACCTGGGGTCCCAGTTGGGGGGTAT
AAAAGGGGGCGGTTCTCTGCTCTTCCTCACTGTCTTCCGGATCGCTGTCCAGGAA
CGTCAGCTGTTGGGGTAGGTATTCCCTCTCGAAGGCGGGCATGACCTCTGCACTC
AGGTTGTCAGTTTCTAAGAACGAGGAGGATTTGATATTGACAGTGCCGCTTGAG
ATGCCTTTCATGAGGTTTTCGTCCATTTGGTCAGAAAACACAATTTTTTATTGTC
AAGTTTGGTGGCAAATGATCCATACAGGGCGTTGGATAAAAGTTTGGCAATGGA
TCGCATGGTTTGGTTCTTTTCCTTGTCCGCGCGCTCTTTGGCAGCGATGTTGAGTT
GGACATACTCGCGTGCCAGGCACTTCCATTCGGGGAAGATAGTTGTCAATTCATC
TGGCACGATTCTCACTTGCCACCCTCGGTTATGCAAGGTAATTAAATCCACACTG
GTGGCCACCTCGCCTCGAAGGGGTCGTTGGTCCAGCAGAGCCTACCTCCTTTCC
TAGAACAGAAAGGTGGAAGTGGGTCTAGCATAAGTTCATCGGGAGGGTCTGCAT
CCATGGTAAAGATTCCAGGAAGTAAATCCTTATCAAAATAGCTGATGGGAGTGG
GGTCATCTAAGGCCATTTGCCATTCTCGAGCTGCCAGTGCGCGCTCGTATGGGTT
AAGGGGACTGCCCCAGGGCATGGGATGGGTGAGTGCAGAGGCATACATGCCAC
AGATGTCATAGACGCTAGATGGGATCCTCAAAGATGCCTATGTAGGTTGGATAGC
ATCGCCCCCCTCTGATACTTGCTCGCACATAGTCATATAGTTCATGTGACGGCGC

TABLE 7-continued

Nucleic Acid Sequences of Vectors

SEQ ID NO Sequence

TAGCAGCCCCGGACCCAAGTTGGTGCGATTGGGTTTTTCTGTTCTGTAGACAATC
TGGCGAAAGATGGCGTGAGAATTGGAAGAGATGGTGGGTCTTTGAAAAATGTTG
AAGTGGGCATGAGGTAGACCTACAGAGTCTCTGATAAAGTGGGCATAAGATTCT
TGAAGCTTGGTTACCAGTTCGGCGGTGACAAGTACGTCCAGGGCGCAGTAGTCA
AGTGTTTCTTGAATGATGTCATAACATGGTTGGTTTTTCTTTTCCCACAGTTCGCG
GTTGAGAAGGTATTCTTCGCGATCCTTCCAGTACTCTTCTAGCGGAAACCCGTCT
TTGTCTGCACGGTAAGATCCTAGCATGTAGAACTGATTAACTGCCTTGTAAGGGC
AGCAGCCCTTCTCTACGGGTAGAGAGTATGCTTGAGCAGCTTTTCGTAGCGAAG
CGTGAGTAAGGGCGAAGGTGTCTCTGACCATGACTTTGAGAAATTGGTATTTGA
AGTCTATGTCGTCACAGGCTCCCTGTTCCCAGAGTTGGAAGTCTACCCGTTTCTT
GTAGGCGGGGTTGGGCAAAGCGAAAGTAACATCGTTGAAGAGAATCTTACCGGC
TCTGGGCATAAAATTGCGAGTGATGCGGAAAGGCTGTGGTACTTCCGCTCGATT
GTTGATCACCTGGGCAGCTAGGACGATCTCGTCGAAACCGTTGATGTTGTGTCCT
ACAATGTATAATTCTATGAAACGCGGCGTGCCTCTGACGTGAGGTAGCTTATTGA
GCTCATCAAAGGTTAGGTCTGTAGGGTCAGATAAGGCGTAGTGTTCGAGGGCCC
ATTCGTGCAGATGAGGATTTGCATGTAGGAATGATGACCAAAGATCCACCGCCA
GTGCTGTTTGTAACTGGTCCCGATACTGACGAAATGCTGGCCAATTGCCATTTT
TTCTGGAGTGACACAGTAGAAGGTTCTGGGATCTTGTTGCCATCGATCCCACTTG
AGTTTAATGGCTAGATCGTGGGCCATGTTGACGAGACGCTCTTCTCCTGAGAGTT
TCATGACCAGCATGAAAGGAACTAGTTGTTTGCCAAAGGATCCCATCCAGGTGT
AAGTTTCCACATCGTAGGTCAGGAAGAGTCTTTCTGTGCGAGGATGAGAGCCGA
TCGGGAAGAACTGGATTTCCTGCCACCAGTTGGAGGATTGGCTGTTGATGTGAT
GGAAGTAGAAGTTTCTGCGGCGCGCCGAGCATTCGTGTTTGTGCTTGTACAGAC
GGCCGCAGTAGTCGCAGCGTTGCACGGGTTGTATCTCGTGAATGAGTTGTACCTG
GCTTCCCTTGACGAGAAATTTCAGTGGGAAGCCGAGGCCTGGCGATTGTATCTC
GTGCTCTTCTATATTCGCTGTATCGGCCTGTTCATCTTCTGTTTCGATGGTGGTCA
TGCTGACGAGCCCCCGCGGGAGGCAAGTCCAGACCTCGGCGCGGGAGGGCGG
AGCTGAAGGACGAGAGCGCGCAGGCTGGAGCTGTCCAGAGTCCTGAGACGCTG
CGGACTCAGGTTAGTAGGTAGGGACAGAAGATTAACTTGCATGATCTTTTCCAG
GGCGTGCGGGAGGTTCAGATGGTACTTGATTTCCACAGGTTCGTTTGTAGAGAC
GTCAATGGCTTGCAGGGTTCCGTGTCCTTTGGGCGCCACTACCGTACCTTTGTTTT
TTCTTTTGATCGGTGGTGGCTCTCTTGCTTCTTGCATGCTCAGAAGCGGTGACGG
GGACGCGCGCCGGGCGGCAGCGGTTGTTCCGGACCCGGGGGCATGGCTGGTAGT
GGCACGTCGGCGCCGCGCACGGGCAGGTTCTGGTACTGCGCTCTGAGAAGACTT
GCGTGCGCCACCACGCGTCGATTGACGTCTTGTATCTGACGTCTCTGGGTGAAAG
CTACCGGCCCCGTGAGCTTGAACCTGAAAGAGAGTTCAACAGAATCAATTTCGG
TATCGTTAACGGCAGCTTGTCTCAGTATTTCTTGTACGTCACCAGAGTTGTCCTG
GTAGGCGATCTCCGCCATGAACTGCTCGATTTCTTCCTCCTGAAGATCTCCGCGA
CCCGCTCTTTCGACGGTGGCCGCGAGGTCATTGGAGATACGGCCCATGAGTTGG
GAGAATGCATTCATGCCCGCCTCGTTCCAGACGCGGCTGTAAACCACGGCCCCC
TCGGAGTCTCTTGCGCGCATCACCACCTGAGCGAGGTTAAGCTCCACGTGTCTGG
TGAAGACCGCATAGTTGCATAGGCGCTGAAAAAGGTAGTTGAGTGTGGTGGCAA
TGTGTTCGGCGACGAAGAAATACATGATCCATCGTCTCAGCGGCATTTCGCTAAC
ATCGCCCAGAGCTTCCAAGCGCTCCATGGCCTCGTAGAAGTCCACGGCAAAATT
AAAAAACTGGGAGTTTCGCGCGGACACGGTCAATTCCTCCTCGAAGAAGACGGAT
GAGTTCGGCTATGGTGGCCCGTACTTCGCGTTCGAAGGCTCCCGGGATCTCTTCT
TCCTCTTCTATCTCTTCTTCCACTAACATCTCTTCTTCGTCTTCAGGCGGGGCGG
AGGGGGCACGCGGCGACGTCGACGGCGCACGGGCAAACGGTCGATGAATCGTT
CAATGACCTCTCCGCGGCGGCGGCGCATGGTTTCAGTGACGGCGCGGCCGTTCT
CGCGCGGTCGCAGAGTAAAAACACCGCCGCGCATCTCCTTAAAGTGGTGACTGG
GAGGTTCTCCGTTTGGGAGGGAGAGGGCGCTGATTATACATTTTATTAATTGGCC
CGTAGGGACTGCACGCAGAGATCTGATCGTGTCAAGATCCACGGGATCTGAAAA
CCTTTCGACGAAAGCGTCTAACCAGTCACAGTCACAAGGTAGGCTGAGTACGGC
TTCTTGTGGGCGGGGGTTGGTTATGTGTTCGGTCTGGGTCTTCTGTTTCTTCTTCAT
CTCGGGAAGGTGAGACGATGCTGCTGGTGATGAAATTAAAGTAGGCAGTTCTAA
GACGGCGGATGGTGGCGAGGAGCACCAGGTCTTTGGGTCCGGCTTGCTGGATAC
GCAGGCGATTGGCCATTCCCCAAGCATTATCCTGACATCTAGCAAGATCTTTGTA
GTAGTCTTGCATGAGCCGTTCTACGGGCACTTCTTCCTCACCCGTTCTGCCATGC
ATACGTGTGAGTCCAAATCCGCGCATTGGTTGTACCAGTGCCAAGTCAGCTACG
ACTCTTTCGGCGAGGATGGCTTGCTGTACTTGGGTAAGGGTGGCTTGAAAGTCAT
CAAAATCCACAAAGCGGTGGTAAGCCCCTGTATTAATGGTGTAAGCACAGTTGG
CCATGACTGACCAGTTAACTGTCTGGTGACCAGGGCGCACGAGCTCGGTGTATTT
AAGGCGCGAATAGGCGCGGGTGTCAAAGATGTAATCGTTGCAGGTGCGCACCAG
ATACTGGTACCCTATAAGAAAATGCGGCGGTGGTGGCGGTAGAGAGGCCATCG
TTCTGTAGCTGGAGCGCCAGGGGCGAGGTCTTCCAACATAAGGCGGTGATAGCC
GTAGATGTACCTGGACATCCAGGTGATTCCTGCGGCGGTAGTAGAAGCCCGAGG
AAACTCGCGTACGCGGTTCCAAATGTTGCGTAGCGGCATGAAGTAGTTCATTGT
AGGCACGGTTTGACCAGTGAGGCGCGCGCAGTCATTGATGCTCTATAGACACGG
AGAAAATGAAAGCGTTCAGCGACTCGACTCCGTAGCCTGGAGGAACGTGAACG
GGTTGGGTCGCGGTGTACCCCGGTTCGAGACTTGTACTCGAGCCGGCCGGAGCC
GCGGCTAACGTGGTATTGGCACTCCCGTCTCGACCCAGCCTACAAAAATCCAGG
ATACGGAATCGAGTCGTTTTGCTGGTTGCCGAATGGCAGGGAAGTGAGTCCTAT
TTTTTTTTTTTGCCGCTCAGATGCATCCCGTGCTGCGACAGATGCGTCCCCAACA
ACAGCCCCCCTCGCAGCAGCAGCAACCACAAAAGGCTGTCCCTGCAACTACTGC
AACTGCCGCCGTGAGCGGTGCGGGACAGCCCGCCTATGATCTGGACTTGGAAGA
GGGCGAAGGACTGGCACGTCTAGGTGCGCCCTCGCCCGAGCGGCATCCGCGAGT

TABLE 7-continued

Nucleic Acid Sequences of Vectors

SEQ ID NO Sequence

TCAACTGAAAAAAGATTCTCGCGAGGCGTATGTGCCCCAACAGAACCTATTTAG
AGACAGAAGCGGCGAGGAGCCGGAGGAGATGCGAGCTTCCCGCTTTAACGCGG
GTCGTGAGCTGCGTCACGGTTTGGACCGAAGACGAGTGTTGCGGGACGAGGATT
TCGAAGTTGATGAAGTGACAGGGATCAGTCCTGCCAGGGCACACGTGGCTGCAG
CCAACCTTGTATCGGCTTACGAGCAGACAGTAAAGGAAGAGCGTAACTTCCAAA
AGTCTTTTAATAATCATGTGCGAACCCTGATTGCCCGCGAAGAAGTCACCCTTGG
TTTGATGCATTTGTGGGATTTGATGGAAGCTATCATTCAGAACCCTACTAGCAAA
CCTCTGACCGCACAGTTGTTTCTGGTGGTGCAACACAGCAGAGACAATGAGGCT
TTCAGAGAGGCACTGCTCAACATCACCGAACCCGAGGGGAGATGGTTGTATGAT
CTTATCAACATTCTACAGAGTATCATAGTGCAGGAGCGGAGCCTGGGCCTGGCC
GAGAAGGTGGCTGCCATCAATTACTCGGTTTTGAGTTTGGGAAAATATTACGCTC
GCAAGATCTACAAGACTCCATACGTTCCCATAGACAAGGAGGTGAAGATAGATG
GGTTCTACATGCGCATGACGCTCAAGGTCTTGACCCTGAGCGATGATCTTGGGGT
GTACCGCAATGACAGAATGCATCGCGCCGTTAGCGCCAGTAGGAGGCGCGAGTT
AAGCGACAGGGAACTGATGCACAGTTTGCAAAGAGCTCTGACTGGAGCTGGAAC
CGAGGGTGAGAATTACTTTGACATGGGAGCTGACTTGCAGTGGCAGCCTAGTCG
CAGGGCTCTGAGCGCCGCGACGGCAGGATGTGAGCTTCCTTACATAGAAGAGGC
GGATGAAGGCGAGGAAGAAGAGGGCGAGTACTTGGAAGACTGATGGCACAACC
CGTGTTTTTGCTAGATGGAACAGCAAGCACCGGATCCCGCAACGCGGGCGGCG
CTGCAGAGCCAGCCGTCCGGCATTAACTCCTCGGACGATTGGACCCAGGCCATG
CAACGTATCATGGCGTTGACGACTCGCAACCCCGAAGCCTTTAGCACAGCAACCC
CAGGCCAACCGTCTATCGGCCATCATGGAAGCTGTAGTGCCTTCCCGCTCTAATC
CCACTCATGAGAAGGTCCTGGCCATCGTGAACGCGTTGGTGGAGAACAAAGCTA
TTCGTCCAGATGAGGCCGGACTGGTATACAACGCTCTCTTAGAACGCGTGGCTC
GCTACAACAGTAGCAATGTGCAAACCAATTTGGACCGTATGTAACAGATGTAC
GCGAAGCCGTGTCTCAGCGCGAAAGGTTCCAGCGCGATGCCAACCTGGGTTCGC
TGGTGGCGTTAAATGCTTTTTTGAGTACTCAGCCTGCTAATGTGCCGCGTGGTCA
ACAGGATTATACTAACTTTTTGAGTGCATTGAGACTGATGGTATCTGAAGTACCT
CAGAGCGAAGTGTATCAGTCCGGACCTGACTACTTCTTTCAGACTAGCAGACAG
GGTTTGCAGACGGTAAATCTGAGCCAAGCTTTTAAAAAACCTTAAAGGTTTGTGG
GGAGTGCATGCCCCAGTAGGAGAAAGAGCAACCGTGTCTAGCTTGTTAACTCCG
AACTCCCGCCTATTACTACTGTTGGTAGCTCCTTTCACCGACAGCGGTAGCATCG
ACCGTAATTCCTATTTGGGTTACCTACTAAACCTGTATCGCGAAGCCATAGGGCA
AAGCCAGGTGGACGAGCAGACCTATCAAGAAATTACCCAAGTCAGTCGCGCTTT
GGGTCAGGAAGACACTGGCAGTTTGGAAGCCACTCTGAACTTCTTGCTTACCAA
TCGGTCTCAGAAGATCCCTCCTCAATATGCTCTTACTGCGGAGGAGGAGAGGAT
CCTTAGATATGTGCAGCAGAGCGTGGGATTGTTTCTGATGCAAGAGGGGCAAC
TCCGACTGCAGCATTGGACATGACGGCGCGAAATATGGAGCCCAGCATGTATGC
CAGTAACCGGCCTTTCATTAACAAACTGCTGGACTACTTGCACAGAGCTGCCGCT
ATGAACTCTGATTATTTCACCAATGCCATCTTAAACCCGCACTGGCTGCCCCCAC
CTGGTTTCTACACGGGCGAATATGACATGCCCGACCCTAATGACGGGTTTCTGTG
GGACGACGTGGACAGTGATGTTTTTTCACCTCTTTCTGATCATCGCACGTGGAAA
AAGGAAGGCGGCGATAGAATGCATTCTTCTGCATCGCTGTCCGGGGTCATGGGT
GCTACCGCGGCTGAGCCCGAGTCTGCAAGTCCTTTTCCTAGTCTACCCTTTTCTCT
ACACAGTGTACGTAGCAGCGAAGTGGGTAGAATAAGTCGCCCGAGTTTAATGGG
CGAAGAGGAATACCTAAACGATTCCTTGCTCAGACCGGCGAGAGAAAAAAATTT
CCCAAACAATGGAATAGAAAGTTTGGTGGATAAGATGAGTAGATGGAAGACTTA
TGCTCAGGATCACAAAGACGAGCCTGGGATCATGGGGACTACAAGTAGAGCGA
GCCGTAGACGCCAGCGTCATGACAGACAGAGGGGTCTTGTGTGGGACGATGAGG
ATTCGGCCGATGATAGCAGCGTGTTGGACTTGGGTGGGAGAGGAAGGGGCAACC
CGTTTGCTCATTTGCGCCCTCGTTTGGGTGGTATGTTGTAAAAAAAAAATAAAAAG
GAAACTCACCAAGGCCATGGCGACGAGCGTACGTTCGTTCTTCTTTATTATCTGT
GTCTAGTATAATGAGGCGAGTCGTGCTAGGCGGAGCGGTGGTGTATCCGGAGGG
TCCTCCTCCTTCGTACGAGAGCGTGATGCAGCAGCAGCAGGCGACGGCGGTGAT
GCAATCCCCACTGGAGGCTCCCTTTGTACCTCCGCGATACCTGGCACCTACGGAG
GGCAGAAACAGCATTCGTTACTCGGAACTGGCACCTCAGTACGATACCACCAGG
TTGTATCTGGTGGACAACAAGTCGGCGGACATTGCTTCTCTGAACTATCAGAATG
ACCACAGCAACTTCTTGACCACGGTGGTGCAGAACAATGACTTTACCCCTACGG
AAGCCAGTACCCAGACCATTAACTTTGATGAACGATCGCGGTGGGGCGTCAGC
TAAAGACCATCATGCATACTAACATGCCCAACGTGAACGAGTATATGTTTAGTA
ATAAGTTCAAAGCGCGTGTGATGGTGTCCAGAAAACCTCCTGAGGGTGTTAGAG
TAGACGATAGTTATGATCATAAGCAAGATATTCTAAAATACGAGTGGTTCGAGT
TTACTTTGCCAGAAGGCAACTTTTCGGTCACTATGACTATTGACTTTGATGAATAA
TGCCATCATAGACAATTACTTGAAAGTGGGCAGACAGAATGGAGTAATGGAAAG
TGACATTGGTGTTAAGTTCGACACCAGGAACTTCAAGCTGGGATGGGATCCAGA
AACTAAGTTAATCATGCCTGGGGTTTACACCTATGAGGCCTTCCATCCTGACATC
GTATTGCTGCCTGGCTGCGAGTGGATTTTACAGAAAGCCGTCTGAGCAACCTTC
TTGGCATTAGAAAGAAACACCCATTCCAAGAGGGTTTTAAGATCTTGTATGAGG
ATTTAGAAGGAGGAAATATTCCAGCCCTTTTGGATGTAGATGCTTATGAGAACA
GCAAGAAAGATCAAAAAGCCAAATAGAAGCTGCTACAGCTGCTGCGGAAGCT
AAGGCAAACATAGTTGCCAGCGACTCTACAAGGGTCGCTAACGCTGGAGAGGTC
AGAGGAGACAATTTTGCACCAACACCTGTTCCGACTGCAAAATCATTATTGGCC
AATATGACTGAAGGAACGGACGTGAAACTCACTATTCAACCTGTAGAAAAAGAT
AGTAAGAATAGAAGCTATAATGTGTTGGAAGATAAAATCAACACAGCCTATCGC
AGTTGGTACCTTTCGTACAATTATGGCGATCCCGAAAAAGGAGTGCGTTCCTGG
ACATTGCTCACCACTTCAGATGTCACCTGCGGAGCAGAGCAGGTCTACTGGTCG

TABLE 7-continued

Nucleic Acid Sequences of Vectors

| SEQ ID NO | Sequence |
|---|---|
| | CTTCCAGACATGATGCAGGATCCTATCACTTTCCGCTCCACTAGACAAGTCAGTA |
| | ACTACCCTGTGGTGGGTGCAGAGCTTATGCCCGTCTTCTCAAAGAGCTTCTACAA |
| | CGAACAAGCTGTGTACTCCCAGCAGCTCCGCCAGTCCACCTCGCTTACGCACGTC |
| | TTCAACCGCTTTCCTGAGAACCAGATTTTAATCCGTCCGCCGGCGCCCACCATTA |
| | CCACCGTCAGTGAAAACGTTCCTGCTCTCACAGATCACGGGACCCTGCCGTTGCG |
| | CAGCAGTATCCGGGGAGTCCAACGTGTGACCGTTACTGACGCCAGACGCCGCAC |
| | CTGTCCCTACGTGTACAAGGCACTGGGCATAGTCGCACCGCGCGTCCTTTCAAGC |
| | CGCACTTTCTAAAAAAAAAAATGTCCATTCTTATCTCGCCCAGTAATAACACCGG |
| | TTGGGGTCTGCGCGCTCCAAGCAAGATGTACGGAGGCGCACGCAAACGTTCTAC |
| | CCAACATCCCGTGCGTGTTCGCGGTCATTTTCGCGCTCCATGGGGTGCCCTCAAG |
| | GGCCGTACTCGCGTTCGAACCACCGTCGATGATGTAATCGATCAGGTGGTTGCC |
| | GACGCCCGTAATTATACTCCTACTGCGCCTACATCTACTGTGGATGCAGTTATTG |
| | ACAGTGTAGTGGCTGACGCTCGCAACTATGCTCGACGTAAGAGCCGGCGAAGGC |
| | GCATTGCCAGACGCCACCGAGCTACCACTGCCATGCGAGCCGCAAGAGCTCTGC |
| | TACGAAGAGCTAGACGCGTGGGACGAAGAGCCATGCTTAGGGCGGCCAGACGT |
| | GCAGCTTCGGGTGCCAGCGCCGGCAGGTCCCGCAGGCAAGCAGCCGCTGTCGCA |
| | GCGGCGACTATTGCCGACATGGCCCAAACGCGAAGAGGCAATGTATACTGGGTG |
| | CGTGACGCTGCCACCGGTCAACGTGTACCCGTGCGCACCCGTCCCCCTCGCACTT |
| | AGAAGATACTGAGCAGTCTCCGATGTTGTGTCTCAGCGGCGAGGATGTCCAAGC |
| | GCAAATACAAGGAAGAAATGCTGCAGGTTATCGCACCTGAAGTCTACGGCCAAC |
| | CGTTGAAGGATGAAAAAAAACCCCGCAAATCAAGCGGGCTAAAAAGGACAAA |
| | AAAGAAGAGGAAGATGGCGATGATGGGCTGGCGGAGTTTGTGCGCGAGTTTGCC |
| | CCACGGCGACGCGTGCAATGGCGTGGGCGCAAAGTTCGACATGTGTTGAGACCT |
| | GGAACTTCGGTGGTCTTTACACCCGGCGAGCGTTCAAGCGCTACTTTTAAGCGTT |
| | CCTATGATGAGGTGTACGGGGATGATGATATTCTTGAGCAGGCGGCTGACCGAT |
| | TAGGCGAGTTTGCTTATGGCAAGCGTAGTAGAATAAATCCCAAGGATGAGACAG |
| | TGTCCATACCCTTGGATCATGGAAATCCCACCCCTAGTCTTAAACCGGTCACTTT |
| | GCAGCAAGTGTTACCCGTAACTCCGCGAACAGGTGTTAAACGCGAAGGTGAAGA |
| | TTTGTATCCCACTATGCAACTAATGGTACCCAAACGCCAAAAGTTGGAGGACGT |
| | TTTGGAGAAAGTAAAAGTGGATCCAGATATTCAACCTGAGGTTAAAGTGAGACC |
| | CATTAAGCAGGTAGCGCCTGGTCTGGGAGTACAAACTGTAGACATTAAGATTCC |
| | CACTGAAAGTATGGAAGTGCAAACTGAACCCGCAAAGCCTACTGCCACCTCCAC |
| | TGAAGTGCAAACGGATCCATGGATGCCCATGCCTATTACAACTGACGCCGCCGG |
| | TCCCACTCGAAGATCCCGACGAAAGTACGGTTCAGCAAGTCTGTTGATGCCCAA |
| | CTATGTTGTACACCCATCTATTATTCCTACTCCTGGTTACCGAGGCACTCGCTACT |
| | ATCGCAGCCGAAACAGTACCTCCCGCCGTCGCCGCAAGCACCTGCAAATCGCA |
| | GTCGTCGCCGTAGACGCACAAGCAAACCGACTCCCGGCGCCCTGGTGCGGCAAG |
| | TGTACCGCAATGGTAGTGCGGAACCTTTGACACTGCCGCGTGCGCGTTACCATCC |
| | GAGTATCATCACTTAATCAATGTTGCCGCTGCCTCCTTGCAGATATGGCCCTCAC |
| | TTGTCGCCTTCGCGTTCCCATCACTGGTTACCGAGGAAGAAATTCGCGCCGTAGA |
| | AGAGGGATGTTGGGCGCGGAATGCGACGCTACAGGCGACGGCGTGCTATCCGC |
| | AAGCAATTGCGGGTGGTTTTTTGCCAGCCTTAATTCCAATTATCGCTGCTGCAA |
| | TTGGCGCGATACCAGGCATAGCTTCCGTGGCGGTTCAGGCCTCGCAACGACATT |
| | GACATTGGAAAAAACGTATAAATAAAAAAAAATACAATGGACTCTGACACTCCT |
| | GGTCCTGTGACTATGTTTTCTTAGAGATGGAAGACATCAATTTTTCATCCTTGGC |
| | TCCGCGACACGGCACGAAGCCGTACATGGGCACCTGGAGCGACATCGGCACGA |
| | GCCAACTGAACGGGGGCGCCTTCAATTGGAGCAGTATCTGGAGCGGGCTTAAAA |
| | ATTTTGGCTCAACCATAAAAACATACGGGAACAAAGCTTGGAACAGCAGTACAG |
| | GACAGGCGCTTAGAAATAAACTTAAAGACCAGAACTTTCAACAAAAAGTAGTCG |
| | ATGGGATAGCTTCCGGCATCAATGGAGTGGTAGATTTGGCTAATCAGGCTGTGC |
| | AGAAAAAGATAAACAGTCGTTTGGACCCGCCGCCAGCAACCCCAGGTGAAATGC |
| | AAGTGGAGGAAGAAATTCCTCCGCCAGAAAAACGAGGCGACAAGCGTCCGCGT |
| | CCCGATTTAGAAGAGACGCTGGTGACGCGCGTAGATGAACCGCCTTCTTATGAG |
| | GAAGCAACGAAGCTTGGAATGCCCACCACTAGACCGATAGCCCCTATGGCTACC |
| | GGGGTGATGAAACCTTCTCAGTTGCATCGACCCGTCACCTTGGATTTGCCCCCTC |
| | CCCCTGCTGTACCCGCTTCTAAGCCTGTCGCTGTCCCGAAACCAGTCGCCGTAGC |
| | CAGGTCACGTCCCGGGGCGCTCCTCGTCCAAATGCGCACTGGCAAAATACTCT |
| | GAACAGCATCGTGGGTCTAGGCGTGCAAAGTGTAAAACGCCGTCGCTGCTTTTA |
| | ATTAAATATGGAGTAGCGCTTAACTTGCCTATCTGTGTATATGTGTCATTACACG |
| | CCGTCACAGCAGCAGAGGAAAAAAGGAAGAGGTCGTGCGTCGACGCTGAGTTA |
| | CTTTCAAGATGGCCACCCCATCGATGCTGCCCCAGTGGGCATACATGCACATCGC |
| | CGGACAGGATGCTTCGGAGTACCTGAGTCCGGGTCTGGTGCAGTTCGCCCGCGC |
| | CACAGACACCTACTTCAATCTTGGAAATAAGTTTAGAAATCCCACCGTAGCGCC |
| | GACCCACGATGTGACCACCGACCGTAGCCAGCGGCTCATGTTGCGCTTCGTGCC |
| | CGTTGACCGGGAGGACAATACATACTCTTACAAAGTGCGGTACACCCTGGCCGT |
| | GGGCGACAACAGAGTGCTGGATATGGCCAGCACGTTCTTTGACATTAGGGGCGT |
| | GTTGGACAGAGGTCCCAGTTTCAAACCCTATTCTGGTACGGCTTACAACTCTCTG |
| | GCTCCTAAAGGCGCTCCAAATGCATCTCAGTGGTTGGATAAGGGAGTTACAAGC |
| | ACTGGTCTAGTGGACGACGGGAATGATGATGATGGGGAAGAAGCCAAAAAAGC |
| | AACATACACTTTTGGTAACGCTCCAGTAAAAGCCGAGGCTGAAATCACAAAAGA |
| | CGGATTGCCGGTGGGCTTGGAGGTTTCAACTGAAGGTCCTAAACCAATCTATGCT |
| | GATAAGCTTTATCAGCCAGAACCTCAAGTGGGAGACGAAACTTGGACTGACCTA |
| | GACGGAAAAACCGAAGAGTATGGAGGGAGAGTTCTTAAACCTGAAACTAAAAT |
| | GAAACCCTGCTACGGATCTTTTGCTAAACCTACTAATATTAAAGGAGGTCAGGC |
| | AAAGGTAAAACCAAAAGAAGACGATGGCACTAACAACATCGAATATGACATTG |
| | ACATGAACTTCTTTGACTTAAGATCACAAAGATCAGAACTGAAACCTAAAATTG |

TABLE 7-continued

Nucleic Acid Sequences of Vectors

SEQ ID NO Sequence

```
TAATGTATGCAGAAAATGTGGACCTGGAATCTCCAGATACTCATGTTGTGTACA
AACCTGGAGTTTCAGATGCTAGTTCTGAGACCAATCTTGGACAACAGTCTATGCC
CAACAGACCCAACTACATTGGCTTCAGAGATAACTTCATCGGACTTATGTACTAT
AACAGTACTGGCAACATGGGGGTACTGGCTGGTCAAGCGTCTCAGTTGAATGCA
GTGGTGGACTTGCAGGACAGAAACACAGAACTGTCTTACCAACTCTTGCTTGAC
TCTCTGGGCGACAGAACCAGATATTTTAGCATGTGGAATCAGGCTGTGGACAGT
TATGATCCTGATGTACGTGTTATTGAAAATCATGGTGTGGAAGATGAACTTCCCA
ACTATTGTTTTCCGTTGGATGGTGTCGGTCCGCAAACAGATAGTTACAAGGAGAT
TAAACCAAATGGAGACCAATCTACTTGGACAAATGTAGACCCAAATGGCAGCAG
TCAACTTGCTAAGGGAAATCCATTTGCCATGGAAATTAACCTTCAAGCCAATCTA
TGGCGAAGTTTCCTTTATTCCAATGTGGCTCTGTATCTCCCAGACTCGTACAAAT
ACACCCCGTCCAATGTCACTCTTCCAGAAAACAAAAACACCTACGACTACATGA
ACGGGCGGGTGGTGCCGCCATCTCTAGTAGACACCTATGTGAACATTGGTGCCA
GGTGGTCTCTGGATGCCATGGACAATGTCAACCCATTCAACCACCACCGTAACG
CTGGCTTGCGTTACCGATCCATGCTTCTGGGTAACGGACGTTATGTGCCTTTCCA
CATACAAGTGCCTCAAAAATTCTTCGCTGTTAAAAACCTGCTGCTTCTCCCAGGC
TCCTACACTTATGAGTGGAACTTTAGGAAGGATGTGAACATGGTTCTACAGAGTT
CCCTCGGTAACGACCTGCGGGTAGATGGCGCCAGCATCAGTTTCACGAGCATCA
ACCTCTATGCTACTTTTTTCCCCATGGCTCACAACACCGCTTCCACCCTTGAAGCC
ATGCTACGGAATGACACCAATGATCAGTCATTCAACGACTACCTATCTGCAGCT
AACATGCTCTACCCCATTCCTGCCAATGCAACCAATATTCCCATTTCCATTCCTTC
TCGCAACTGGGCGGCTTTCAGAGGCTGGTCATTTACCAGACTCAAAACCAAAGA
AACTCCCTCTTTGGGGTCTGGATTTGACCCCTACTTTGTCTATTCTGGTTCTATTC
CCTACCTGGATGGTACCTTCTACCTGAACCACACTTTTAAGAAGGTTTCCATCAT
GTTTGACTCTTCAGTGAGCTGGCCTGGAAATGACAGGTTACTATCTCCTAACGAA
TTTGAAATAAAGCGCACTGTGGATGGCGAAGGCTACAACGTAGCCCAATGCAAC
ATGACCAAAGACTGGTTCTTGGTACAGATGCTCGCCAACTACAACATCGGCTAT
CAGGGCTTCTACATTCCAGAAGGATACAAAGATCGCATGTATTCATTTTTCAGAA
ACTTCCAGCCCATGAGCAGGCAGGTGGTTGATGAGGTCAATTACAAAGACTTCA
AGGCCGTCGCCATACCCTACCAACACAACAACTCTGGCTTTGTGGGTTACATGGC
TCCGACCATGCGCCAAGGTCAACCCTATCCCGCTAACTATCCCTATCCACTCATT
GGAACAACTGCCGTAAATAGTGTTACGCAGAAAAAGTTCTTGTGTGACAGAACC
ATGTGGCGCATACCGTTCTCGAGCAACTTCATGTCTATGGGGCCCTTACAGACT
TGGGACAGAATATGCTCTATGCCAACTCAGCTCATGCTCTGGACATGACCTTTGA
GGTGGATCCCATGGATGAGCCCACCCTGCTTTATCTTCTCTTCGAAGTTTTCGAC
GTGGTCAGAGTGCATCAGCCACACCGCGGCATCATCGAGGCAGTCTACCTGCGT
ACACCGTTCTCGGCCGGTAACGCTACCACGTAAGAAGCTTCTTGCTTCTTGCAAA
TAGCAGCTGCAACCATGGCCTGCGGATCCCAAAACGGCTCCAGCGAGCAAGAGC
TCAGAGCCATTGTCCAAGACCTGGGTTGCGGACCCTATTTTTTGGGAACCTACGA
TAAGCGCTTCCCGGGGTTCATGGCCCCCGATAAGCTCGCCTGTGCCATTGTAAAT
ACGGCCGGACGTGAGACGGGGGGAGAGCACTGGTTGGCTTTCGGTTGGAACCCA
CGTTCTAACACCTGCTACCTTTTTGATCCTTTTGGATTCTCGGATGATCGTCTCAA
ACAGATTTACCAGTTTGAATATGAGGGTCTCCTGCGCCGCAGCGCTCTTGCTACC
AAGGACCGCTGTATTACGCTGGAAAAATCTACCCAGACCGTGCAGGGCCCCCGT
TCTGCCGCCTGCGGACTTTTCTGCTGCATGTTCCTTCACGCCTTTGTGCACTGGCC
TGACCGTCCCATGGACGGAAACCCCACCATGAAATTGCTAACTGGAGTGCCAAA
CAACATGCTTCATTCTCCTAAAGTCCAGCCCACCCTGTGTGACAATCAAAAAGCA
CTCTACCATTTTCTTAATACCCATTCGCCTTATTTTCGCTCTCATCGTACACACAT
CGAAAGGGCCACTGCGTTCGACCGTATGGATGTTCAATAATGACTCATGTAAAC
AACGTGTTCAATAAACATCACTTTATTTTTTTACATGTATCAAGGCTCTGGATTA
CTTATTTATTTACAAGTCGAATGGGTTCTGACGAGAATCAGAATGACCCGCAGG
CAGTGATACGTTGCGGAACTGATACTTGGGTTGCCACTTGAATTCGGGAATCACC
AACTTGGGAACCGGTATATCGGGCAGGATGTCACTCCACAGCTTTCTGGTCAGCT
GCAAAGCTCCAAGCAGGTCAGGAGCCGAAATCTTGAAATCACAATTAGGACCAG
TGCTCTGAGCGCGAGAGTTGCGGTACACCGGATTGCAGCACTGAAACACCATCA
GCGACGGATGTCTCACGCTTGCCAGCACGGTGGGATCTGCAATCATGCCCACAT
CCAGATCTTCAGCATTGGCAATGCTGAACGGGGTCATCTTGCAGGTCTGCCTACC
CATGGCGGGCACCCAATTAGGCTTGTGGTTGCAATCGCAGTGCAGGGGGATCAG
TATCATCTTGGCCTGATCCTGTCTGATTCCTGGATACACGGCTCTCATGAAAGCA
TCATATTGCTTGAAAGCCTGCTGGGCTTTACTACCCTCGGTATAAAACATCCCGC
AGGACCTGCTCGAAAACTGGTTAGCTGCACAGCCGGCATCATTCACACAGCAGC
GGGCGTCATTGTTAGCTATTTGCACCACACTTCTGCCCCAGCGGTTTTGGGTGAT
TTTGGTTCGCTCGGGATTCTCTTTTAAGGCTCGTTGTCCGTTCTCGCTGGCCACAT
CCATCTCGATAATCTGCTCCTTCTGAATCATAATATTGCCATGCAGGCACTTCAG
CTTGCCCTCATAATCATTGCAGCCATGAGGCCACAACGCACAGCCTGTACATTCC
CAATTATGGTGGCGATCTGAGAAAAGAATGTATCATTCCCTGCAGAAATCTT
CCCATCATCGTGCTCAGTGTCTTGTGACTAGTGAAAGTTAACTGGATGCCTCGGT
GCTCCTCGTTTACGTACTGGTGACAGATGCGCTTGTATTGTTCGTGTTGCTCAGG
CATTAGTTTAAAAGAGGTCCTAAGTTCGTTATCCAGCCTGTACTTCTCCATCAGC
AGACACATCACTTCCATGCCTTTCTCCCAAGCAGACACCAGGGGCAAGCTAATC
GGATTCTTAACAGTGCAGGCAGCAGCTCCTTTAGCCAGAGGGTCATCTTTAGCG
ATCTTCTCAATGCTTCTTTTGCCATCCTTCTCAACGATGCGCACGGGCGGGTAGC
TGAAACCCACTGCTACAAGTTGCGCCTCTTCTCTTTCTTCTTCGCTGTCTTGACTG
ATGTCTTGCATGGGATATGTTTGGTCTTCCTTGGCTTCTTTTTGGGGGGTATCGG
AGGAGGAGGACTGTCGCTCCGTTCCGGAGACAGGGAGGATTGTGACGTTTCGCT
CACCATTACCAACTGACTGTCGGTAGAAGAACCTGACCCCACACGGCGACAGGT
```

TABLE 7-continued

Nucleic Acid Sequences of Vectors

SEQ ID NO Sequence

GTTTCTCTTCGGGGGCAGAGGTGGAGGCGATTGCGAAGGGCTGCGGTCCGACCT
GGAAGGCGGATGACTGGCAGAACCCCTTCCGCGTTCGGGGGTGTGCTCCCTGTG
GCGGTCGCTTAACTGATTTCCTTCGCGGCTGGCCATTGTGTTCTCCTAGGCAGAG
AAACAACAGACATGGAAACTCAGCCATTGCTGTCAACATCGCCACGAGTGCCAT
CACATCTCGTCCTCAGCGACGAGGAAAAGGAGCAGAGCTTAAGCATTCCACCGC
CCAGTCCTGCCACCACCTCTACCCTAGAAGATAAGGAGGTCGACGCATCTCATG
ACATGCAGAATAAAAAAGCGAAAGAGTCTGAGACAGACATCGAGCAAGACCCG
GGCTATGTGACACCGGTGGAACACGAGGAAGAGTTGAAACGCTTTCTAGAGAGA
GAGGATGAAAACTGCCCAAAACAGCGAGCAGATAACTATCACCAAGATGCTGG
AAATAGGGATCAGAACACCGACTACCTCATAGGGCTTGACGGGGAAGACGCGCT
CCTTAAACATCTAGCAAGACAGTCGCTCATAGTCAAGGATGCATTATTGGACAG
AACTGAAGTGCCTATCAGTGTGGAAGAGCTCAGCCGCGCCTACGAGCTTAACCT
CTTTTCACCTCGTACTCCACCCAAACGTCAGCCAAACGGCACCTGCGAGCCAAAT
CCTCGCTTAAACTTTTATCCAGCTTTTGCTGTGCCAGAAGTACTGGCTACCTATC
ACATCTTTTTTAAAAATCAAAAAATTCCAGTCTCCTGCCGCGCTAATCGCACCCG
CGCCGATGCCCTACTCAATCTGGGACCTGGTTCACGCTTACCTGATATAGCTTCC
TTGGAAGAGGTTCCAAAGATCTTCGAGGGTCTGGGCAATAATGAGACTCGGGCC
GCAAATGCTCTGCAAAAGGGAGAAAATGGCATGGATGAGCATCACAGCGTTCTG
GTGGAATTGGAAGGCGATAATGCCAGACTCGCAGTACTCAAGCGAAGCATCGAG
GTCACACACTTCGCATATCCCGCTGTCAACCTGCCCCCTAAAGTCATGACGGCGG
TCATGGACCAGTTACTCATTAAGCGCGCAAGTCCCCTTTCAGAAGACATGCATG
ACCCAGATGCCTGTGATGAGGGTAAACCAGTGGTCAGTGATGAGCAGCTAACCC
GATGGCTGGGCACCGACTCTCCCCGGGATTTGGAAGAGCGTCGCAAGCTTATGA
TGGCCGTGGTGCTGGTTACCGTAGAACTAGAGTGTCTCCGACGTTTCTTTACCGA
TTCAGAAACCTTGCGCAAACTCGAAGAGAATCTGCACTACACTTTTAGACACGG
CTTTGTGCGGCAGGCATGCAAGATATCTAACGTGGAACTCACCAACCTGGTTTCC
TACATGGGTATTCTGCATGAGAATCGCCTAGGACAAAGCGTGCTGCACAGCACC
CTTAAGGGGGAAGCCCGCCGTGATTACATCCGCGATTGTGTCTATCTCTACCTGT
GCCACACGTGGCAAACCGGCATGGGTGTATGGCAGCAATGTTTAGAAGAACAGA
ACTTGAAAGAGCTTGACAAGCTCTTACAGAAATCTCTTAAGGTTCTGTGGACAG
GGTTCGACGAGCGCACCGTCGCTTCCGACCTGGCAGACCTCATCTTCCCAGAGC
GTCTCAGGGTTACTTTGCGAAACGGATTGCCTGACTTTATGAGCCAGAGCATGCT
TAACAATTTTCGCTCTTTCATCCTGGAACGCTCCGGTATCCTGCCCGCCACCTGCT
GCGCACTGCCCTCCGACTTTGTGCCTCTCACCTACCGCGAGTGCCCCCCGCCGCT
ATGGAGTCACTGCTACCTGTTCCGTCTGGCCAACTATCTCTCCTACCACTCGGAT
GTGATCGAGGATGTGAGCGGAGACGGCTTGCTGGAGTGTCACTGCCGCTGCAAT
CTGTGCACGCCCCACCGGTCCCTAGCTTGCAACCCCCAGTTGATGAGCGAAACC
CAGATAATAGGCACCTTTGAATTGCAAGGCCCCAGCGGCCAAGGCGATGGGTCT
TCTCCTGGGCAAAGTTTAAAACTGACCCCGGGACTGTGGACCTCCGCCTACTTGC
GCAAGTTTGCTCCGGAAGATTACCACCCCTATGAAATCAAGTTCTATGAGGACC
AATCACAGCCTCCAAAGGCCGAACTTTCGGCCTGCGTCATCACCCAGGGGGCAA
TTCTGGCCCAATTGCAAGCCATCCAAAAATCCCGCCAAGAATTTCTACTGAAAA
AGGGTAAGGGGGTCTACCTTGACCCCCAGACCGGCGAGGAACTCAACACAAGGT
TCCCTCAGGATGTCCCAACGACGAGAAAACAAGAAGTTGAAGGTGCAGCCGCCG
CCCCCAGAAGATATGGAGGAAGATTGGGACAGTCAGGCAGAGGAGGCGGAGGA
GGACAGTCTGGAGGACAGTCTGGAGGAAGACAGTTTGGAGGAGGAAAACGAGG
AGGCAGAGGAGGTGGAAGAAGTAACCGCCGACAAACAGTTATCCTCGGCTGCG
GAGACAAGCAACAGCGCTACCATCTCCGCTCCGAGTCGAGGAACCCGGCGGCGT
CCCAGCAGTAGATGGGACGAGACCGGACGCTTCCCGAACCCAACCAGCGCTTCC
AAGACCGGTAAGAAGGATCGGCAGGGATACAAGTCCTGGCGGGGGCATAAGAA
TGCCATCATCTCCTGCTTGCATGAGTGCGGGGGCAACATATCCTTCACGCGGCGC
TACTTGCTATTCCACCATGGGGTGAACTTTCCGCGCAATGTTTTGCATTACTACC
GTCACCTCCACAGCCCCTACTATAGCCAGCAAATCCCGGCAGTCTCGACAGATA
AAGACAGCGGCGGCGACCTCCAACAGAAAACCAGCAGCGGCAGTTAGAAAATA
CACAACAAGTGCAGCAACAGGAGGATTAAAGATTACAGCCAACGAGCCAGCGC
AAACCCGAGAGTTAAGAAATCGGATCTTTCCAACCCTGTATGCCATCTTCCAGCA
GAGTCGGGGTCAAGAGCAGGAACTGAAAATAAAAAACCGATCTCTGCGTTCGCT
CACCAGAAGTTGTTTGTATCACAAGAGCGAAGATCAACTTCAGCGCACTCTCGA
GGACGCCGAGGCTCTCTTCAACAAGTACTGCGCGCTGACTCTTAAAGAGTAGGC
AGCGACCGCGCTTATTCAAAAAAAGGCGGGAATTACATCATCCTCGACATGAGT
AAAGAAATTCCCACGCCTTACATGTGGAGTTATCAACCCAAATGGGATTGGCG
GCAGGCGCCTCCCAGGACTACTCCACCCGCATGAATTGGCTCAGCGCCGGGCCT
TCTATGATTTCTCGAGTTAATGATATACGCGCCTACCGAAACCAAATACTTTTGG
AACAGTCAGCTCTTACCACCACGCCCCGCCAACACCTTAATCCCAGAAATTGGC
CCGCCGCCCTAGTGTACCAGGAAAGTCCCGCTCCCACCACTGTATTACTTCCTCG
AGACGCCCAGGCCGAAGTCCAAATGACTAATGCAGGTGCGCAGTTAGCTGGCGG
CTCCACCCTATGTCGTCACAGGCCTCGGCATAATATAAAACGCCTGATGATCAG
AGGCCGAGGTATCCAGCTCAACGACGAGTCGGTGAGCTCTCCGCTTGGTCTACG
ACCAGACGGAATCTTTCAGATTGCCGGCTGCGGGAGATCTTCCTTCACCCCTCGT
CAGGCTGTTCTGACTTTGGAAAGTTCGTCTTCGCAACCCCGCTCGGGCGGAATCG
GGACCGTTCAATTTGTGGAGGAGTTTACTCCCTCTGTCTACTTCAACCCCTTCC
GGATCTCCTGGGCACTACCCGGACGAGTTCATACCGAACTTCGACGCGATTAGC
GAGTCAGTGGACGGCTACGATTGATGTCTGGTGACGCGGCTGAGCTATCTCGGC
TGCGACATCTAGACCACTGCCGCCGCTTTCGCTGCTTTGCCCGGGAACTCATTGA
GTTCATCTACTTCGAACTCCCCAAGGATCACCCTCAAGGTCCGGCCCACGGAGTG
CGGATTTCTATCGAAGGCAAAATAGACTCTCGCCTGCAACGAATTTTCTCCCAGC

TABLE 7-continued

Nucleic Acid Sequences of Vectors

SEQ ID NO Sequence

```
GGCCCGTGCTGATCGAGCGAGACCAGGGAAACACCACGGTTTCCATCTACTGCA
TTTGTAATCACCCCGGATTGCATGAAAGCCTTTGCTGTCTTATGTGTACTGAGTTT
AATAAAAACTGAATTAAGACTCTCCTACGGACTGCCGCTTCTTCAACCCGGATTT
TACAACCAGAAGAACGAAACTTTTCCTGTCGTCCAGGACTCTGTTAACTTCACCT
TTCCTACTCACAAACTAGAAGCTCAACGACTACACCGCTTTTCCAGAAGCATTTT
CCCTACTAATACTACTTTCAAAACCGGAGGTGAGCTCCAAGGTCTTCCTACAGAA
AACCCTTGGGTGGAAGCGGGCCTTGTAGTGCTAGGAATTCTTGCGGGTGGGCTT
GTGATTATTCTTTGCTACCTATACACACCTTGCTTCACTTTCTTAGTGGTGTTGTG
GTATTGGTTTAAAAAATGGGGCCCATACTAATCTTGCTTGTTTTACTTTCGCTTTT
GGAACCGGGTTCTGCCAATTACGATCCATGTCTAGACTTTGACCCAGAAAACTG
CACACTTACTTTTGCACCCGACACAAGCCGCATCTGTGGAGTTCTTATTAAGTGC
GGATGGGAATGCAGGTCCGTTGAAATTACACACAATAACAAAACCTGGAACAAT
ACCTTATCCACCACATGGGAGCCAGGAGTTCCCGAGTGGTACACTGTCTCTGTCC
GAGGTCCTGACGGTTCCATCCGCATTAGTAACAACACTTTCATTTTTTCTGAAAT
GTGCGATCTGGCCATGTTCATGAGCAAACAGTATTCTCTATGGCCTCCTAGCAAG
GACAACATCGTAACGTTCTCCATTGCTTATTGCTTGTGCGCTTGCCTTCTTACTGC
TTTACTGTGCGTATGCATACACCTGCTTGTAACCACTCGCATCAAAAACGCCAAT
AACAAAGAAAAAATGCCTTAACCTCTTTCTGTTTACAGACATGGCTTCTCTTACA
TCTCTCATATTTGTCAGCATTGTCACTGCCGCTCATGGACAAACAGTCGTCTCTA
TCCCTCTAGGACATAATTACACTCTCATAGGACCCCCAATCACTTCAGAGGTCAT
CTGGACCAAACTGGGAAGCGTTGATTACTTTGATATAATCTGCAACAAAACAAA
ACCAATAATAGTAACTTGCAACATACAAAATCTTACATTGATTAATGTTAGCAA
AGTTTACAGCGGTTACTATTATGGTTATGACAGATACAGTAGTCAATATAGAAAT
TACTTGGTTCGTGTTACCCAGTTGAAAACCACGAAAATGCCAAATATGGCAAAG
ATTCGATCCGATGACAATTCTCTAGAAACTTTTACATCTCCCACCACACCCGACG
AAAAAAAACATCCCAGATTCAATGATTGCAATTGTTGCAGCGGTGGCAGTGGTGA
TGGCACTAATAATAATATGCATGCTTTTATATGCTTGTCGCTACAAAAAGTTTCA
TCCTAAAAAACAAGATCTCCTACTAAGGCTTAACATTTAATTTCTTTTTATACAG
CCATGGTTTCCACTACCACATTCCTTATGCTTACTAGTCTCGCAACTCTGACTTCT
GCTCGCTCACACCTCACTGTAACTATAGGCTCAAACTGCACACTAAAAGGACCT
CAAGGTGGTCATGTCTTTTGGTGGAGAATATATGACAATGGATGGTTTACAAAA
CCATGTGACCAACCTGGTAGATTTTTCTGCAACGGCAGAGACCTAACCATTATCA
ACGTGACAGCAAATGACAAAGGCTTCTATTATGGAACCGACTATAAAAGTAGTT
TAGATTATAACATTATTGTACTGCCATCTACCACTCCAGCACCCCGCACAACTAC
TTTCTCTAGCAGCAGTGTCGCTAACAATACAATTTCCAATCCAACCTTTGCCGCG
CTTTTAAAACGCACTGTGAATAATTCTACAACTTCACATACAACAATTTCCACTT
CAACAATCAGCATTATCGCTGCAGTGACAATTGGAATATCTATTCTTGTTTTTAC
CATAACCTACTACGCCTGCTGCTATAGAAAAGACAAACATAAAGGTGATCCATT
ACTTAGATTTGATATTTAATTTGTTCTTTTTTTTATTTACAGTATGGTGAACACC
AATCATGGTACCTAGAAATTTCTTCTTCACCATACTCATTTGTGCATTTAATGTTT
GCGCTACTTTCACAGCAGTAGCCACAGCAACCCCAGACTGTATAGGAGCATTTG
CTTCCTATGCACTTTTTGCTTTTGTTACTTGCATCTGCGTATGTAGCATAGTCTGC
CTGGTTATTAATTTTTTCCAACTTCTAGACTGGATCCTTGTGCGAATTGCCTACCT
GCGCCACCATCCCGAATACCGCAACCAAAATATCGCGGCACTTCTTAGACTCAT
CTAAAACCATGCAGGCTATACTACCAATATTTTTGCTTCTATTGCTTCCCTACGCT
GTCTCAACCCCAGCTGCCTATAGTACTCCACCAGAACACCTTAGAAAATGCAAA
TTCCAACAACCGTGGTCATTTCTTGCTTGCTATCGAGAAAAATCAGAAATTCCCC
CAAATTTAATAATGATTGCTGGAATAATTAATATAATCTGTTGCACCATAATTTC
ATTTTTGATATACCCCCTATTTGATTTTGGCTGGAATGCTCCCAATGCACATGATC
ATCCACAAGACCCAGAGGAACACATTCCCCTACAAAACATGCAACATCCAATAG
CACTAATAGATTACGAAAGTGAACCACAACCCCCACTACTCCCTGCTATTAGTTA
CTTCAACCTAACCGGCGGAGATGACTGAAACACTCACCACCTCCAATTCCGCCG
AGGATCTGCTCGATATGGACGGCCGCGTCTCAGAACAGCGACTCGCCCAACTAC
GCATCCGCCAGCAGCAGGAACGCGCGGCCAAAGAGCTCAGAGATGTCATCCAA
ATTCACCAATGCAAAAAAGGCATATTCTGTTTGGTAAAACAAGCCAAGATATCC
TACGAGATCACCGCTACTGACCATCGCCTCTCTTACGAACTTGGCCCCCAACGAC
AAAAATTTACCTGCATGGTGGGAATCAACCCCATAGTTATCACCCAGCAAAGTG
GAGATACTAAGGGTTGCATTCACTGCTCCTGCGATTCCATCGAGTGCACCTACAC
CCTGCTGAAGACCCTATGCGGCCTAAGAGACCTGCTACCAATGAATTAAAAAAT
GATTAATAAAAAATCACTTACTTGAAATCAGCAATAAGGTCTCTGTTGAAATTTT
CTCCCAGCAGCACCTCACTTCCCTCTTCCCAACTCTGGTATTCTAAACCCCGTTCA
GCGGCATACTTTCTCCATACTTTAAAGGGGATGTCAAATTTTAGCTCCTCTCCTG
TACCCACAATCTTCATGTCTTTCTTCCCAGATGACCAAGAGAGTCCGGCTCAGTG
ACTCCTTCAACCCTGTCTACCCCTATGAAGATGAAAGCACCTCCCAACACCCCTT
TATAAACCCAGGGTTTATTTCCCCAAATGGCTTCACACTAAGCCCAGACGGAGTT
CTTACTTTAAAATGTTTAACCCCACTAACAACCACAGGCGGATCTCTACAGCTAA
AAGTGGGAGGGGGACTTACAGTGGATGACACCAACGGTTTTTTGAAAGAAAACA
TAAGTGCCACCACACCACTCGTTAAGACTGCTCACTCTATAGGTTTACCACTAGG
AGCCGGATTGGGAACGAATGAAATAAACTTTGTATCAAATTAGGACAAGGACT
TACATTCAATTCAAACAACATTTGCATTGATGATAATATTAACACCTTATGGACA
GGAGTCAACCCCACCGAAGCCAACTGTCAAATCATGAACTCCAGTGAATCTAAT
GATTGCAAATTAATTCTAACACTAGTTAAAACTGGAGCACTAGTCACTGCATTTG
TTTATGTTATAGGAGTATCTAACAATTTTAATATGCTAACTACACACAGAAATAT
AAATTTTACTGCAGAGCTGTTTTTCGATTCTACTGGTAATTTACTAACTAGACTCT
CATCCCTCAAAACTCCACTTAATCATAAATCAGGACAAAACATGGCTACTGGTG
CCATTACTAATGCTAAAGGTTTCATGCCCAGCACGACTGCCTATCCTTTCAATGA
```

TABLE 7-continued

Nucleic Acid Sequences of Vectors

| SEQ ID NO | Sequence |
|---|---|
| | TAATTCTAGAGAAAAAGAAAACTACATTTACGGAACTTGTTACTACACAGCTAG<br>TGATCACACTGCTTTTCCCATTGACATATCTGTCATGCTTAACCGAAGAGCAATA<br>AATGACGAGACATCATATTGTATTCGTATAACTTGGTCCTGGAACACAGGAGAT<br>GCCCCAGAGGTGCAAACCTCTGCTACAACCCTAGTCACCTCCCCATTTACCTTTT<br>ACTACATCAGAGAAGACGACTGACAAATAAAGTTTAACTTGTTTATTTGAAAAT<br>CAATTCACAAAATCCGAGTAGTTATTTTGCCTCCCCCTTCCCATTTAACAGAATA<br>CACCAATCTCTCCCCACGCACAGCTTTAAACATTTGGATACCATTAGATATAGAC<br>ATGGTTTTAGATTCCACATTCCAAACAGTTTCAGAGCGAGCCAATCTGGGGTCAG<br>TGATAGATAAAAATCCATCGGGATAGTCTTTTAAAGCGCTTTCACAGTCCAACTG<br>CTGCGGATGCGACTCCGGAGTCTGGATCACGGTCATCTGGAAGAAGAACGATGG<br>GAATCATAATCCGAAAACGGTATCGGACGATTGTGTCTCATCAAACCCACAAGC<br>AGCCGCTGTCTGCGTCGCTCCGTGCGACTGCTGTTTATGGGATCAGGGTCCACAG<br>TGTCCTGAAGCATGATTTTAATAGCCCTTAACATCAACTTTCTGGTGCGATGCGC<br>GCAGCAACGCATTCTGATTTCACTCAAATCTTTGCAGTAGGTACAGCACATTATT<br>ACAATATTGTTTAATAAACCATAATTAAAAGCGCTCCAGCCAAAACTCATATCTG<br>ATATAATCGCCCCTGCATGACCATCATACCAAAGTTTAATATAAATTAAATGACG<br>TTCCCTCAAAAACACACTACCCACATACATGATCTCTTTTGGCATGTGCATATTA<br>ACAATCTGTCTGTACCATGGACAACGTTGGTTAATCATGCAACCCAATATAACCT<br>TCCGGAACCACACTGCCAACACCGCTCCCCCAGCCATGCATTGAAGTGAACCCT<br>GCTGATTACAATGACAATGAAGAACCCAATTCTCTCGACCGTGAATCACTTGAG<br>AATGAAAAATATCTATAGTGGCACAACATAGACATAAATGCATGCATCTTCTCA<br>TAATTTTTAACTCCTCAGGATTTAGAAACATATCCCAGGGAATAGGAAGCTCTTG<br>CAGAACAGTAAAGCTGGCAGAACAAGGAAGA |
| SEQ ID<br>NO: 1426 | CATCATCAATAATATACCTTATAGATGGAATGGTGCCAATATGTAAATGAGGTG<br>ATTTTAAAAATTGCGGGGTGTGTGGTGATTGGCTGTGTGGTTAACGGCTAAAAG<br>GGGCGGCGCGGCCGTGGGAAAATGACGTTTTTTGGGGGTGGAGTTTTTTTGCAA<br>GTTGTCGCGGGAAATGTGACGTATACAAAGGCTTTTTTCTCACGGAACTACTTAG<br>TTTTCCCCACGGTATTTAACAGGAAATGAGGTAGTTTTGGCCGGATGCAAGTGA<br>AAACTGTTCATTTTCGCGCGAAAACTGAATGAGGAAGTGTTTTTCTGAATAATGT<br>GGTATTTATGGCAGGGTGGAGTATTTGTTCAGGGCCAGGTAGACTTTGACCCATT<br>ACGTGGAGGTTTCGATTACCGTGTTTTTTACCTGAATTTCCGCGTACCGTGTCAA<br>AGTCTTCTGTTTTTACGTAGGTGTCAGCTGATCGCTAGGGTATTTATACCTCAGG<br>GTTTGTGTCAAGAGGCCACTCTTGAGTGCCAGCGAGAAGAGTTTTCTCCTCTGCG<br>CCGGCAGTTTAATAATAAAAAAAAATGAGAGATTTGCGATTTCTGCCTCAGGAA<br>ATAATCTCTGCTGAGACTGGAAATGAAATATTGGAGCTTGTGGTGCACGCCCTA<br>ATGGGAGACGATCCGGAGCCACCTGTGCAGCTTTTTGAGCCTCCTACGCTTCAGG<br>AACTGTATGATTTAGAGGTAGAGGGATCGGAGGATTCTAATGAGGAAGCTGTGA<br>ATGGCTTTTTTACCGATTCTGTGCTTTTAGCTGCTAATGAAGGATTAGAATTAGA<br>TCCGCCTTTGGACACTTTTGATACTCCAGGGGTGATTGTGGAAAGCGGTACAGGT<br>GTAAGAAAATTACCTGATTTGGGTTCCGTGGACTGTGATTTGCACTGCTATGAAG<br>ACGGGTTTCCTCCGAGTGATGAGGAGGACCATGAAAAGGAGCAGTCTATGCAGA<br>CTGCAGCGGGTGAGGGAGTGAAGGCTGCCAGTGTTGGTTTTCAGTTGGATTGCC<br>CGGAGCTTCCTGGACATGGCTGTAAGTCTTGTGAATTTCACAGGAAAATACTG<br>GAGTAAAGGAACTGTTATGTTCGCTTTGTTATATGAGAACGCACTGCCACTTTAT<br>TTACAGTAAGTGTGTTTAAGTTAAAATTTAAAGGAATATGCTGTTTTTCACATGT<br>ATATTGAGTGGGAGTTTTGTGTTTCTTATTATAGGTCCTGTGTCTGATGCTGATGA<br>ATCACCATCTCCTGATTCTACTACCTCACCTCCTGAGATTCAAGCACCTGTTCCTG<br>TGGACGTGCGCAAGCCCATTCCTGTGAAGCCTAAGCCTGGGAAACGTCCAGCAG<br>TGGAGAAACTTGAGGACTTGTTACAGGGTGGGGACGGACCTTTGGACTTGAGTA<br>CACGGAAACGTCCAAGACAATAAGTGTTCCATATCCGTGTTTACTTAAGGTGAC<br>GTCAATATTTGTGTGAGAGTGCAATGTAATAAAAATATGTTAACTGTTCACTGGT<br>TTTTATTGCTTTTTGGGCGGGGACTCAGGTATATAAGTAGAAGCAGACCTGTGTG<br>GTTAGCTCATAGGAGCTGGCTTTCATCCATGGAGGTTTGGGCCATTTTGGAAGAC<br>CTTAGGAAGACTAGGCAACTGTTGGAGAACGCTTCGGACGGAGTCTCCGGTTTT<br>TGGAGATTCTGGTTCGCTAGTGAATTAGCTAGGGTAGTTTTTAGGATAAAACAG<br>GACTATAAAGAAGAATTTGAAAAGTTGTTGGTAGATTGCCCAGGACTTTTTGAA<br>GCTCTTAATTTGGGCCATCAGGTTCACTTTAAAGAAAAAGTTTTATCAGTTTTAG<br>ATTTTTCAACCCCAGGTAGAACTGCCGCTGCTGTGGCTTTTCTTACTTTTATATTA<br>GACAAATGGATCCCGCAGACTCATTTCAGCAGGGGATACGTTTTGGATTTCATA<br>GCCACAGCATTGTGGAGAACATGGAAGGTTCGCAAGATGAGGACAATCTTAGGT<br>TACTGGCCAGTGCAGCCTTTGGGTGTAGCGGGAATCCTGAGGCATCCACCTGTC<br>ATGCCAGCGGTTCTGGAGGAGGAACAGCAAGAGGACAATCCGAGAGCCGGCCT<br>GGACCCTCCAGTGGAGGAGGCGGAGTAGCTGACTTGTCTCCTGAACTGCAACGG<br>GTGCTTACTGGATCTACGTCCACTGGACGGGATAGGGCGTTAAGAGGGAGAGG<br>GCATCCAGTGGTACTGATGCTAGATCTGAGTTGGCTTTAAGTTTAATGTCTCGCA<br>GACGTCCTGAAACCATTTGGTGGCATGAGGTTCAGAAAGAGGGAAGGGATGAA<br>GTTTCTGTATTGCAGGAGAAATATTCACTGGAACAGGTGAAAACATGTTGGTTG<br>GAGCCAGAGGATGATTGGGAGGTGGCCATTAAAAATTATGCGAAGATAGCTTTG<br>AGGCCTGATAAGCAGTATAAGATTACTAGACGGATTAATATCCGGAATGCTTGT<br>TACATATCTGGAAATGGGGCTGAGGTGGTAATAGATACTCAAGACAAGACAGTT<br>ATTAGATGCTGCATGATGGATATGTGGCCTGGAGTAGTCGGTATGGAAGCAGTC<br>ACTTTTGTAAATGTTAAGTTTAGGGGAGATGGTTATAATGGAATAGTGTTTATGG<br>CCAATACCAAACTTATATTGCATGGTTGTAGCTTTTTGGTTTCAACAATACCTGT<br>GTAGATGCCTGGGGACAGGTTAGTGTGCGGGGGTGTAGTTTCTATGCGTGTTGG<br>ATTGCCACAGCAGGCAGAACCAAGAGTCAATTGTCTCTGAAGAAATGCATATTC |

TABLE 7-continued

Nucleic Acid Sequences of Vectors

SEQ ID NO Sequence

CAAAGATGTAACCTGGGCATTCTGAATGAAGGCGAAGCAAGGGTCCGCCACTGC
GCTTCTACAGATACTGGATGTTTTATTTTAATTAAGGGAAATGCCAGCGTAAAGC
ATAACATGATTTGCGGTGCTTCCGATGAGAGGCCTTATCAAATGCTCACTTGTGC
TGGTGGGCATTGTAATATGCTGGCTACTGTGCATATTGTTTCCCACCAACGCAAA
AAATGGCCTGTTTTTGATCACAATGTGTTGACCAAGTGCACCATGCATGCAGGTG
GGCGTAGAGGAATGTTTATGCCTTACCAGTGTAACATGAATCATGTGAAAGTGT
TGTTGGAACCAGATGCCTTTTCCAGAATGAGCCTAACAGGAATCTTTGACATGA
ACACGCAAATCTGGAAGATCCTGAGGTATGATGATACGAGATCAAGGGTGCGCG
CATGCGAATGCGGAGGCAAGCATGCCAGGTTCCAGCCGGTGTGTGTAGATGTGA
CGGAAGATCTCAGACCGGATCATTTGGTTATTGCCCGCACTGGAGCAGAGTTCG
GATCCAGTGGAGAAGAAACTGACTAAGGTGAGTATTGGGGAAACTTTGGGGTGG
GATTTTCAGATAGACAGATTGAGTAAAAATTTGTTTTTTCTGTCTTGCAGCTGTC
ATGAGTGGAAACGCTTCTTTTAAGGGGGGAGTCTTCAGCCCTTATCTGACAGGG
CGTCTCCCATCCTGGGCAGGAGTTCGTCAGAATGTTATGGGATCTACTGTGGATG
GAAGACCCGTCCAACCCGCCAATTCTTCAACGCTGACCTATGCTACTTTAAGTTC
TTCACCTTTGGACGCAGCTGCAGCCGCCGCCGCCGCCTCTGTCGCCGCTAACACT
GTGCTTGGAATGGGTTACTATGGAAGCATCGTGGCTAATTCCACTTCCTCTAATA
ACCCTTCTACCCTGACTCAGGACAAGTTACTTGTCCTTTTGGCCCAGCTGGAGGC
TTTGACCCAACGTCTGGGTGAACTTTCTCAGCAGGTGGCCGAGTTGCGAGTACA
AACTGAGTCTGCTGTCGGCACGGCAAAGTCTAAATAAAAAAATTCCAGAATCAA
TGAATAAATAAACGAGCTTGTTGTTGATTTAAATCAAGTGTTTTTATTTCATTTTT
CGCGCACGGTATGCCCTAGACCACCGATCTCGATCATTGAGAACTCGGTGGATTT
TTTCCAGAATCCTATAGAGGTGGGATTGAATGTTTAGATACATGGGCATTAGGCC
ATCTTTGGGGTGGAGATAGCTCCATTGAAGGGATTCATGCTCCGGGGTAGTGTTG
TAAATCACCCAGTCATAACAAGGTCGCAGTGCATGGTGTTGCACAATATCTTTTA
GAAGTAGGCTGATTGCCACAGATAAGCCCTTGGTGTAGGTGTTTACAAACCGGT
TGAGCTGGGAGGGGTGCATTCGGGGTGAAATTATGTGCATTTTGGATTGGATTTT
TAAGTTGGCGATATTGCCGCCAAGATCCCGTCTTGGGTTCATGTTATGAAGGACC
ACCAAGACGGTGTATCCGGTACATTTAGGAAATTTGTCATGTAGCTTGGATGGA
AAAGCGTGGAAAAATTTGGAGACACCCTTGTGTCCTCCGAGATTTTCCATGCACT
CATCCATGATAATAGCAATGGGGCCGTGGGCAGCGGCGCGGGCAAACACGTTCC
GTGGGTCTGACACATCATAGTTATGTTCCTGAGTTAAATCATCATAAGCCATTTT
AATGAATTTGGGGCGGAGAGTACCAGATTGGGGTATGAATGTTCCTTCGGGCCC
CGGAGCATAGTTTCCCTCACAGATTTGCATTTCCCAAGCTTTCAGTTCCGAGGGT
GGAATCATGTCCACCTGGGGGGCTATGAAAAACACCGTTTCTGGGGCGGGGGTG
ATTAGTTGGGATGATAGCAAATTTCTGAGCAATTGAGATTTGCCACATCCGGTGG
GGCCATATATGATTCCGATTACAGGTTGCAGATGGTAGTTTAGGGAACGGCAAC
TGCCGTCTTCTCGAAGCAAGGGGGCCACCTCGTTCATCATTTCCCTTACATGCAT
ATTTTCCCGCACCAAATCCATTAGGAGGCGCTCTCCTCCTAGTGATAGAAGTTCT
TGTAGTGAGGAAAAGTTTTTCAGCGGTTTTAGACCGTCAGCCATGGGCATTTTGG
AGAGAGTTTGCTGCAAAAGTTCTAGTCTGTTCCACAGTTCAGTGATGTGTTCTAT
GGCATCTCGATCCAGCAGACCTCCTCGTTTCGCGGGTTTGGACGGCTCCTGGAGT
AGGGTATGAGACGATGGGCGTCCAGCGCTGCCAGGGTTCGGTCCTTCCAGGGTC
TCAGTGTTCGAGTCAGGGTTGTTTCCGTCACAGTGAAGGGGTGTGCGCCTGCTTG
GGCGCTTGCCAGGGTGCGCTTCAGACTCATTCTGCTGGTCGAGAACTTCTGTCGC
TTGGCGCCCTGTATGTCGGCCAAGTAGCAGTTTACCATGAGTTCGTAGTTGAGCG
CCTCGGCTGCGTGGCCTTTGGCGCGTAGCTTACCTTTGGAAGTTTTCTTGCATAC
CGGGCAGTATAGGCATTTCAGCGCATACAGCTTGGGCGCGAGGAAAATGGATTC
TGGGGAGTATGCATCCGCGCCGCAGGAGGCGCAAACAGTTTCACATTCCACCAG
CCAGGTTAAATCCGGTTCATTGGGGTCAAAAACAAGTTTTCCGCCATATTTTTTG
ATGCGTTTCTTACCTTTGCTCTCCATAAGTTCGTGTCCTCGTTGAGTGACAAACA
GGCTGTCCGTATCCCCGTAGACTGATTTTACAGGCCTCTTCTCCAGTGGTGTGCC
TCGGTCTTCTTCGTACAGGAACTCTGACCACTCTGATACAAAGGCGCGCGTCCAG
GCCAGCACAAAGGAGGCTATGTGGGAGGGGTAGCGATCGTTGTCAACCAGGGG
GTCCACCTTTTCCAAAGTATGCAAACACATGTCACCCTCTTCAACATCCAGGAAT
GTGATTGGCTTGTAGGTGTATTCACGTGACCTGGGGTCCCCGCTGGGGGGGTAT
AAAAGGGGGCGGTTCTTTGCTCTTCCTCACTGTCTTCCGGATCGCTGTCCAGGAA
CGTCAGCTGTTGGGGTAGGTATTCCCTCTCGAAGGCGGGCATGACCTCTGCACTC
AGGTTGTCAGTTTCTAAGAACGAGGAGGATTTGATATTGACAGTGCCGGTTGAG
ATGCCTTTCATGAGGTTTTCGTCCATTTGGTCAGAAAACACAATTTTTTATTGTC
AAGTTTGGTGGCAAATGATCCATACAGGGCGTTGGATAAAGTTTGGCAATGGA
TCGCATGGTTTGGTTCTTTTCCTTGTCCGCGCGCTCTTTGGCAGCGATGTTGAGTT
GGACATACTCGCGTGCCAGGCACTTCATTCGGGGAAGATAGTTGTCAATTCATC
TGGCACGATTCTCACTTGCCACCCTCGATTATGCAGGGTAATTAAATCCACACTG
GTGGCCACCTCGCCTCGAAGGGGTTCGTTGGTCCAACAGAGCCTACCTCCTTTCC
TAGAACAGAAAGGGGGAAGTGGGTCTAGCATAAGTTCATCGGGAGGGTCTGCAT
CCATGGTAAAGATTCCAGGAAGTAAATCCTTATCAAAATAGCTGATGGGAGTGG
GGTCATCTAAGGCCATTTGCCATTCTCGAGCTGCCAGTGCGCGCTCATATGGGTT
AAGAGGACTGCCCCAGGGCATGGGATGGGTGAGTGCAGAGGCATACATGCCAC
AGATGTCATAGACGTAGATGGGATCCTCAAAGATGCCTATGTAGGTTGGATAGC
ATCGCCCCCTCTGATACTTGCTCGCACATAGTCATATAGTTCATGTGATGGCGC
CAGCAGCCCCGGACCCAAGTTGGTACGATTGGGTTTTTCTGTTCTGTAGACAATC
TGGCGAAAGATGGCGTGAGAATTGAAGAGATGGTGGGTCTTTGAAAAATGTTG
AAATGGGCATGAGGTAGACCTACAGAGTCTCTGACAAAGTGGGCATAAGATTCT
TGAAGCTTGGTTACCAGTTCGGCGGTGACAAGTACGTCCAGGGCGCAGTAGTCA
AGTGTTTCTTGAATGATGTCATAACCTGGTTGGTTTTCTTTTCCCACAGTTCGCG

TABLE 7-continued

Nucleic Acid Sequences of Vectors

SEQ ID NO Sequence

GTTGAGAAGGTATTCTTCGCGATCCTTCCAGTATTCTTCTAGCGGAAACCCGTCT
TTGTCTGCACGGTAAGATCCTAGCATGTAGAACTGATTAACTGCCTTGTAAGGGC
AGCAGCCCTTCTCTACGGGTAGAGAGTATGCTTGAGCAGCTTTTCGTAGCGAAG
CGTGAGTAAGGGCAAAGGTGTCTCTGACCATGACTTTGAAAAATTGGTATTTGA
AGTCCATGTCGTCACAGGCTCCCTGTTCCCAGAGTTGGAAGTCTACCCGTTTCTT
GTAGGCGGGGTTGGGCAAAGCGAAAGTAACATCGTTGAAGAGAATCTTGCCGGC
TCTGGGCATAAAATTGCGAGTGATGCGGAAAGGCTGTGGTACTTCCGCTCGATT
GTTGATCACCTGGGCAGCTAGGACGATCTCGTCGAAACCGTTGATGTTGTGTCCT
ACGATGTATAATTCTATGAAACGCGGCGTGCCTCTGACGTGAGGTAGCTTATTGA
GCTCATCAAAGGTTAGGTCTGTAGGGTCAGATAAGGCGTAGTGTTCGAGAGCCC
ATTCGTGCAGGTGAGGATTTGCATGGAGGAATGTTGACCAAAGATCCACCGCCA
GTGCTGTTTGTAACTGGTCCCGATACTGACGAAAATGTTGGCCAATTGCCATTTT
TTCTGGAGTGACACAGTAGAAGGTTCTGGGGTCTTGTTGCCATCGATCCCACTTG
AGTTTAATGGCTAGATCGTGGGCCATGTTGACGAGACGCTCTTCTCCTGAGAGTT
TCATGACCAGCATGAAAGGAACTAGTTGTTTGCCAAAGGACCCCATCCAGGTGT
AAGTTTCCACATCGTAGGTCAGGAAGAGTCTTTCTGTGCGAGGATGAGAGCCGA
TCGGGAAGAACTGGATTTCCTGCCACCAGTTGGAGGATTGGCTGTTGATGTGAT
GGAAGTAGAAGTTTCTGCGGCGCGCCGAGCATTCGTGTTTGTGCTTGTACAGAC
GGCCGCAGTAGTCGCAGCGTTGCACGGGTTGTATCTCGTGAATGAGCTGTACCT
GGCTTCCCTTGACGAGAAATTTCAGTGGGAAGCCGAGGCCTGGCGATTGTATCT
CGTGCTCTTCTATATTCGCTGTATCGGCCTGTTCATCTTCTGTTTCGATGGTGGTC
ATGCTGACGAGCCCCCGCGGGAGGCAAGTCCAAACCTCGGCGCGGGAGGGGCG
GAGCTGAAGGACGAGAGCGCGCAGGCTGGAGCTGTCCAGAGTCCTGAGACGCT
GCGGACTCAGGTTAGTAGGTAGGGACAGAAGATTAACTTGCATGATCTTTTCCA
GGGCGTGCGGGAGGTTCAGATGGTACTTGATTTCCACAGGTTCGTTTGTAGAGA
CGTCAATGGCTTGCAGGGTTCCGTGTCCTTTGGGCGCCACTACCGTACCTTTGTT
TTTTCTTTTGATCGGTGGTGGCTCTCTTGCTTCTTGCATGCTCAGAAGCGGTGACG
GGGACGCGCGCCGGGCGGCAGCGGTTGTTCCGGACCCGGGGCATGGCTGGTAG
TGGCACGTCGGCGCCGCGCACGGGCAGGTTCTGGTACTGCGCTCTGAGAAGACT
TGCGTGCGCCACCACGCGTCGATTGACGTCTTGTATCTGACGTCTCTGGGTGAAA
GCTACCGGCCCCGTGAGCTTGAACCTGAAAGAGAGTTCAACAGAATCAATTTCG
GTATCGTTAACGGCAGCTTGTCTCAGTATTTCTTGTACGTCACCAGAGTTGTCCT
GGTAGGCGATCTCCGCCATGAACTGCTCGATTTCTTCCTCCTGAAGATCTCCGCG
ACCCGCTCTCTCGACGGTGGCCGCGAGGTCATTGGAGATACGGCCCATGAGTTG
GGAGAATGCATTCATGCCCGCCTCGTTCCAGACGCGGCTGTAAACCACGGCCCC
CTCGGAGTCTCTTGCGCGCATCACCACCTGAGCGAGGTTAAGCTCCACGTGTCTG
GTGAAGACCGCATAGTTGCATAGGCGCTGAAAAAGGTAGTTGAGTGTGGTGGCA
ATGTGTTCGGCGACGAAGAAGTACATGATCCATCGTCTAAGCGGCATTTCGCTG
ACATCGCCCAGAGCTTCCAAGCGCTCCATGGCCTCGTAGAAGTCCACGGCAAAA
TTAAAAAACTGGGAGTTTCGCGCGGACACGGTCAATTCCTCCTGAGAAGACGG
ATGAGTTCGGCTATGGTGGCCCGTACTTCGCGTTCGAAGGCTCCCGGGATCTCTT
CTTCCTCTTCTATCTCTTCTTCCACTAACATCTCTTCTTCCTCTTCAGGCGGGGC
GGAGGGGGCACGCGGCGACGTCGACGGCGCACGGGCAAACGGTCGATGAATCG
TTCAATGACCTCTCCGCGGCGGCGGCGCATGGTTTCAGTGACGGCGCGGCCGTTC
TCGCGCGGTCGCAGAGTAAAAACACCGCCGCGCATCTCCTTAAAGTGGTGACTG
GGAGGTTCTCCGTTTGGGAGAGAGGGGCGCTGATTATACATTTTATTAATTGGC
CCGTAGGGACTGCGCGCAGAGATCTGATCGTGTCAAGATCCACGGGATCTGAAA
ACCTTTCGACGAAAGCGTCTAACCAGTCACAGTCACAAGGTAGGCTGAGTACGG
CTTCTTGTGGGCGGGGTGGTTATGTGTTCGGTCTGGGTCTTCTATTCCTTCTTCA
TCTCGGGAAGGTGAGACGATGCTGCTGGTGATGAAATTAAAGTAGGCAGTTCTA
AGACGGCGGATGGTGGCGAGGAGCACCAGGTCTTTGGGTCCGGCTTGCTGGATA
CGCAGGCGATTGGCCATTCCCCAAGCATTATCCTGACATCTAGCAAGATCTTTGT
AGTAGTCTTGCATGAGCCGTTCTACGGGCACTTCTTCCTCACCCGTTCTGCCATG
CATACGTGTGAGTCCAAACCCGCGCATTGGTTGAACCAGTGCCAAGTCAGCTAC
GACTCTTTCGGCGAGGATGGCTTGCTGTACTTGGGTGAGGGTGGCTTGAAAGTC
ATCAAAATCCACGAAGCGGTGGTAAGCCCCGGTATTAATGGTGTAAGCACAGTT
GGCCATGACTGACCAGTTAACTGTCTGGTGACCAGGGCGCACGAGCTCGGTGTA
TTTAAGTCGCGAATAGGCGCGGGTGTCAAAGATGTAATCGTTGCAGGTGCGCAC
CAGATACTGGTACCCTATAAGAAAATGTGGCGGTGGTTGGCGGTAGAGAGGCCA
TCTTTCTGTAGCTGGAGCGCCGGGGCGAGGTCTTCCAACATAAGGCGGTGATA
GCCGTAGATGTACCTGGACATCCAGGTGATTCCTGCGGCGGTAGTAGAAGCCCG
AGGAAACTCGCGTACGCGGTTCCAAATGTTGCGTAGCGGCATGAAGTAGTTCAT
TGTAGGTACGGTTTGACCAGTGAGGCGCGCGCAGTCATTGATGCTCTATAGACA
CGGAGAAAATGAAAGCGTTCAGCGACTCGACTCCGTAGCCTGGAGGAACGTGA
ACGGGTTGGGTCGCGGTGTACCCCGGTTCGAGACTTGTACTCGAGCCGGCCGGA
GCCGCGGCTAACGTGGTATTGGCACTCCCGTCTCGACCCAGCCTACAAAAATCC
AGGATACGGAATCGAGTCGTTTTGCTGGTTGCCGAATGGCAGGGAAGTGAGTCC
TATTTTTTTTTTTGCCGCTCAGATGCATCCCGTGCTGCGACAGATGCGTCCCCAA
CAACAGCCCCCTCGCAGCAGCAGCAGCAACCACAAAAGGCTGTCCCTGCAACT
ACTGCAACTGCCGCCGTGAGCGGTGCGGGACAGCCCGCCTATGATCTGGACTTG
GAAGAGGGCGAAGGACTGGCACGTCTAGGTGCGCCTTCGCCCGAGCGGCATCCG
CGAGTTCAACTGAAAAAAGATTCTCGCGAGGCATATGTGCCCCAACAGAACCTA
TTTAGAGACAGAAGCGGCGAGGAGCCGGAGGAAATGCGAGCTTCCCGCTTTAAC
GCGGGTCGTGAGCTGCGTCACGGTTTGGATCGAAGACGAGTGTTGCGGGACGAG
GATTTTGAAGTTGATGAAGTGACAGGGATCAGTCCTGCCAGGGCACACGTGGCT
GCCGCCAACCTTGTATCGGCTTACGAGCAGACAGTAAAGGAAGAGCGTAACTTT

TABLE 7-continued

Nucleic Acid Sequences of Vectors

SEQ ID NO Sequence

```
CAAAAGTCTTTTAATAATCATGTGCGAACACTGATTGCCCGCGAAGAGGTCACC
CTTGGTTTGATGCATTTGTGGGATTTGATGGAAGCTATCATTCAGAACCCTACTA
GCAAACCTCTGACCGCGCAGCTGTTTCTGGTGGTGCAACACAGCAGAGACAATG
AGGCTTTCAGAGAGGCGCTTCTCAACATCACCGAACCCGAGGGGAGATGGTTGT
ATGATCTTATCAACATTCTACAAAGTATCATAGTGCAGGAGCGGAGCCTGGGCC
TGGCCGAGAAGGTGGCTGCCATCAATTACTCGGTTTTGAGCTTGGGAAAATATT
ACGCTCGCAAGATCTACAAAACTCCATATGTTCCCATAGACAAGGAGGTGAAGA
TAGATGGGTTCTACATGCGTATGACGCTGAAGGTGCTGACCCTGAGCGATGATC
TTGGGGTGTACCGCAATGACAGAATGCATCGCGCGGTTAGCGCCAGCAGGAGGC
GCGAGTTAAGCGACAGGGAACTGATGCACAGTTTGCAAAGAGCTCTGACTGGAG
CTGGAACCGAGGGTGAGAATTACTTTGACATGGGAGCTGACTTGCAGTGGCAGC
CTAGTCGCAGGGCTCTGAGCGCCGCTACGACAGGATGTGAGCTTCCTTACATAG
AAGAGGCGGATGAAGGCGAGGAGGAAGAGGGCGAGTACTTGGAAGACTGATGG
CACAACCCGTGTTTTTTGCTAGATGGAACAGCAAGCACCGGATCCCGCAATGCG
GGCGGCGCTGCAGAGCCAGCCGTCCGGCATTAACTCCTCGGACGATTGGACCCA
GGCCATGCAACGTATCATGGCGTTGACGACTCGCAACCCCGAAGCCTTTAGACA
GCAACCCCAGGCCAACCGTCTATCGGCCATCATGGAAGCTGTAGTGCCTTCCCG
CTCTAATCCCACTCATGAGAAGGTCCTGGCCATCGTGAACGCGTTGGTGGAGAA
CAAAGCTATTCGTCCAGATGAGGCCGGACTGGTATACAACGCTCTCTTAGAACG
CGTGGCTCGCTACAACAGTAGCAACGTGCAAACCAATTTGGACCGTATGATAAC
AGATGTACGCGAAGCTGTGTCTCAGCGCGAAAGGTTCCAGCGCGATGCCAACCT
GGGTTCGCTGGTGGCGTTAAATGCTTTTTTGAGTACTCAGCCTGCTAATGTGCCG
CGCGGTCAACAGGATTATACTAACTTTTTTGAGTGCATTGAGACTGATGGTATCTG
AAGTACCTCAGAGCGAAGTGTATCAGTCCGGACCTGACTACTTCTTTCAGACTAG
CAGACAGGGCTTGCAGACGGTAAATCTGAGCCAAGCTTTTAAAAACCTTAAAGG
TTTGTGGGGAGTGCATGCCCCGGTAGGAGAAAGAGCAACCGTATCTAGCTTGTT
AACTCCGAACTCCCGCCTATTACTACTGTTGGTAGCTCCTTTCACCGACAGCGGT
AGCATCGACCGTAATTCCTATTTGGGTTACCTACTAAACCTGTATCGCGAAGCCA
TAGGGCAAAGCCAGGTGGACGAGCAGACCTATCAAGAAATTACCCAAGTCAGTC
GCGCTTTGGGTCAGGAAGACACTGGCAGTTTGGAAGCCACTCTGAACTTCTTGCT
TACCAATCGATCTCAGAAGATCCCTCCTCAATATGCTCTTACTGCAGAGGAGGA
GAGGATCCTTAGATATGTGCAGCAGAGTGTGGGATTGTTTCTGATGCAAGAGGG
GGCAACTCCGACTGCAGCACTGGACATGACTGCGCGAAATATGGAGCCCAGCAT
GTATGCCAGTAACCGACCTTTCATTAACAAACTGCTGGACTACTTGCACAGAGCT
GCCGCTATGAACTCTGATTATTTCACCAATGCCATCTTAAACCCGCACTGGCTGC
CCCCACCTGGTTTCTACACGGGCGAATATGACATGCCCGACCCTAATGACGGGTT
TCTGTGGGACGACGTGGACAGCGATGTTTTTTCACCTCTTTCTGATCATCGCGCG
TGGAAAAAGGAAGGCGGCGATAGAATGCATTCTTCTGCATCGCTGTCCGGGGTC
ATGGGTGCTACCGCGGCTGAGCCCGAGTCTGCAAGTCCTTTTCCTAGTCTACCCT
TTTCCCTACACAGTGTACGTAGCAGCGAAGTGGGTAGGATAAGTCGCCCGAGTT
TAATGGGCGAAGAGGAGTACCTAAACGATTCCTTGCTCAGACCGGCGAGAGAAA
AAAATTTCCCAAACAATGGAATAGAAAGTTTGGTGGATAAAATGAGTAGATGGA
AGACTTATGCTCAGGATCACAGAGACGAGCCTGGGATCATGGGGACTACAAGTA
GAGCGAGCCGTAGACGCCAGCGCCATGACAGACAGAGGGGTCTTGTGTGGGAC
GATGAGGATTCGGCCGATGATAGCAGCGTGTTGGACTTGGGTGGGAGAGGAAG
GGGCAACCCGTTTGCTCATTTGCGCCCTCGCTTGGGTGGTATGTTGTAAAAAAAA
AAATAAAAAGAAAAACTCACCAAGGCCATGGCGACGAGCGTACGTTCGTTCTTC
TTTATTATCTGTGTCTAGTATAATGAGGCGAGTCGTGCTAGGCGGAGCGGTGGTG
TATCCGGAGGGTCCTCCTCCTTCGTACGAGAGCGTGATGCAGCAGCAGCAGGCG
ACGGCGGTGATGCAATCCCCACTGGAGGCTCCCTTTGTGCCTCCGCGATACCTGG
CACCTACGGAGGGCAGAAACAGCATTCGTTACTCGGAACTGGCACCTCAGTACG
ATACCACCAGGTTGTATCTGGTGGACAACAAGTCGGCGGACATTGCTTCTCTGA
ACTATCAGAATGACCACAGCAACTTCTTGACCACGGTGGTGCAGAACAATGACT
TTACCCCTACGGAAGCCAGTACCCAGACTATTAACTTTGATGAACGATCGCGGT
GGGGCGGTCAGCTAAAGACCATCATGCATACTAATATGCCAAACGTGAACGAGT
ATATGTTTAGTAACAAGTTCAAAGCGCGTGTGATGGTGTCCAGAAAAGCTCCTG
AAGGTGTTACAGTAGACAATAATTATGATCATAAGCAAGATATTCTAAAATACG
AGTGGTTCGAGTTCACTTTGCCAGAGGGCAACTTTTCGGTCACTATGACTATTGA
CTTGATGAACAATGCCATCATAGACAACTACTTAAAAGTTGGCAGACAGAATGG
AGTGCTGGAAAGTGACATCGGTGTTAAGTTCGACACCAGGAACTTCAAGCTGGG
ATGGGATCCCGAAACCAAGTTGATCATGCCTGGAGTGTATACGTATGAAGCTTT
CCATCCTGACATTGTTTTACTGCCTGGCTGCGGAGTGGACTTTACCGAGAGTCGT
TTGAGCAACCTTCTTGGTATCAGAAAAAAACAGCCATTCCAAGAGGGTTTTAAG
ATCTTGTATGAAGATTTAGAAGGTGGTAATATTCCGGCTCTCTTGGATGTAGATG
CCTATGAGAACAGTAAGAAAGAACAAAAAGCCAAAATAGAAGCTGCTATAGCT
GCTGCAGAAGCTAAGGCAAACATAGTTGCCAGCGACTCTACAAGGGTTGCTAAC
GCTGGAGAGGTCAGAGGAGACAATTTTGCGCCAACACCTGTTCCGACTACAGAA
TCATTATTGGCCGATATGTCTGAAGGAACGGACGTAAAACTCACTATTCAACCTG
TAGAAAAAGATAGTAAGAATAGAAGCTATAATGTGTTGGAAGATAAAATCAAC
ACAGCCTATCGCAGTTGGTACCTTTCGTACAATTATGGCGACCCCGAAAAAGGA
GTGCGTTCCTGGACATTGCTCACCACCTCAGATGTCACCTGCGGAGCGGAGCAG
GTCTACTGGTCGCTTCCAGACATGATGCAGGATCCTGTCACTTTCCGCTCCACTA
GACAAGTCAGTAACTACCCTGTGGTGGGTGCAGAGCTTATGCCCGTCTTCTCAAA
GAGCTTCTACAACGAACAAGCTGTGTACTCCCAGCAGCTCCGCCAGTCCACCTC
GCTTACGCACGTCTTCAACCGCTTTCCTGAGAACCAGATTTTAATCCGTCCGCCG
GCGCCCACCATTACCACCGTCAGTGAAAACGTTCCTGCTCTCACAGATCACGGG
```

TABLE 7-continued

Nucleic Acid Sequences of Vectors

SEQ ID NO Sequence

ACCCTGCCGTTGCGCAGCAGTATCCGGGGAGTCCAACGTGTGACCGTTACTGAC
GCCAGACGCCGCACCTGTCCCTACGTGTACAAGGCACTGGGCATAGTCGCACCG
CGCGTCCTTTCAAGCCGCACTTTCTAAAAAAAATGTCCATTCTTATCTCACCCAG
TAATAACACCGGTTGGGGTCTGCGCGCTCCCAGCAAGATGTACGGAGGCGCACG
CAAACGTTCTACCCAACATCCCGTGCGTGTTCGCGGTCATTTTCGCGCTCCATGG
GGTGCCCTCAAGGGCCGCACTCGCGTTCGAACCACCGTTGATGATGTAATCGAT
CAGGTGGTTGCCGACGCCCGTAATTATACTCCTACTGCGCCTACATCTACTGTGG
ACGCAGTTATTGACAGTGTAGTGGCTGACGCTCGCAACTATGCTCGACGTAAGA
GCCGACGAAGGCGCATTGCCAGACGTCACCGAGCTACCACTGCCATGCGAGCCG
CAAGAGCTCTGCTACGAAGAGCTAGGCGCGTGGGGCGAAGAGCCATGCTTAGG
GCGGCCAGACGTGCAGCTTCGGGCGCCAGCGCCGGCAGGTCCCGCAGGCAAGCT
GCCGCTGTCGCAGCGGCGACTATTGCCGACATGGCCCAATCGCGAAGAGGCAAT
GTATACTGGGTGCGTGACGCTGCCACCGGTCAACGTGTACCCGTGCGCACCCGT
CCCCCTCGCACTTAGAAGATACTGAGCAGTCTCCCGATGTTGTGTCCCAGCGGCGA
GGATGTCCAAGCGCAAATACAAGGAAGAAATGCTGCAGGTTATCGCGCCTGAAG
TCTACGGCCAACCGTTGAAGGATGAAAAAAAACCCCGCAAAATCAAGCGGGTA
AAAAAGGACAAAAAAGAAGAGGAAGATGGCGATGATGGGCTGGCGGAGTTTGT
GCGCGAGTTTGCCCCACGGCGGCGCGTGCAATGGCGTGGACGCAAAGTTCGACA
TGTGTTGAGACCTGGAACTTCGGTGGTCTTTACACCCGGCGAGCGTTCAAGCGCT
ACTTTTAAGCGTTCCTACGATGAGGTGTACGGGGATGATGATATTCTTGAGCAGG
CAGCTGACCGATTAGGCGAGTTTGCTTATGGCAAGCGTAGTAGAATAAATCCCA
AGGATGAGACAGTGTCCATACCCTTGGATCATGGAAATCCCACCCCTAGTCTTA
AACCGGTCACTTTGCAGCAAGTGTTACCCGTAACTCCGCGAACAGGTGTTAAAC
GCGAAGGTGAAGATTTGTATCCCACTATGCAACTGATGGTGCCCAAACGCCAGA
AGTTGGAGGACGTTTTGGAGAAAGTAAAAGTGGATCCAGATATTCAACCTGAGG
TTAAAGTGAGACCCATTAAGCAGGTAGCGCCTGGTCTAGGAGTACAAACTGTAG
ACATTAAGATTCCCACTGAAAGTATGGAAGTGCAAACTGAACCCGCAAAGCCTA
CTGCCACCTCCACTGAAGTGCAAACGGATCCATGGATGCCCATGCCTATTACAA
CTGACGCCGCCGGTCCCACTCGAAGATCCCGACGAAAGTACGGTCCAGCAAGTC
TGTTGATGCCCAATTATGTTGTACATCCATCTATTATTCCTACTCCTGGTTACCGA
GGCACTCGCTACTATCGCAGCCGAAACAGTACCTCCCGCCGTCGCCGCAAGACA
CCTGCAAATCGCAGTCGTCGCCGCAGACGCACAAGCAAACCGACTCCCGGCGCC
CTGGTCGGCAAGTGTACCGCAATGGTAGTGCGGAACCTTTGACACTGCCGCGC
GCGCGTTACCATCCGAGTATCGTCACTTAATCAATGTTGCCGCTGCCTCCTTGCA
GATATGCCCTCACTTGTCGCCTTCGCGTTCCCATCACTGGTTACCGAGGAAGAA
ACTCGCGCCGTAGAAGAGGGATGTTGGGGCGCGGAATGCGACGCTACAGGCGA
CGGCGTGCTATCCGCAAGCAATTGCGGGGTGGTTTTTTGCCAGCCTTAATTCCAA
TTATCGCTGCTGCGATTGGCGCAATACCAGGCATAGCTTCCGTGGCGGTTCAGGC
CTCGCAACGACATTGACATTGGAAAAAAAAAAAACGTATAAATAAAAAAAAAT
ACAATGGACTCTGACACTCCTGGTCCTGTGACTATGTTTTCTTAGAGATGGAAGA
CATCAATTTTTTCATCCTTGGCTCCGCGACACGGCACGAAGCCGTACATGGGCACC
TGGAGCGACATCGGCACGAGCCAACTGAACGGGGGCGCCTTCAATTGGAGCAGT
ATCTGGAGCGGGCTTAAAAATTTTGGCTCAACCATAAAAACATACGGGAACAAA
GCTTGGAACAGCAGTACAGGACAGGCGCTTAGAAATAAACTTAAAGATCAGAA
CTTCCAACAAAAAGTAGTCGATGGGATAGCTTCCGGCATCAATGGAGTGGTAGA
TTTGGCTAACCAGGCTGTGCAGAAAAAAGATAAACAGTCGTTTGGACCCGCCGCC
AGCAACCCCAGGTGAAATGCAAGTGGAGGAAGAAATTCCTCCGCCAGAAAAAC
GAGGCGACAAGCGTCCGCGTCCCGATTTGGAAGAGACGCTGGTGACGCGCGTAG
ATGAACCGCCTTCTTATGAGGAAGCAACGAAGCTTGGAATGCCCACCACCAGAC
CGATAGCCCCTATGGCCACCGGGGTGATGAAACCTTCTCAGTTGCATCGACCCGT
CACCCTTGGATTTGCCCCCTCCCCCTGCTGCTACTGCTGTACCCGCTTCTAAGCCTG
TCGCTACCCCGAAACCAGTCGCCGTAGCCAGGTCACGTCCCGGGGGCGCTCCTC
GTCCAAATGCGCACTGGCAAAATACTCTGAACAGCATCGTGGGTCTAGGCGTGC
AAAGTGTAAAACGCCGTCGCTGCTTTTAATTAAATATGGAGTAGCGCTTAACTTG
CCTATCTGTGTATATGTGTCATTACACGCCGTCACAGCAGCAGAGGAAAAAAGG
AAGAGGTCGTGCGTCGACGCTGAGTTACTTTCAAGATGGCCACCCCATCGATGC
TGCCCCAATGGGCATACATGCACATCGCCGGACAGGATGCTTCGGAGTACCTGA
GTCCGGGTCTGGTGCAGTTCGCCCGCGCCACAGACACCTACTTCAATCTGGGAA
ATAAGTTTAGAAATCCCACCGTAGCGCCGACCCACGATGTGACCACCGATCGTA
GCCAGCGGCTCATGTTGCGCTTCGTGCCCGTTGACCGGGAGGACAATACATACT
CTTACAAAGTGCGGTACACCCTGGCCGTGGGCGACAACAGAGTGCTGGATATGG
CCAGCACGTTCTTTGACATTAGGGGCGTGTTGGACAGAGGTCCCAGTTTCAAACC
CTATTCTGGTACGGCTTACAACTCCCTGGCTCCTAAAGGCGCTCCAAATACATCT
CAGTGGATTGCAGAAGGTGTAAAAAATACAACTGGTAGAAATGGTGAGGAAGA
CGTAACAGAAGAGGAAACCAATACTGCTACTTACACTTTTGGCAATGCTCCTGT
AAAAGCTGAAGCTGAAATTACAAAGAAGGACTCCCAGTAGGTTTGGAAGTTTC
AGATGAAGAAAGTAAACCGATTTATGCTGATAAAACATATCAGCCAGAACCTCA
GCTGGGAGATGAAACTTGGACTGACCTTGATGGAAAAACTGAAAAGTATGGAG
GCAGGGCTCTCAAACCCGATACTAAGATGAAACCATGCTACGGGTCCTTTGCCA
AACCTACTAATGTGAAAGGCGGTCAGGCAAAACCAAAAACAACGGAGCAGCCA
AATCAGAAAGTCGAATATGATATCGACATGGAGTTTTTTGATGCGGCATCGCAG
AAAACAAACTTAAGTCCTAAAATTGTCATGTATGCAGAAAATGTAAATTTGGAA
ACTCCAGACACTCATGTAGTGTACAAACCTGGAACAGAAGCACAAGTTCCGAA
GCTAATTTGGGACAACAGTCTATGCCCAACAGACCCAACTACATTGGCTTCAGA
GATAACTTTATCGGACTTATGTACTATAACAGTACTGGTAACATGGGGGTGCTGG
CTGGTCAAGCGTCTCAGTTAAATGCAGTGGTTGACTTGCAGGACAGAAACACAG

TABLE 7-continued

Nucleic Acid Sequences of Vectors

SEQ ID NO Sequence

AACTGTCTTACCAACTCTTGCTTGACTCTCTGGGCGACAGAACCAGATACTTTAG
CATGTGGAATCAGGCTGTGGACAGTTATGATCCTGATGTACGTGTTATTGAAAAT
CATGGTGTGGAAGATGAACTTCCCAACTATTGTTTTCCACTGGACGGCATAGGTG
TTCCAACAACCAGTTACAAATCAATAATTCCAAATGGAGACAATGCACCTAATT
GGAAGGAACCTGAAGTAAATGGAACAAGTGAGATCGGACAGGGTAATTTGTTTG
CCATGGAAATTAACCTTCAAGCCAATCTATGGCGAAGTTTCCTTTATTCCAATGT
GGCTCTGTATCTCCCAGACTCGTACAAATACACCCCGTCCAATGTCACTCTTCCA
GAAAACAAAAACACCTACGACTACATGAACGGGCGGGTGGTGCCGCCATCTCTA
GTAGACACCTATGTGAACATTGGTGCCAGGTGGTCTCTGGATGCCATGGACAAT
GTCAACCCGTTCAACCACCACCGTAACGCCGGCTTGCGTTACCGATCCATGCTTC
TGGGTAACGGACGTTATGTGCCTTTCCACATACAAGTGCCTCAAAAATTTTTCGC
TGTTAAAAACCTGCTGCTTCTCCCAGGCTCCTACACTTATGAGTGGAACTTTAGG
AAGGATGTGAACATGGTTCTACAGAGTTCCCTCGGTAACGACCTGCGGGTAGAT
GGCGCCAGCATCAGTTTTACGAGCATCAACCTCTATGCTACTTTTTTCCCCATGG
CTCACAACACCGCTTCCACCCTTGAAGCCATGCTGCGGAATGACACCAATGATC
AGTCATTCAACGACTACCTATCTGCAGCTAACATGCTCTACCCCATTCCTGCCAA
TGCAACCAATATTCCCATTTCCATTCCTTCTCGCAATTGGGCGGCTTTCAGAGGC
TGGTCATTTACCAGACTCAAAACCAAAGAAACTCCCTCTTTGGGGTCTGGATTTG
ACCCCTACTTTGTCTATTCTGGTTCTATTCCCTACCTGGACGGTACCTTCTACCTG
AACCACACTTTTAAGAAGGTTTCCATCATGTTTGACTCTTCAGTGAGCTGGCCTG
GAAATGACAGGTTACTATCTCCTAACGAATTTGAAATAAAGCGTACTGTGGATG
GCGAAGGCTACAACGTAGCCCAATGCAACATGACCAAAGACTGGTTCTTGGTAC
AGATGCTCGCCAACTACAACATCGGCTATCAGGGCTTTTACATTCCAGAAGGAT
ACAAAGATCGCATGTATTCATTTTTCAGAAACTTCCAGCCCATGAGCAGGCAGG
TGGTTGATGAGGTCAATTACAAAGACTTCAAGGCCGTCGCCATACCCTACCAAC
ACAACAACTCTGGCTTTGTGGGTTACATGGCTCCGACCATGCGCCAAGGTCAAC
CCTATCCAGCTAACTATCCCTATCCACTCATTGGAACAACTGCCGTAAATAGTGT
TACGCAGAAAAAGTTCTTGTGCGACAGAACCATGTGGCGCATACCGTTCTCGAG
CAACTTCATGTCTATGGGGGCCCTTACAGACTTGGGACAGAACATGCTCTATGCC
AACTCAGCTCATGCTCTGGACATGACCTTTGAGGTGGATCCCATGGATGAGCCC
ACCCTGCTTTATCTTCTCTTCGAAGTTTTCGACGTGGTCAGAGTGCATCAGCCAC
ACCGCGGCATCATCGAGGCAGTCTACCTGCGTACACCGTTCTCGGCCGGTAACG
CTACCACGTAAGAAGCTTCTTGCTTCTTGCAAACAGCAGCTGCAACCATGGCCTG
CGGATCCCAAAACGGCTCCAGCGAGCAAGAGCTCAGAGCCATTGTCCAAGACCT
GGGTTGCGGACCCTATTTTTTGGGAACCTTTGATAAGCGCTTCCCGGGGTTCATG
GCCCCCGATAAGCTCGCCTGTGCCATTGTAAATACGGCCGGACGTGAGACGGGG
GGAGAGCACTGGTTGGCTTTCGGTTGGAACCCACGTTCTAACACCTGCTACCTTT
TTGATCCTTTTGGATTCTCGGATGATCGTCTCAAACAGATTTACCAGTTTGAATA
TGAGGGTCTCCTGCGCCGCAGCGCTCTTGCTACCAAGGACCGCTGTATTACGCTG
GAAAAATCTACCCAGACCGTGCAGGGCCCCGTTCTGCCGCCTGCGGACTATTCT
GCTGCATGTTCCTTCACGCCTTTGTGCACTGGCCTGACCGTCCCATGGACGGAAA
CCCCACCATGAAATTGCTAACTGGAGTGCCAAACAACATGCTTCATTCTCCTAAA
GTCCAGCCCACCCTGTGTGACAACCAAAAAGCACTCTACCATTTTCTCAATACCC
ATTCGCCTTATTTTCGCTCTCATCGTACACACATCGAAAGGGCCACTGCGTTCGA
CCGTATGGATGTGCAATAATGACTCATGTAAACAACGTGTTCAATAAACATCAC
TTTATTTTTTACATGTATCAAGGCTCTGGATTACTTTTTATTTACAAGTCGAATGG
GTTCTGACGAGAATCAGAATGACCCGCAGGCAGTGATACGTTGCGGAATTGATA
CTTGGGTTGCCACTTGAATTCGGGAATCACCAACTTGGGAACCGGTATATCGGG
CAGGATGTCACTCCACAGCTTTCTGGTCAGCTGCAAAGCTCCCAGCAGGTCAGG
AGCCGAAATCTTGAAATCACAATTAGGACCAGTGCTCTGAGCGCGAGAGTTGCG
GTACACCGGATTGCAGCACTGAAACACCATCAGCGACGGATGTCTCACGCTTGC
CAGCACGGTGGGATCTGCAATCATGCCCACATCCAGATCTTCAGCATTGGCAAT
GCTGAACGGGGTCATCTTGCAGGTCTGCCTACCCATAGCGGGCACCCAATTAGG
CTTGTGGTTACAATCGCAGTGCAGGGGGATCAGTATCATCTTGGCCTGATCCTGT
CTGATTCCTGGATACACGGCTCTCATGAAAGCATCATATTGCTTGAAAGCCTGCT
GGGCTTTACTACCCTCGGTATAAAACATCCCGCAGGACCTGCTCGAAAACTGGTT
AGCTGCGCAGCCGGCATCATTCACACAGCAGCGGGCGTCATTGTTGGCTATTTGC
ACCACACTTCTGCCCCAGCGGTTTGGGTGATTTTGGTTCGCTCGGGATTCTCCTT
CAAGGCTCGTTGTCCGTTCTCGCTGGCCACATCCATCTCGATAATCTGCTCCTTCT
GAATCATAATATTGCCATGCAGGCACTTCAGCTTGCCCTCATAATCATTGCAACC
ATGAGGCCACAACGCACAGCCTGTACATTCCCAATTATGGTGGGCGATCTGAGA
AAAAGAATGTATCATTCCCTGCAGAAATCTTCCCATCATGGTGCTCAGTGTCTTG
TGACTAGTGAAAGTTAACTGGATGCCTCGGTGCTCCTCGTTTACGTACTGGTGAC
AGATGCGCTTGTATTGTTCGTGTTGCTCAGGCATTAGTTTAAAAGAGGTTCTAAG
TTCGTTATCCAGCCTGTACTTCTCCATCAGCACACACATCACTTCCATGCCTTTCT
CCCAAGCAGACACCAGGGGCAAGCTAATCGGATTCTTAACAGTGCAGGCAGCAG
CTCCTTTAGCCAGAGGGTCATCTTTGGCGATCTTCTCAATGCTTCTTTTGCCATCC
TTCTCAACGATGCGCACGGGCGGGTAGCTGAAACCCACTGCTACAAGTTGCGCC
TCTTCTCTTTCTTCTTCGCTGTCTTGACTGATGTCTTGCATGGGACATGTTTGGT
CTTCCTTGGCTTCTTTTTGGGGGGTATCGGAGGAGGAGGACTGTCGCTCCGTTCC
GGAGAGAGGGAGGATTGTGAAGTTTCGCTCACCATTACCAACTGACTGTCGGTA
GAAGAACCTGACCCCACACGGCGACAGGTGTTTCTCTTCGGGGGCAGAGGTGGA
GGCGATTGCGAAGGGCTGCGGTCCGACCTGGAAGGCGGATGACTGGCAGAACC
CCTTCCGCGTTCGGGGTGTGCTCCCTGTGGCGGTCGCTTAACTGATTTCCTTCG
CGGCTGGCCATTGTGTTCTCCTAGGCAGAGAAACAACAGACATGGAAACTCAGC
CATTGCTGTCAACATCGCCACGAGTGCCATCACATCTCGTCCTCAGCGACGAGG

TABLE 7-continued

Nucleic Acid Sequences of Vectors

SEQ ID NO Sequence

AAAAGGAGCAGAGCTTAAGCATTCCACCGCCCAGTCCTGCCACCACCTCTACCC
TAGAAGATAAGGAGGTCGACGCATCTCATGACATGCAGAATAAAAAAGCGAAA
GAGTCTGAGACAGACATCGAGCAAGACCCGGGCTATGTGACACCGGTGGAACA
CGAGGAAGAGTTGAAACGCTTTCTAGAGAGAGAGGATGAAAACTGCCCAAAAC
AGCAAGCGGATAACTATCACCAAGATGCTGGAAATAGGGATCAGAACACCGAC
TACCTCATAGGGCTTGACGGGGAAGACGCGCTCCTTAAACATCTAGCAAGACAG
TCGCTCATAGTCAAGGATGCATTATTGGACAGAACTGAAGTGCCCATCAGTGTG
GAAGAGCTCAGCCGCGCCTACGAGCTCAACCTCTTTTCACCTCGTACTCCCCCCA
AACGCCAGCCAAACGGCACCTGTGAGCCAAATCCTCGCTTAAACTTTTATCCAG
CTTTTGCTGTGCCAGAAGTACTGGCTACCTATCACATCTTTTTTAAAAATCAAAA
AATTCCAGTCTCCTGCCGCGCTAATCGCACCCGCGCCGATGCCCTACTCAATCTG
GGACCTGGTTCACGCTTACCTGATATAGCTTCCTTGGAAGAGGTTCCAAAGATCT
TCGAGGGTCTGGGCAATAATGAGACTCGGGCCGCAAACGCTCTGCAAAAGGGA
GAAAATGGCATGGATGAGCATCACAGCGTTCTGGTGGAATTGGAGGGCGATAAT
GCCAGACTCGCAGTACTCAAGCGAAGCGTCGAGGTCACACACTTTGCATACCCC
GCTGTCAACCTGCCCCCTAAAGTCATGACGGCCGTCATGGACCAGTTACTCATTA
AGCGCGCAAGTCCCCTTTCAGAAGACATGCATGACCCAGATGCCTGTGACGAGG
GTAAACCAGTGGTCAGTGATGAGCAGCTAACCCGATGGCTGGGCACCGACTCTC
CCCGGGATTTGGAAGAGCGTCGCAAGCTTATGATGGCCGTGGTGCTGGTTACCG
TAGAACTAGAGTGTCTCCGGCGTTTCTTTACCGATTCAGAAACCTTGCGCAAACT
CGAAGAGAATCTGCACTACACTTTTAGACACGGCTTTGTGCGGCAGGCATGCAA
GATATCTAACGTGGAACTCACCAACCTGGTTTCCTACATGGGTATTCTGCATGAG
AATCGCCTAGGACAAAGCGTGCTGCACAGCACCCTTAAGGGGGAAGCCCGCCGT
GATTACATCCGCGATTGTGTCTATCTCTACCTGTGCCACACGTGGCAAACCGGCA
TGGGTGTATGGCAGCAATGTTTAGAAGAACAGAACTTGAAAGAGCTTGACAAGC
TCTTACAGAAATCTCTTAAGGTTCTGTGGACAGGGTTCGACGAGCGCACCGTCGC
TTCCGACCTGGCAGACCTCATCTTCCCAGAGCGTCTCAGGGTTACTTTGCGAAAC
GGACTGCCTGACTTTATGAGCCAGAGCATGCTTAACAATTTTCGCTCTTTCATCC
TGGAACGCTCCGGTATCCTGCCCGCCACCTGCTGCGCACTGCCCTCCGACTTTGT
GCCTCTCACCTACCGCGAGTGCCCCCCGCCGCTATGGAGTCACTGCTACCTGTTC
CGTCTGGCCAACTACCTCTCCTACCACTCGGATGTGATCGAGGATGTGAGCGGA
GACGGCTTGCTGGAGTGTCACTGCCGCTGCAATCTGTGCACGCCCCACCGGTCCC
TAGCTTGCAACCCCCAGTTGATGAGCGAAACCCAGATAATAGGCACCTTTGAAT
TGCAGGGCCCCAGCAGCCAAGGCGATGGGTCTTCTCCTGGGCAAAGTTTAAAAC
TGACCCCGGGACTGTGGACCTCCGCCTACTTGCGCAAGTTTGCCCCGGAAGATTA
CCACCCCTATGAAATCAAGTTCTATGAGGACCAATCACAGCCTCCGAAGGCCGA
ACTTTCGGCCTGCGTCATCACCCAGGGGGCAATTCTGGCCCAATTGCAAGCCATC
CAAAAAATCCCGCCAAGAATTTCTACTAAAAAAGGGTAAGGGGTCTACCTTGAC
CCCCAGACCGGCGAGGAACTCAACACAAGGTTCCCTCAGGATGTCCAACGACG
AGAAAGCAAGAAGTTGAAGGTGCAGCCGCCGCCCCCAGAAGATATGGAGGAAG
ATTGGGACAGTCAGGCAGAGGAAGCGGAGGAGGAGGAGGACAGTCTGGAGGAC
AGTCTGGAGGAAGACAGTTTGGAGGAGGAAAACGAGGAGGCAGAGGAGGTGGA
AGAAGTAACCGCCGACAAACAGTTATCCTCGGCTGCGGAGACAAGCAACAGCG
CTACCATCTCCGCTCCGAGTCGAGGAACCCGGCGGCGTCCCAGCAGTAGATGGG
ACGAGACCGGACGCTTCCCGAACCCAACCAGCGCTTCCAAGACCGGTAAGAAGG
ATCGGCAGGGATACAAGTCCTGGCGGGGGCATAAGAATGCCATCATCTCCTGCT
TGCATGAGTGCGGGGGCAACATATCCTTCACGCGACGCTACTTGCTATTCCACCA
TGGGGTGAACTTTCCGCGCAATGTTTTGCATTACTACCGTCACCTCCACAGCCCC
TACTATAGCCAGCAAATCCCGGCAGTCTCGACAGATAAAGACAGCGGCGGCGAC
CTCCAACAGAAAACCAGCAGCGGCAGTTAGAAAACACACAACAAGTGCAGCAA
CAGGAGGATTAAAGATTGCAGCCAACGAGCCAGCGCAAACCCGAGAGTTAAGA
AATCGGATCTTTCCAACCCTGTATGCCATCTTCCAGCAGAGTCGGGGCCAAGAG
CAGGAACTGAAAATAAAAAACCGATCTCTGCGTTCGCTCACCAGAAGTTGTTTG
TATCACAAGAGCGAAGATCAACTTCAGCGCACTCTCGAGGACGCCGAGGCTCTC
TTCAACAAGTACTGCGCGCTGACTCTTAAAGAGTAGGCAGCGACCGCGCTTATT
CAAAAAAGGCGGGAATTACATCATCCTCGTCATGAGTAAAGAAATTCCCACGCC
TTACATGTGGAGTTACCAGCCCCAAATGGGATTGGCGGCAGGCGCCTCCCAGGA
CTACTCCACCCGCATGAATTGGCTCAGCGCCGGGCCCTCTATGATTTCTCGAGTT
AATGATATACGCGCCTACCGAAACCAAATACTTTTGGAACAGTCAGCTCTTACC
ACCACGCCCCGCCAACACCTTAATCCCAGAAATTGGCCCGCCGCCCTAGTGTAC
CAGGAAAGTCCCGCTCCCACCACTGTATTACTTCCTCGAGACGCCCAGGCCGAA
GTCCAAATGACTAATGCAGGTGCGCAGTTAGCTGGCGGCTCCACCCTATGTCGTC
ACAGGCCTCGGCATAATATAAAACGCCTGATGATCAGAGGCCGAGGTATCCAGC
TCAACGACGAGTCGGTGAGCTCTCCGCTTGGTCTACGACCAGACGGAATCTTTCA
AATTGCCGGCTGCGGGAGATCTTCCTTCACCCCTCGTCAGGCTGTTCTGACTTTG
GAAAGTTCGTCTTCGCAACCCCGCTCGGGCGGAATCGGGACCGTTCAATTTGTG
GAGGAGTTTACTCCCTCTGTCTACTTCAACCCCTTCTCCGGATCTCCTGGGCACT
ACCCGGACGAGTTCATACCGAACTTCGACGCGATTAGCGAGTCAGTGGACGGCT
ACGATTGATGTCTGGTGACGCGGCTGAGCTATCTCGGCTGCGACATCTAGACCA
CTGCCGCCGCTTTCGCTGCTTTGCCCGGGAACTCATTGAGTTCATCTACTTCGAA
CTCCCCAAGGATCACCCTCAAGGTCCGGCCCACGGAGTGCGGATTACTATCGAA
GGCAAAATAGACTCTCGCCTGCAACGAATTTTCTCCCAGCGGCCCGTGCTGATCG
AGCGAGACCAGGGAAACACCACGGTTTCCATCTACTGCATTTGTAATCACCCCG
GATTGCATGAAAGCCTTTGCTGTCTTATGTGTACTGAGTTTAATAAAAACTGAAT
TAAGACTCTCCTACGGACTGCCGCTTTTTCAACCCGGATTTTACAACCAGAAGAA
CGAAACTTTTCCTGTCGTCCAGGACTCTGTTAACTTCACCTTTCCTACTCACAAAC

TABLE 7-continued

Nucleic Acid Sequences of Vectors

SEQ ID NO Sequence

TAGAAGCTCAACGACTACACCGCTTTTCCAGAAGCATTTTCCCTACTAATACTAC
TTTCAAAACCGGAGGTGAGCTCCACGGTCTCCCTACAGAAAACCCTTGGGTGGA
AGCGGGCCTTGTAGTGCTAGGAATTCTTGCGGGTGGGCTTGTGATTATTCTTTGC
TACCTATACACACCTTGCTTCACTTTCCTAGTGGTGTTGTGGTATTGGTTTAAAAA
ATGGGGCCCATACTAGTCTTGCTTGTTTTACTTTCGCTTTTGGAACCGGGTTCTGC
CAATTACGATCCATGTCTAGACTTCGACCCAGAAAACTGCACACTTACTTTTGCA
CCCGACACAAGCCGCATCTGTGGAGTTCTTATTAAGTGCGGATGGGACTGCAGG
TCCGTTGAAATTACACACAATAACAAAACCTGGAACAATACCTTATCCACCACA
TGGGAGCCAGGAGTTCCCGAGTGGTACACTGTCTCTGTCCAAGGTCCTGACGGTT
CCATCCGCATTAGTAACAACACTTTCATTTTTTCTGAAATGTGCGATTTGGCCAT
GTTCATGAGCAAACAGTATTCTCTATGGCCTCCCAACAAGGACAACATCGTAAC
GTTCTCCATTGCTTATTGCTTGTGCGCTTGCCTCCTTACTGCTTTACTGTGCGTAT
GCATACACCTGCTTGTAACCACTCGCATCAAAAACGCCAATAACAAAGAAAAAA
TGCCTTAACCTCTTTCTGTTTACAGACATGGCTTCTCTTACATCTCTCATATTTGT
CAGCATTGTCACTGCCGCTCACGGACAAACAGTCGTCTCTATCCCTCTAGGACAT
AATTACACTCTCATAGGACCCCCAATCACTTCAGAGGTCATCTGGACCAAATTGG
GAAGCGTTGATTACTTTGATATAATCTGCAACAAAACAAAACCAATAATAGTAA
CTTGCAACATACAAAATCTTACATTAATTAATGTTAGCAAAGTTTACAGCGGTTA
CTATTATGGTTATGACAGATACAGTAGTCAATATAGAAATTACTTGGTTCGTGTT
ACCCAGTTCAAAACCACAAAAATGCCAAATATGGCAAAGATTCGATCCGATGAC
AATTCTCTAGAAACTTTTACATCTCCCACCACACCTGACGAAAAAAACATCCCAG
ATTCAATGATTGCAATTATCGCAGCGGTGGCAGTGGTGATGGCACTAATAATAA
TATGCATGCTTTTATATGCTTGTCGCTACAAAAAGTTTCATCCTAAAAAACAAGA
TCTCCTACTAAGGCTTAACATTTAATTTCTTTTTATACAGCCATGGTTTCCACTAC
CACATTCCTTATGCTTACTAGTCTCGCAACTCTGACTTCTGCTCGCTCACACCTCA
CTGTAACTATAGGTTCAAACTGCACACTAAAAGGACCTCAAGGCGGCCATGTCT
TTTGGTGGAGAATATATGACAATGGATGGTTTACAAAACCATGTGACCAACCTG
GTCGATTTTCTGCAACGGCAGAGACCTAACCATTGTCAACGTGACAGCAAGTG
ACAAAGGCTTCTATTATGGAACCGACTATCAAACTAGTTTAGATTATAACATTAT
TGTACTGCCATCCACCACTCCAGCACCCCGCAAAACTACTTTCTCTAGCAGCAGT
GCCGCTAACAATACAATTTCCAATCCAACCTTTGCCGCGCTTTTAAAACGCACTG
TGAATAATTCTACAACTTCACATACAACAATTTCCATTTCAACAATCAGCATTAT
TGCTGCCGTGACAATTGGAATATCTATTCTTGTTTTTACCATAACCTACTACGCCT
GCTGCTATAGAAAAGACAAACATAAAGGTGATCCATTACTTAGATTTGATATTT
AATTTGTTCTTTTTTTTATTTACAGTATGGTGAACACCAATCATGGTACCTAGAA
ATTTCTTCTTCACCATACTCATCTGTGCTTTTAATGTTTGCGCTACTTTCACAGCA
GTAGCCACAGCAACCCCAGACTGTATAGGAGCATTTGCTTCCTATGCACTTTTTG
CTTTTGTCACTTGCATCTGCGTATGTAGCATAGTCTGCCTGGTTATTAATTTTTTC
CAACTTCTAGACTGGATCCTTGTGCGAATTGCCTACCTGCGCCACCATCCCGAAT
ACCGCAACCAAAATATCGCGGCACTTCTTAGACTCATCTAAAACCATGCAGGCT
ATACTACCAATATTTTTGCTTCTATTGCTCCCCTACGCTGTCTCAACTCCAGCTGC
CTATAGTACTCCGCCAGAACACCTTAGAAAATGCAAATTCCAACAACCGTGGTC
ATTTCTTGCTTGCTATCGAGAAAAATCAGAAATTCCCCCAAATTTAATAATGATT
GCTGGAATAATTAATATAATCTGCTGCACCATAATTTCATTTCTGATATACCCCC
TATTTGATTTTGGCTGGAATGCTCCCAATGCACATGATCATCCACAAGACCCAGA
GGAACACATTCCCCTACAGAACATGCAACATCCAATAGCGCTAATAGAATACGA
AAGTGAACCACAACCCCCACTACTCCCTGCTATTAGTTACTTCAACCTAACCGGC
GGAGATGACTGAAACACTCACCACCTCCAATTCCGCCGAGGATCTGCTTGATAT
GGACGGCCGCGTCTCAGAACAGCGACTCGCCCAACTACGCATCCGCCAACAGCA
GGAACGCGTGGCCAAAGAGCTCAGAGATGTCATCCAAATTCACCAATGCAAAAA
AGGCATATTCTGTCTGGTAAAACAAGCCAAGATATCCTACGAGATCACCGCTAC
TGACCATCGCCTCTCTTATGAGCTTGGCCCCCAACGACAAAAATTTACCTGCATG
GTGGGAATCAACCCCATAGTTATCACCCAGCAAAGTGGAGATACTAAGGGTTGC
ATTCACTGCTCCTGCGATTCCATCGAGTGCACCTACACCCTGCTGAAGACCCTAT
GCGGTCTAAGAGACCTGCTACCAATGAATTAAAAAAAATGATTAATAAAAAATC
ACTTACTTGAAATCAGCAATAAGGTCTCTGTTGAAATTTTCTCCCAGCAGCACCT
CACTTCCCTCTTCCCAACTCTGGTATTCTAAACCCCGTTCAGCGGCATACTTTCTC
CATACTTTAAATGGGATGTCAAATTTTAGCTCCTCTCCTGTACCCACAATCTTCAT
GTCTTTCTTCCCAGATGACCAAGAGAGTCCGGCTCAGTGACTCCTTCAACCCTGT
CTATCCCTATGAAGATGAAAGCACCTCCCAACACCCCTTTATAAACCCAGGGTTT
ATTTCCCCAAACGGCTTCACACAAAGCCCAGACGGAGTTCTTACTTTAAAATGTT
TAACCCCGCTAACAACCACAGGCGGGTCTCTACAGTTAAAAGTGGGAGAGGGTC
TTACAGTAGATGACACCGGGTTTTTGAAAGAAAACATAAGTGCTACCACACCAC
TCGTTAAGACTGGTCACTCTATAGGTTTGTCGCTAGGACCCGGATTAGGAACAA
ATGAAAATAAACTTTGTACCAAATTGGGAGAAGGACTTACATTCAATTCGAACA
ACATTTGCATTGATGACAATATTAACACCCTATGGACAGGAGTTAACCCCACCA
GAGCCAACTGTCAAATGATGGACTCCAGTGAATCTAATGATTGCAAATTAATTCT
AACACTAGTTAAAACTGGAGCCCTAGTTACTGCATTTGTTTATGTTATAGGAGTA
TCTAACGATTTTAATATGCTAACTACACAGAAAAATATAAATTTTACTGCAGAGC
TGTTTTTCGATTCTACTGGTAATTTACTAACTAGCCTCTCATCCCTAAAAACTCCA
CTTAATCATAAATCAGGGCAAAACATGGCTACTGGTGCCATTACTAATGCTAAA
GGTTTCATGCCCAGCACAACTGCCTATCCTTTCAATAATAATTCCAGAGAAAAAG
AAAACTACATTTACGGAACTTGTTACTACACAGCTAGTGATCACACTGCTTTTCC
CATTGACATATCTGTCATGCTTAACCGAAGAGCAATAAATGATGAGACATCATA
TTGTATTCGTATAACTTGGTCCTGGAGCACAGGAGTTGCCCCAGAAGTGCAAAC
CTCTGCTACTACCCTAGTCACCTCTCCATTTACCTTTTACTACATCAGAGAAGAC

TABLE 7-continued

Nucleic Acid Sequences of Vectors

| SEQ ID NO | Sequence |
|---|---|
| | GACTGACAAATAAAGTTTAACTTGTTTATTTGAAAATCAATTCACAAAATTCGAG<br>TAGTTATTTTGCCTCCCCCTTCCCATTTAACAGAATACACCAATCTCTCCCCACGC<br>ACAGCTTTAAACATTTGGATACCATTAGAGATAGACATAGTTTTAGATTCCACAT<br>TCCAAACAGTTTCAGAGCGAGCCAATCTGGGGTCAGTGATACATAAAAATGCAT<br>CTGGATAGTCTTTTAAAGCGCTTTCACAGTCCAACTGCTGCGGATGCGACTCCGG<br>AGTCTGAATCACGGTCATCTGGAAGAAGAACGATGGGAATCATAATCCGAAAAC<br>GGGATCGGGCGATTGTGTCTCATCAAACCCACAAGCAGCCGCTGTCTGCGTCGC<br>TCCGTGCGACTGCTGTTTATGGGATCGGGGTCCACAGTGTCCTGAAGCATAATTT<br>TAATAGCCCTTAACATTAACTTTCTGGTGCGATGCGCGCAGCAACGCATTCTGAT<br>CTCACTTAGATTACTACAGTAGGTACAGCACATTATCACAATATTGTTTAATAAA<br>CCATAATTAAAAGCGCTCCAGCCAAAACTCATATCTGATATAATCGCCCCTGCAT<br>GACCATCATACCAAAGTTTAATATAAATTAAATGTCGTTCCCTCAAAAACACACT<br>ACCCACATACATGATCTCTTTTGGCATGTGCATATTAACAATCTGTCTGTACCAT<br>GGACAACGTTGGTTAATCATGCAACCCAATATAACCTTCCGGAACCACACTGCC<br>AACACCGCTCCCCCAGCCATGCATTGAAGTGAACCCTGCTGATTACAATGACAA<br>TGAAGAACCCAATTCTCTCGACCGTGAATCACTTGAGAATGAAAAATATCTATA<br>GTAGCACAACATAGACATAAATGCATGCATCTTCTCATAATTTTTAACTCCTCAG<br>GATTTAGAAACATATCCCAGGGAATAGGAAGCTCTTGCAGAACAGTAAA |
| SEQ ID NO: 1427 | GTGGTGATTGGCTGTGGGGTTAACGGCTAAAAGGGGCGGCGCGGCCGTGGGAA<br>AATGATGTTTTTTGGGGGTGGAGTTTTTTTTGCAAGTTGTCGCGGGAAATGTGAC<br>GTGCACAAAGGCTTTTTTCTCACGGAACTACTTAGTTTTCCCACGGTATTTAACA<br>GGAAATGAGGTACTTTTGGCCGGATGCAAGTGAAAACTGTTCATTTTCGCGCGA<br>AAACTGAATGAGGAAGTGTTTTTCTGAATAATGTGGTATTTATGGCAGGGTGGA<br>GTATTTGTTCAGGGCCAGGTAGACTTTGACCCATTACGTGGAGGTTTCGATTACC<br>GTGTTTTTTACCTGAATTTCCGCGTACCGTGTCAAAGTCTTCTGTTTTTACGTAGG<br>TGTCAGCTGATCGCTAGGGTATTTATACCTCAGGGTTTGTGTCAAGAGGCCACTC<br>TTGAGTGCCAGCGAGAAGAGTTTTCTCCTCTGCGCCGGCAGTTTAATAATAAAA<br>AAATGAGAGATTTGCGATTTCTGCCTCAGGAAATAATCTCTGCTGAGACTGGAA<br>ATGAAATATTGGAGCTTGTGGTGCACGCCCTAATGGGAGACGATCCGGAGCCAC<br>CTGTGCAGCTTTTTGAGCCTCCTACGCTTCAGGAACTGTATGATTTAGAGGTAGA<br>GGGATCGGAGGATTCTAATCAGGAAGCTGTGAATGGCTTTTTTACCGATTCTATG<br>CTTTTAGCTGCTAATGAAGGATTAGAATTAGATCCGCCTTTGGACACTTTTGATA<br>TTCCAGGGGTGATTGTGGAAAGCGGTACAGGTGTAAGAAAATTACCTGATTTGG<br>GTTCCGTGGACTGTGATTTGCACTGCTATGAAGACGGGTTTCCTCCGAGTGATGA<br>GGAGGACCATGAAAAGGAGCAGTCTATGCAGACTGCAGCGGGTGAGGGAGTGA<br>AGGCTGCCAGTGTTGGTTTTCAGTTGGATTGCCCGGAGCTTCCTGGACATGGCTG<br>TAAGTCTTGTGAATTTCACAGGAAAAATACTGGAGTAAAGGAACTGTTATGTTC<br>GCTTTGTTATATGAGAACGCACTGCCACTTTATTTACAGTAAGTGTGTTTAACTT<br>AAAATTTAAAGGAATATGCTGTTTTTCACATGTATATTGAGTGGGAGTTTTGTGT<br>TTCTTATTATAGGTCCTGTGTCTGATGCTGATGAATCACCATCTCCTGATTCTACT<br>ACCTCACCTCCTGAGATTCAAGCACCTGTTCCTGTGGACGTGCGCAAGCCCATTC<br>CTGTGAAGCTTAAGCCTGGGAAACGTCCAGCAGTGGAAAAACTTGAGGACTTGT<br>TACAGGGTGGGGACGGACCTTTGGACTTGAGTACACGGAAACGTCCAAGACAAT<br>AAGTGTTCCATATCCGTGTTTACTTAAGGTGACGTCAATATTTGTGTGAGAGTGC<br>AATGTAATAAAAAATATGTTAACTGTTCACTGGTTTTTTATTGCTTTTTTGGGCGGG<br>GACTCAGGTATATAAGTAGAAGCAGACCTGTGTGGTTAGCTCATAGGAGCTGGC<br>TTTCATCCATGGAGGTTTGGGCCATTTTGGAAGACCTTAGGAAGACTAGGCAACT<br>GTTGGAGAACGCTTCGGACGGAGTCTCCGGTTTTTGGAGATTCTGGTTCGCTAGT<br>GAATTAGCTAGGGTAGTTTTTAGGATAAAACAGGACTATAAAGAAGAATTTGAA<br>AAGTTGTTGGTAGATTGCCCAGGACTTTTTGAAGCTCTTAATTTGGGCCACCAGG<br>TTCACTTTAAAGAAAAAGTTTTATCAGTTTTAGACTTTTCAACCCCAGGTAGAAC<br>TGCCGCTGCTGTGGCTTTTCTTACTTTTATATTAGACAAATGGATCCCGCAGACT<br>CATTTCAGCAGGGGATACGTTTTGGATTTCATAGCCACAGCATTGTGGAGAACAT<br>GGAAGGTTCGCAAGATGAGGACAATCTTAGGTTACTGGCCAGTGCAGCCTTTGG<br>GTGTAGCGGGAATCCTGAGGCATCCACCTGTCATGCCAGCGGTTCTGGAGGAGG<br>AACAGCAAGAGGACAATCCGAGAGCCGGCCTGGACCCTCCAGTGGAGGAGGCG<br>GAGTAGCTGACTTGTCTCCTGAACTGCAACGGGTGCTTACTGGATCTACGTCCAC<br>TGGACGGGATAGGGCGTTAAGAGGGAGAGGGCATCCAGTGGTACTGATGCTA<br>GATCTGAGTTGGCTTTAAGTTTAATGTCTCGCAGACGTCCTGAAACCATTTGGTG<br>GCATGAGGTTCAGAAAGAGGGAAGGGATGAAGTTTCTGTATTGCAGGAGAAAT<br>ATTCACTGGAACAGGTGAAAACATGTTGGTTGGAGCCAGAGGATGATTGGGAGG<br>TGGCCATTAAAAATTATGCGAAGATAGCTTTGAGGCCTGATAAGCAGTATAAGA<br>TCACTAGACGGATTAATATCCGGAATGCTTGTTACATATCTGGAAATGGGGCTG<br>AGGTGGTAATGATACTCAAGACAAGACAGTTATTAGATGCTGCATGATGGATA<br>TGTGGCCTGGAGTAGTCGGTATGGAAGCAGTCACTTTTGTAAATGTTAAGTTTAG<br>GGGAGATGGTTATAATGGAATAGTGTTTATGGCCAATACCAAACTTATATTGCAT<br>GGTTGTAGCTTTTTTGGTTTCAACAATACCTGTGTAGATGCCTGGGGACAGGTTA<br>GTGTGCGGGGGTGTAGTTTCTATGCGTGTTGGATTGCCACAGCAGGCAGAACCA<br>AGAGTCAATTGTCTCTGAAGAAATGCATATTCCAAAGATGTAACCTGGGCATTCT<br>GAATGAAGGCGAAGCAAGGGTCCGCCACTGCGCTTCTACAGATACTGGATGTTT<br>TATTTTAATTAAGGGAAATGCCAGCGTAAAGCATAACATGATTTGCGGTGCTTCC<br>GATGAGAGGCCTTATCAAATGCTCACTTGTGCTGGTGGGCATTGTAATATGCTGG<br>CTACTGTGCATATTGTTTCCCACCAACGCAAAAAATGGCCTGTTTTTGATCACAA<br>TGTGTTGACCAAGTGCACCATGCATGCAGGTGGGCGTAGAGGAATGTTTATGCC<br>TTACCAGTGTAACATGAATCATGTGAAAGTGTTGTTGGAACCAGATGCCTTTTCC |

TABLE 7-continued

Nucleic Acid Sequences of Vectors

SEQ ID NO Sequence

AGAATGAGCCTAACAGGAATCTTTGACATGAACACGCAAATCTGGAAGATCCTG
AGGTATGATGATACGAGATCAAGGGTGCGCACATGCGAATGCGGAGGCAAGCA
TGCCAGGTTCCAGCCGGTGTGTGTAGATGTGACGGAAGATCTCAGACCGGATCA
TTTGGTTATTGCCCGCACTGGAGCAGAGTTCGGATCCAGTGGAGAAGAAACTGA
CTAAGGTGAGTATTGGGAAAAGTTTGGGGTGGGATTTTCAGATAGACAGATTGA
GTAAAAATTTGTTTTTTCTGTCTTGCAGCTGTCATGAGTGGAAACGCTTCTTTTAA
GGGGGGAGTCTTCAGCCCTTATTTGACAGGGCGTCTCCCATCCTGGGCAGGAGTT
CGTCAGAATGTTATGGGATCTACTGTGGATGGAAGACCCGTCCAACCCGCCAAT
TCTTCAACGCTGACCTATGCTACTTTAAGTTCTTCACCTTTGGACGCAGCTGCAG
CCGCCGCCGCCTCTGTCGCCGCTAACACTGTGCTTGGAATGGGTTACTATGGAAG
CATCGTGGCTAATTCCACTTCCTCTAATAACCCTTCTACCCTGACTCAGGACAAG
TTACTTGTCCTTTTGGCCCAGCTGGAGGCTTTGACCCAACGTCTGGGTGAACTTT
CTCAGCAGGTGGCGGAGTTGCGAGTACAAACTGAGTCTGCTGTCGGCACGGCAA
AGTCTAAATAAAAAAATTCCAGAATCAATGAATAAATAAACGAGCTTGTTGTTG
ATTTAAATCAAGTGTTTTTATTTCATTTTTCGCGCACGGTATGCCCTAGACCACCG
ATCTCGATCATTGAGAACTCGGTGGATTTTTTCCAGAATCCTATAGAGGTGGGAT
TGAATGTTTAGATACATGGGCATTAGGCCATCTTTGGGGTGGAGATAGCTCCATT
GAAGGGATTCATGCTCCGGGGTAGTGTTGTAAATCACCCAGTCATAACAAGGTC
GCAGTGCATGGTGTTGCACAATATCTTTTAGAAGTAGGCTGATTGCCACAGATA
AGCCCTTGGTGTAGGTGTTTACAAACCGGTTGAGCTGGGAGGGGTGCATTCGGG
GTGAAATTATGTGCATTTTGGATTGGATTTTTAAGTTGGCGATATTGCCGCCAAG
ATCCCGTCTTGGGTTCATGTTATGAAGGACCACCAAGACGGTGTATCCGGTACAT
TTAGGAAATTTATCATGTAGCTTGATGGAAAAGCGTGGAAAAATTTGGAGACA
CCCTTGTGTCCTCCGAGATTTTCCATGCACTCATCCATGATAATAGCAATGGGGC
CGTGGGCAGCGGCGCGGGCAAACACGTTCCGTGGGTCTGACACATCATAGTTAT
GTTCCTGAGTTAAATCATCATAAGCCATTTTAATGAATTTGGGGCGGAGAGTACC
AGATTGGGGTATGAATGTTCCTTCGGGCCCCGGAGCATAGTTTCCCTCACAGATT
TGCATTTCCCAAGCTTTCAGTTCCGAGGGTGGAATCATGTCCACCTGGGGGCTA
TGAAAAACACCGTTTCTGGGGCGGGGTGATTAGTTGGGATGATAGCAAATTTC
TGAGCAATTGAGATTTGCCACATCCGGTGGGGCCATATATGATTCCGATTACAG
GTTGCAGATGGTAGTTTAGGGAGCGGCAACTGCCGTCTTCTCGAAGCAAGGGGG
CCACCTCGTTCATCATTTCCCTTACATGCATATTTTCCCGCACCAAATCCATTAGG
AGGCGCTCTCCTCCTAGTGATAGAAGTTCTTGTAGTGAGGAAAAGTTTTTCAGCG
GTTTTAGACCGTCAGCCATGGGCATTTTGGAGAGAGTTTGCTGCAAAAGTTCTAG
TCTGTTCCACAGTTCAGTGATGTGTTCTATGGCATCTCGATCCAGCAGACCTCCT
CGTTTCGCGGGTTTGGACGGCTCCTGGAGTAGGGTATGAGACGATGGGCGTCCA
GCGCTGCCAGGGTTCGGTCCTTCCAGGGTCTCAGTGTTCGAGTCAGGGTTGTTTC
CGTCACAGTGAAGGGGTGTGCGCCTGCTTGGGCGCTTGCCAGGGTGCGCTTCAG
ACTCATTCTGCTGGTCGAGAACTTCTGTCGCTTGGCGCCCTGTATGTCGGCCAAG
TAGCAGTTTACCATGAGTTCGTAGTTGAGCGCCTCGGCTGCGTGGCCTTTGGCGC
GTAGCTTACCTTTGGAAGTTTTCTTGCATACCGGGCAGTATAGGCATTTCAGCGC
ATACAGCTTGGGCGCGAGGAAAATGGATTCTGGGGAGTATGCATCCGCACCGCA
GGAGGCGCAAACAGTTTCACATTCCACCAGCCAGGTTAAATCCGGTTCATTGGG
GTCAAAAACAAGTTTTCCGCCATATTTTTTGATGCGTTTCTTACCTTTGCTCTCCA
TAAGTTCGTGTCCTCGTTGAGTGACAAACAGGCTGTCCGTGTCCCCGTAGACTGA
TTTTACAGGCCTCTTCTCCAGTGGTGTGCCTCGGTCTTCTTCGTACAGAAACTCTG
ACCACTCTGATACAAAGGCGCGCGTCCAGGCCAGCACAAAGGAGGCTATGTGGG
AGGGGTAGCGATCGTTGTCAACCAGGGGGTCCACCTTTTCCAAAGTATGCAAAC
ACATGTCACCCTCTTCAACATCCAGGAATGTGATTGGCTTGTAGGTGTATTTCAC
GTGACCTGGGGTCCCCGCTGGGGGGGTATAAAAGGGGGCGGTTCTTTGCTCTTC
CTCACTGTCTTCCGGATCGCTGTCCAGGAACGTCAGCTGTTGGGGTAGGTATTCC
CTCTCGAAGGCGGGCATGACCTCTGCACTCAGGTTGTCAGTTTCTAAGAACGAG
GAGGATTTGATATTGACAGTGCCGGTTGAGATGCCTTTCATGAGGTTTTCGTCCA
TTTGGTCAGAAAACACAATTTTTTTATTGTCAAGTTTGGTGGCAAATGATCCATA
CAGGGCGTTGGATAAAAGTTTGGCAATGGATCGCATGGTTTGGTTCTTTTCCTTG
TCCGCGCGCTCTTTGGCAGCGATGTTGAGTTGGACATACTCGCGTGCCAGGCACT
TCCATTCGGGGAAGATAGTTGTCAATTCATCGGCACGATTCTCACTTGCCACCC
TCGATTATGCAGGGTAATTAAATCCACACTGGTGGCCACCTCGCCTCGAAGGGG
TTCGTTGGTCCAACAGAGCCTACCTCCTTTCCTAGAACAGAAAGGGGGAAGTGG
GTCTAGCATAAGTTCATCGGGAGGGTCTGCATCCATGGTAAAGATTCCCGGAAG
TAAATCCTTATCAAAATAGCTGATGGGAGTGGGGTCATCTAAGGCCATTTGCCAT
TCTCGAGCTGCCAGTGCGCGCTCATATGGGTTAAGAGGACTGCCCCAGGGCATG
GGATGGGTGAGTGCAGAGGCATACATGCCACAGATGTCATAGACGTAGATGGG
ATCCTCAAAGATGCCTATGTAGGTTGGATAGCATCGCCCCCCTCTGATACTTGCT
CGCACATAGTCATATAGTTCATGTGATGGCGCTAGCAGCCCCGGACCCAAGTTG
GTACGATTGGGTTTTTCTGTTCTGTAGACAATCTGGCGAAAGATGGCGTGAGAAT
TGGAAGAGATGGTGGGTCTTTGAAAAATGTTGAAATGGGCATGAGGTAGACCTA
CAGAGTCTCTGACAAAGTGGGCATAAGATTCTTGAAGCTTGGTTACCAGTTCGG
CGGTGACAAGTACGTCCAGGGCGCAGTAGTCAAGTGTTTCTTGAATGATGTCAT
AACCTGGTTGGTTTTCTTTTCCCACAGTTCGCGGTTGAGAAGGTATTCTTCGCG
ATCCTTCCAGTACTCTTCTAGCGGAAACCCGTCTTTGTCTGCACGGTAAGATCCT
AGCATGTAGAACTGATTAACTGCCTTGTAAGGGCAGCAGCCCTTCTCTACGGGT
AGAGAGTATGCTTGAGCAGCTTTTCGTAGCGAAGCGTGAGTAAGGGCAAAGGTG
TCTCTGACCATGACTTTGAGAAATTGGTATTTGAAGTCCATGTCGTCACAGGCTC
CCTGTTCCCAGAGTTGGAAGTCTACCCGTTTCTTGTAGGCGGGGTTGGGCAAAGC
GAAAGTAACATCGTTGAAGAGAATCTTGCCGGCTCTGGGCATAAAATTGCGAGT

TABLE 7-continued

Nucleic Acid Sequences of Vectors

SEQ ID NO Sequence

```
GATGCGGAAAGGCTGTGGTACTTCCGCTCGATTGTTGATCACCTGGGCAGCTAG
GACGATCTCGTCGAAACCGTTGATGTTGTGTCCTACGATGTATAATTCTATGAAA
CGCGGCGTGCCTCTGACGTGAGGTAGCTTATTGAGCTCATCAAAGGTTAGGTCTG
TAGGGTCAGATAAGGCGTAGTGTTCGAGAGCCCATTCGTGCAGGTGAGGATTTG
CATGGAGGAATGTTGACCAAAGATCCACCGCCAGTGCTGTTTGTAACTGGTCCC
GATACTGACGAAATGTTGGCCAATTGCCATTTTTTCTGGAGTGACACAGTAGA
AGGTTCTGGGGTCTTGTTGCCATCGATCCCACTTGAGTTTAATGGCTAGATCGTG
GGCCATGTTGACGGAGACGCTCTTCTCCTGAGAGTTTCATGACCAGCATGAAAGG
AACTAGTTGTTTGCCAAAGGACCCCATCCAGGTGTAAGTTTCCACATCGTAGGTC
AGGAAGAGTCTTTCTGTGCGAGGATGAGAGCCGATCGGGAAGAACTGGATTTCC
TGCCACCAGTTGGAGGATTGGCTGTTGATGTGATGGAAGTAGAAGTTTCTGCGG
CGCGCCGAGCATTCGTGTTTGTGCTTGTACAGACGGCCGCAGTAGTCGCAGCGTT
GCACGGGTTGTATCTCGTGAATGAGCTGTACCTGGCTTCCCTTGACGAGAAATTT
CAGTGGGAAGCCGAGGCCTGGCGATTGTATCTCGTGCTCTTCTATATTCGCTGTA
TCGGCCTGTTCATCTTCTGTTTCGATGGTGGTCATGCTGACGAGCCCCCGCGGGA
GGCAAGTCCAAACCTCGGCGCGGGAGGGGCGGAGCTGAAGGACGAGAGCGCGC
AGGCTGGAGCTGTCCAGAGTCCTGAGACGCTGCGGACTCAGGTTAGTAGGTAGG
GACAGAAGATTAACTTGCATGATCTTTTCCAGGGCGTGCGGGAGGTTCAGATGG
TACTTGATTTCCACAGGTTCGTTTGTAGAGACGTCAATGGCTTGCAGGGTTCCGT
GTCCTTTGGGCGCCACTACCGTACCTTTGTTTTTTCTTTTGATCGGTGGTGGCTCT
CTTGCTTCTTGCATGCTCAGAAGCGGTGACGGGGACGCGCGCCGGGCGGCAGCG
GTTGTTCCGGACCCGGGGGCATGGCTGGTAGTGGCACGTCGGCGCCGCGCACGG
GCAGGTTCTGGTACTGCGCTCTGAGAAGACTTGCGTGCGCCACCACGCGTCGATT
GACGTCTTGTATCTGACGTCTCTGGGTGAAAGCTACCGGCCCGTGAGCTTGAAC
CTGAAAGAGAGTTCAACAGAATCAATTTCGGTATCGTTAACGGCAGCTTGTCTC
AGTATTTCTTGTACGTCACCAGAGTTGTCCTGGTAGGCAATCTCCGCCATGAACT
GCTCGATTTCTTCCTCCTGAAGATCTCCGCGACCCGCTCTCTCGACGGTGGCCGC
GAGGTCATTGGAGATACGGCCCATGAGTTGGGAGAATGCATTCATGCCCGCCTC
GTTCCAGACGCGGCTGTAAACCACGGCCCCCTCGGAGTCTCTTGCGCGCATCACC
ACCTGAGCGAGGTTAAGCTCCACGTGTCTGGTGAAGACCGCATAGTTGCATAGG
CGCTGAAAAAGGTAGTTGAGTGTGGTGGCAATGTGTTCGGCGACGAAGAAGTAC
ATGATCCATCGTCTCAGCGGCATTTCGCTGACATCGCCCAGAGCTTCCAAGCGCT
CCATGGCCTCGTAGAAGTCCACGGCGAAATTAAAAAACTGGGAGTTTCGCGCGG
ACACGGTCAATTCCTCCTCGAGAAGACGGATGAGTTCGGCTATGGTGGCCCGTA
CTTCGCGTTCGAAGGCTCCCGGGATCTCTTCTTCCTCTTCTATCTCTTCTTCCACT
AACATCTCTTCTTCCTCTTCAGGCGGGGCGGAGGGGGCACGCGGCGACGTCGA
CGGCGCACGGGCAAACGGTCGATGAATCGTTCAATGACCTCTCCGCGGCGGCGG
CGCATGGTTTCAGTGACGGCGCGGCCGTTCTCGCGCGGTCGCAGAGTAAAAACA
CCGCCGCGCATCTCCTTAAAGTGGTGACTGGGAGGTTCTCCGTTTGGGAGAGAG
AGGGCGCTGATTATACATTTTATTAATTGGCCCGTAGGGACTGCGCGCAGAGAT
CTGATCGTGTCAAGATCCACGGGATCTGAAAACCTTTCGACGAAAGCGTCTAAC
CAGTCACAGTCACAAGGTAGGCTGAGTACGGCTTCTTGTGGGCGGGGTGGTTA
TGTGTTCGGTCTGGGTCTTCTATTCCTTCTTCATCTCGGGAAGGTGAGACGATGC
TGCTGGTGATGAAATTAAAGTAGGCAGTTCTAAGACGGCGGATGGTGGCGAGGA
GCACCAGGTCTTTGGGTCCGGCTTGCTGGATACGCAGGCGATTGGCCATTCCCCA
AGCATTATCCTGACATCTAGCAAGATCTTTGTAGTAGTCTTGCATGAGCCGTTCT
ACGGGCACTTCTTCCTCACCCGTTCTGCCATGCATACGTGTGAGTCCAAACCCGC
GCATTGGTTGAACCAGTGCCAAGTCAGCTACGACTCTTTCGGCGAGGATGGCTT
GCTGTACTTGGGTGAGGGTGGCTTGAAAGTCATCAAAATCCACGAAGCGGTGGT
AAGCCCCGGTATTAATGGTGTAAGCACAGTTGGCCATGACTGACCAGTTAACTG
TCTGGTGACCAGGGCGCACGAGCTCGGTGTATTTAAGTCGCGAATAGGCGCGGG
TGTCAAAGATGTAATCGTTGCAGGTGCGCACCAGATACTGGTACCCTATAAGAA
AATGTGGCGGTGGTTGGCGGTAGAGAGGCCATCTTTCTGTAGCTGGAGCGCCGG
GGGCGAGGTCTTCCAACATAAGGCGGTGATAGCCGTAGATGTACCTGGACATCC
AGGTGATTCCTGCGGCGGTAGTAGAAGCCCGAGGAAACTCGCGTACGCGGTTCC
AAATGTTGCGTAGCGGCATGAAGTAGTTCATTGTAGGTACGGTTTGACCAGTGA
GGCGCGCGCAGTCATTGATGCTCTATAGACACGGAGAAAATGAAAGCGTTCAGC
GACTCGACTCCGTAGCCTGGAGGAACGTGAACGGGTTGGGTCGCGGTGTACCCC
GGTTCGAGACTTGTACTCGAGCCGGCCGGAGCCGCGGCTAACGTGGTATTGGCA
CTCCCGTCTCGACCCAGCCTACAAAAATCCAGGATACGGAATCGAGTCGTTTTGC
TGGTTGCCGAATGGCAGGGAAGTGAGTCCTATTTTTTTTTTTTGCCGCTCAGAT
GCATCCCGTGCTGCGACAGATGCGTCCCCAACAACAGCCCCCCTCGCAGCAGCA
GCAGCAACCACAAAAGGCTGTCCCTGCAACTACTGCAACTGCCGCCGTGAGCGG
TGCGGGACAGCCCGCCTATGATCTGGACTTGGAAGAGGGCGAAGGACTGGCACG
TCTAGGTGCGCCTTCGCCCGAGCGGCATCCGCGAGTTCAACTGAAAAAGATTC
TCGCGAGGCATATGTGCCCAACAGAACCTATTTAGAGACAGAAGCGGCGAGGA
GCCGGAGGAAATGCGAGCTTCCCGCTTTAACGCGGGTCGTGAGCTGCGTCACGG
TTTGGATCGAAGACGAGTGTTGCGGGACGAGGATTTTGAAGTTGATGAAGTGAC
AGGAATCAGTCCTGCCAGGGCACACGTGGCTGCCGCCAACCTTGTATCGGCTTA
CGAGCAGACAGTAAAGGAAGAGCGTAACTTTCAAAAGTCTTTTAATAATCATGT
GCGAACACTGATTGCCCGCGAAGAGGTCACCCTTGGTTTGATGCATTTGTGGGAT
TTGATGGAAGCTATCATTCAGAACCCTACTAGCAAACCTCTGACCGCGCAGCTGT
TTCTGGTGGTGCAACACAGCAGAGACAATGAGGCTTTCAGAGAGGCGCTTCTCA
ACATCACCGAACCCGAGGGGAGATGGTTGTATGATCTTATCAACATTCTACAAA
GTATCATAGTGCAGGAGCGGAGCCTGGGCCTGGCCGAGAAGGTGGCTGCCATCA
ATTACTCGGTTTTGAGCTTGGGAAAATATTACGCTCGCAAGATCTACAAAACTCC
```

TABLE 7-continued

Nucleic Acid Sequences of Vectors

SEQ ID NO Sequence

ATACGTTCCCATAGACAAGGAGGTGAAGATAGATGGGTTCTACATGCGCATGAC
GCTGAAGGTGCTGACCCTGAGCGATGATCTTGGGGTGTACCGCAATGACAGAAT
GCATCGCGCGGTTAGCGCCAGCAGGAGGCGCGAGTTAAGCGACAGGGAACTGA
TGCACAGTTTGCAAAGAGCTCTGACTGGAGCTGGAACCGAGGGTGAGAATTACT
TTGACATGGGAGCTGACTTGCAGTGGCAGCCTAGTCGCAGGGCTCTGAGCGCCG
CTACGGCAGGATGTGAGCTTCCTTACATAGAAGAGGCGGATGAAGGCGAGGAG
GAAGAGGGCGAGTACTTGGAAGACTGATGGCACAACCCGTGTTTTTTGCTAGAT
GGAACAGCAAGCACCGGATCCCGCAATGCGGGCGGCGCTGCAGAGCCAGCCGT
CCGGCATTAACTCCTCGGACGATTGGACCCAGGCCATGCAACGTATCATGGCGT
TGACGACTCGCAACCCCGAAGCCTTTAGACAGCAACCCCAGGCCAACCGTCTAT
CGGCCATCATGGAAGCTGTAGTGCCTTCCCGCTCTAATCCCACTCATGAGAAGGT
CCTGGCCATCGTGAACGCGTTGGTGGAGAACAAAGCTATTCGTCCAGATGAGGC
CGGACTGGTATACAACGCTCTCTTAGAACGCGTGGCTCGCTACAACAGTAGCAA
CGTGCAAACCAATTTGGACCGTATGATAACAGATGTACGCGAAGCTGTGTCTCA
GCGCGAAAGGTTCCAGCGCGATGCCAACTTGGGTTCGCTGGTGGCGTTAAATGC
TTTTTTGAGTACTCAGCCTGCTAATGTGCCGCGCGGTCAACAGGATTATACTAAC
TTTTTGAGTGCATTGAGACTGATGGTATCTGAAGTACCTCAGAGCGAAGTGTATC
AGTCCGGACCTGACTACTTCTTTCAGACTAGCAGACAGGGCTTGCAGACGGTAA
ATCTGAGCCAAGCTTTTAAAAACCTTAAAGGTTTGTGGGGAGTGCATGCCCCGG
TAGGAGAAAGAGCAACCGTATCTAGCTTGTTAACTCCGAACTCCCGCCTATTACT
ACTGTTGGTAGCTCCTTTCACCGACAGCGGTAGCATCGACCGTAATTCCTATTTG
GGTTACCTACTAAACCTGTATCGCGAAGCCATAGGGCAAAGCCAGGTGGACGAG
CAGACCTATCAAGAAATTACCCAAGTCAGTCGCGCTTTGGGTCAGGAAGACACT
GGCAGTTTGGAAGCCACTCTGAACTTCTTGCTTACCAATCGATCTCAGAAGATCC
CTCCTCAATATGCTCTTACTGCAGAGGAGGAGAGGATCCTTAGATATGTGCAGC
AGAGTGTGGGATTGTTTCTGATGCAAGAGGGGGCAACTCCGACTGCAGCACTGG
ACATGACTGCGCGAAATATGGAGCCCAGCATGTATGCCAGTAACCGACCTTTCA
TTAACAAACTGCTGGACTACTTGCACAGAGCTGCCGCTATGAACTCTGATTATTT
CACCAATGCCATCTTAAACCCGCACTGGCTGCCCCCACCTGGTTTCTACACGGGC
GAATATGACATGCCCGACCCTAATGACGGGTTTCTGTGGGACGACGTGGACAGC
GATGTTTTTCACCTCTTTCTGATCATCGCGCGTGGAAAAAGGAAGGCGGCGATA
GAATGCATTCTTCTGCATCGCTGTCCGGGTCATGGGTGCTACCGCGGCTGAGCC
CGAGTCTGCAAGTCCTTTTCCTAGTCTACCCTTTTCCCTACACAGTGTACGTAGC
AGCGAAGTGGGTAGGATAAGTCGCCCGAGTTTAATGGGCGAAGAGGAGTACCT
AAACGATTCCTTGCTCAGACCGGCGAGAGAAAAAAATTTCCCAAACAATGGAAT
AGAAAGTTTGGTGGATAAAATGAGTAGATGGAAGACTTATGCTCAGGATCACAG
AGACGAGCCTGGGATCATGGGGACTACAAGTAGAGCGAGCCGTAGACGCCAGC
GCCATGACAGACAGAGGGGTCTTGTGTGGGACGATGAGGATTCGGCCGATGATA
GCAGCGTGTTGGACTTGGGTGGGAGAGGAAGGGGCAACCCGTTTGCTCATTTGC
GCCCTCGCTTGGGTGGTATGTTGTAAAAAAAAATAAAAAGAAAAACTCACCAAG
GCCATGGCGACGAGCGTACGTTCGTTCTTCTTTATTATCTGTGTCTAGTATAATG
AGGCGAGTCGTGCTAGGCGGAGCGGTGGTGTATCCGGAGGGTCCTCCTCCTTCG
TACGAGAGCGTGATGCAGCAGCAGCAGGCGACGGCGGTGATGCAATCCCCACTG
GAGGCTCCCTTTGTGCCTCCGCGATACCTGGCACCTACGGAGGGCAGAAACAGC
ATTCGTTACTCGGAACTGGCACCTCAGTACGATACCACCAGGTTGTATCTGGTGG
ACAACAAGTCGGCGGACATTGCTTCTCTGAACTATCAGAATGACCACAGCAACT
TCTTGACCACGGTGGTGCAGAACAATGACTTTACCCCTACGGAAGCCAGTACCC
AGACTATTAACTTTGATGAACGATCGCGGTGGGCGGTCAGCTAAAGACCATCA
TGCATACTAATATGCCAAACGTGAACGAGTATATGTTTAGTAACAAGTTCAAAG
CGCGTGTGATGGTGTCCAGAAAAGCTCCTGAAGGTGTTACAGTAGACAATAATT
ATGATCATAAGCAAGATATTCTAAAATACGAGTGGTTCGAGTTCACTTTGCCAG
AGGGCAACTTTTCGGTCACTATGACTATTGACTTGATGAACAATGCCATCATAGA
CAACTACTTAAAAGTTGGCAGACAGAATGGAGTGCTGGAAAGTGACATCGGTGT
TAAGTTCGACACCAGGAACTTCAAGCTGGGATGGGATCCCGAAACCAAGTTGAT
CATGCCTGGAGTGTATACGTATGAAGCCTTCCATCCTGACATTGTTTTACTGCCT
GGCTGCGGAGTGGACTTTACCGAGAGTCGTTTGAGCAACCTTCTTGGTATCAGA
AAAAAACAGCCATTCCAAGAGGGTTTTAAGATCTTGTATGAAGATTTAGAAGGT
GGTAATATTCCGGCTCTCTTGGATGTAGATGCCTATGAGAACAGTAAGAAAGAA
CAAAAAGCCAAAATAGAAGCTGCTATAGCTGCTGCAGAAGCTAAGGCAAACAT
AGTTGCCAGCGACTCTACAAGGGTTGCTAACGCTGGAGAGGTCAGAGGAGACAA
TTTTGCGCCAACACCTGTTCCGACTACAGAATCATTATTGGCCGATATGTCTGAA
GGAACGGACGTAAAACTCACTATTCAACCTGTAGAAAAGATAGTAAGAATAG
AAGCTATAATGTGTTGGAAGATAAAATCAACACAGCCTATCGCAGTTGGTACCT
TTCGTACAATTATGGCGACCCCGAAAAAGGAGTGCGTTCCTGGACATTGCTCAC
CACCTCAGATGTCACCTGCGGAGCGGAGCAGGTCTACTGGTCGCTTCCAGACAT
GATGCAGGATCCTGTCACTTTCCGCTCCACTAGACAAGTCAGTAACTACCCTGTG
GTGGGTGCAGAGCTTATGCCCGTCTTCTCAAAGAGCTTCTACAACGAACAAGCT
GTGTACTCCCAGCAGCTCCGCCAGTCCACCTCGCTTACGCACGTCTTCAACCGCT
TTCCTGAGAACCAGATTTTAATCCGTCCGCCGGCGCCCACCATTACCACCGTCAG
TGAAAACGTTCCTGCTCTCACAGATCACGGGACCCTGCCGTTGCGCAGCAGTATC
CGGGGAGTCCAACGTGTGACCGTTACTGACGCCAGACGCCGCACCTGTCCCTAC
GTGTACAAGGCACTGGGCATAGTCGCACCGCGCGTCCTTTCAAGCCGCACTTTCT
AAAAAAAAAAATGTCCATTCTTTATCTCACCCAGTAATAACACCGGTTGGGGTCT
GCGCGCTCCCAGCAAGATGTACGGAGGCGCACGCAAACGTTCTACCCAACATCC
CGTGCGTGTTCGCGGTCATTTTCGCGCTCCATGGGGTGCCCTCAAGGGCCGCACT
CGCGTTCGAACCACCGTTGATGATGTAATCGATCAGGTGGTTGCCGACGCCCGT

TABLE 7-continued

Nucleic Acid Sequences of Vectors

| SEQ ID NO | Sequence |
|---|---|
| | AATTATACTCCTACTGCGCCTACATCTACTGTGGACGCAGTTATTGACAGTGTAG
TGGCTGACGCTCGCAACTATGCTCGACGTAAGAGCCGACGAAGGCGCATTGCCA
GACGTCACCGAGCTACCACTGCCATGCGAGCCGCAAGAGCTCTGCTACGAAGAG
CTAGACGCGTGGGACGAAGAGCCATGCTTAGGGCGGCCAGACGTGCAGCTTCGG
GCGCCAGCGCCGGCAGGTCCCGCAGGCAAGCTGCCGCTGTCGCAGCGGCGACTA
TTGCCGACATGGCCCAATCGCGAAGAGGCAATGTATACTGGGTGCGTGACGCTG
CCACCGGTCAACGTGTACCCGTGCGCACCCGTCCCCCTCGCACTTAGAAGATACT
GAGCAGTCTCCGATGTTGTGTCCCAGCGGCGAGGATGTCCAAGCGCAAATACAA
GGAAGAAATGCTGCAGGTTATCGCGCCTGAAGTCTACGGCCAACCGTTGAAGGA
TGAAAAAAAACCCCGCAAAATCAAGCGGGTAAAAAAGGACAAAAAAGAAGAG
GAAGATGGCGATGATGGGCTGGCGGAGTTTGTGCGCGAGTTTGCCCCACGGCGG
CGCGTGCAATGGCGTGGACGCAAAGTTCGACATGTGTTGAGACCTGGAACTTCG
GTGGTCTTTACACCCGGCGAGCGTTCAAGCGCTACTTTTAAGCGTTCCTACGATG
AGGTGTACGGGGATGATGATATTCTTGAGCAGGCAGCTGACCGATTAGGCGAGT
TTGCTTATGGCAAGCGTAGTAGAATAAATCCCAAGGATGAGACAGTGTCCATAC
CCTTGGATCATGGAAATCCCACCCCTAGTCTTAAACCGGTCACTTTGCAGCAAGT
GTTACCCGTAACTCCGCGAACAGGTGTTAAACGCGAAGGTGAAGATTTGTATCC
CACTATGCAACTGATGGTGCCCAAACGCCAGAAGTTGGAGGACGTTTTGGAGAA
AGTAAAAGTGGATCCAGATATTCAACCTGAGGTTAAAGTGAGACCCATTAAGCA
GGTAGCGCCTGGTCTGGGAGTACAAACTGTAGACATTAAGATTCCCACTGAAAG
TATGGAAGTGCAAACTGAACCCGCAAAGCCTACTGCCACCTCCACTGAAGTGCA
AACGGATCCATGGATGCCCATGCCTATTACAACTGACGCCGCCGGTCCCACTCG
AAGATCCCGACGAAAGTACGGTCCAGCAAGTCTGTTGATGCCCAATTATGTTGT
ACATCCATCTATTATTCCTACTCCTGGTTACCGAGGCACTCGCTACTATCGCAGC
CGAAACAGTACCTCCCGCCGTCGCCGCAAGACACCTGCAAATCGCAGTCGTCGC
CGCAGACGCACAAGCAAACCGACTCCCGGCGCCCTGGTGCGGCAAGTGTACCGC
AATGGTAGTGCGGAACCTTTGACACTGCCGCGTGCGCGTTACCATCCGAGTATC
GTCACTTAATCAATGTTGCCGCTGCCTCCTTGCAGATATGGCCCTCACTTGTCGC
CTTCGCGTTCCCATCACTGGTTACCGAGGAAGAAACTCGCGCCGTAGAAGAGGG
ATGTTGGGGCGCGGAATGCGACGCTACAGGCGACGGCGTGCTATCCGCAAGCAA
TTGCGGGGTGGTTTTTTGCCAGCCTTAATTCCAATTATCGCTGCTGCGATTGGCG
CAATACCAGGCATAGCTTCCGTGGCGGTTCAGGCCTCGCAACGACATTGACATT
GGAAAAAAAAACGTATAAATAAAAAAAAATACAATGGACTCTGACACTCCTGG
TCCTGTGACTATGTTTTCTTAGAGATGGAAGACATCAATTTTTCATCCTTGGCTCC
GCGACACGGCACGAAGCCGTACATGGGCACCTGGAGCGACATCGGCACGAGCC
AACTGAACGGGGGCGCCTTCAATTGGAGCAGTATCTGGAGCGGGCTTAAAAATT
TTGGCTCAACCATAAAAACATACGGGAACAAAGCTTGGAACAGCAGTACAGGA
CAGGCGCTTAGAAATAAACTTAAAGATCAGAACTTCCAACAAAAAGTAGTCGAT
GGGATAGCTTCCGGCATCAATGGAGTGGTAGATTTGGCTAACCAGGCTGTGCAA
AAAAAGATAAACAGTCGTTTGGACCCGCCGCCAGCAACCCCAGGTGAAATGCAA
GTGGAGGAAGAAATTCCTCCACCAGAAAAACGAGGCGACAAGCGTCCGCGTCC
CGATTTGGAAGAGACGCTGGTGACGCGCGTAGATGAACCGCCTTCTTATGAGGA
AGCAATGAAGCTTGGAATGCCCACCACCAGACCGATAGCCCCTATGGCCACCGG
GGTGATGAAACCTTCTCAGTTGCATCGACCCGTCACCTTGGATTTGCCCCCTCCC
CCTGCTGCTACTGCTGTACCCGCTTCTAAGCCTGTCGCTACCCCGAAACCAGTCG
CCGTAGCCAGGTCACGTCCCGGGGGCGCTCCTCGTCCAAATGCGCACTGGCAAA
ATACTCTGAACAGCATCGTGGGTCTAGGCGTGCAAAGTGTAAAACGCCGTCGCT
GCTTTTAATTAAATATGGAGTAGCGCTTAACTTGCCTATCTGTGTATATGTGTCA
TTACACGCCGTCACAGCAGCAGAGGAAAAAAGGAAGAGGTCGTGCGTCGACGC
TGAGTTACTTTCAAGATGGCCACCCCATCGATGCTGCCCCAATGGGCATACATGC
ACATCGCCGGACAGGATGCTTCGGAGTACCTGAGTCCGGGTCTGGTGCAGTTCG
CCCGCGCCACAGACACCTACTTCAATCTTGGAAATAAGTTTAGAAATCCCACCGT
AGCGCCGACCCACGATGTGACCACCGACCGTAGCCAGCGGCTCATGTTGCGCTT
CGTGCCCGTTGACCGGGAGGACAATACATACTCTTACAAAGTGCGGTACACCCT
GGCCGTGGGCGACAACAGAGTGCTGGATATGGCCAGCACGTTCTTTGACATTAG
GGGCGTGTTGGACAGAGGTCCCAGTTTCAAACCTTATTCTGGCACGGCTTACAAC
TCCCTGGCTCCTAAAGGCGCTCCAAATGCATCTCAGTGGTTGGATAAGGGAGTT
ACAAGCACTGGTCTAGTGGACGACGGGAATGGTGATGATGGGAAGAAGCCAA
AAAAGCAACATACACTTTTGGTAATGCTCCAGTAAAAGCCGAGGCTGAAATCAC
AAAAGACGGATTGCCGGTGGGCTTGGAAGTTTCAACTGAAGGTCCTAAACCAAT
CTATGCTGATAAGCTTTATCAGCCAGAACCTCAAGTGGGAGACGAAACTTGGAC
TGACCTAGACGGAAAAACCGAAGAGTATGGAGGGAGGGTTCTTAAACCTGAAA
CTAAAATGAAACCCTGCTACGGATCTTTTGCTAAACCTACTAATATTAAAGGAG
GTCAGGCAAAGGTAAAACCAAAAGAAGACGATGGCACTAACAACATCGAATAT
GACATTGACATGAACTTCTTTGACTTAAGATCACAAAGATCAGAACTGAAACCT
AAAATTGTAATGTATGCAGAAAATGTGGACCTGGAATCTCCAGATACTCATGTT
GTGTACAAACCTGGAGTTTCAGATGCTAGTTCTGAGACCAATCTTGGACAACAG
TCTATGCCCAACAGACCCAACTACATTGGCTTCAGAGATAACTTATCGGACTTA
TGTACTATAACAGTACTGGCAACATGGGGTATTGGCTGGCCAAGCGTCTCAGT
TGAATGCAGTGGTTGACTTGCAGGACAGAAACACAGAACTGTCTTACCAACTCT
TGCTTGACTCCCTGGGCGACAGAACCAGATACTTTAGCATGTGGAATCAGGCTG
TGGACAGTTATGATCCTGATGTACGTGTTATTGAAAATCATGGTGTGGAAGATG
AACTTCCCAACTATTGTTTTCCGTTGGATGGTGTCGGTCCGCGAACAGATAGTTA
CAAGGAGATTAAACCAAATGGAGACCAATCTACTTGGACGAATGTAGACCCGAA
TGGCAGCAGTGAACTTGCTAAGGGAAATCCATTTGCCATGGAAATTAACCTTCA
AGCCAATCTATGGCGAAGTTTCCTTTATTCCAATGTGGCTCTGTATCTCCCAGAC |

TABLE 7-continued

Nucleic Acid Sequences of Vectors

SEQ ID NO Sequence

TCGTACAAATACACCCCGTCCAATGTCACTCTTCCAGAAAACAAAAACACCTAC
GACTACATGAACGGGCGGGTGGTGCCGCCATCTCTAGTAGACACCTATGTGAAC
ATTGGCGCCAGGTGGTCTCTGGATGCCATGGACAATGTGAACCCATTCAACCAC
CACCGTAACGCTGGCTTGCGTTACCGATCCATGCTTCTGGGTAACGGACGTTATG
TGCCTTTCCACATACAAGTGCCTCAAAAATTCTTCGCTGTTAAAAACCTGCTGCT
TCTCCCAGGCTCCTACACTTATGAGTGGAACTTTAGGAAGGATGTGAACATGGTT
CTACAGAGTTCCCTCGGTAATGACCTGCGGGTAGATGGCGCCAGCATCAGTTTC
ACGAGCATCAACCTCTATGCTACTTTTTTCCCAATGGCTCACAACACCGCTTCCA
CCCTTGAAGCCATGCTGCGGAATGACACCAATGATCAGTCATTCAACGACTACC
TATCTGCAGCTAACATGCTCTACCCCATTCCTGCCAATGCAACCAATATTCCCAT
TTCAATTCCTTCTCGCAACTGGGCGGCTTTCAGAGGCTGGTCATTTACCAGACTG
AAAACCAAAGAAACTCCCTCTTTGGGGTCCGGATTTGACCCATACTTTGTCTATT
CTGGTTCTATTCCCTACCTGGATGGTACCTTCTACCTGAACCACACACTTTTAAGAA
GGTTTCCATCATGTTTGACTCTTCAGTGAGCTGGCCTGGAAACGACAGGTTACTA
TCTCCTAACGAATTTGAAATAAAGCGCACTGTGGATGGCGAAGGCTACAACGTA
GCCCAATGCAACATGACCAAAGACTGGTTCTTGGTACAGATGCTCGCCAACTAC
AACATCGGCTATCAGGGCTTCTACATTCCAGAAGGATACAAAGATCGCATGTAT
TCATTTTTCAGAAACTTCCAGCCCATGAGCAGGCAGGTGGTTGATGAAGTCAATT
ACAAAGACTTCAAGGCCGTCGCCATACCCCTACCAACACAACAACTCTGGCTTTG
TGGGTTACATGGCTCCGACTATGCGCCAAGGTCAACCCTATCCCGCTAACTATCC
CTATCCACTCATCGGAACTACTGCCGTAAATAGTGTTACGCAGAAAAAGTTCTTG
TGTGACAGAACCATGTGGCGCATACCGTTCTCCAGCAACTTCATGTCTATGGGGG
CCCTTACAGACTTGGGCAGAACATGCTCTATGCCAACTCAGCTCATGCTCTGGA
CATGACCTTCGAGGTGGATCCCATGGATGAGCCCACCCTGCTTTATCTTCTCTTC
GAAGTTTTCGACGTGGTCAGAGTGCATCAGCCACACCGCGGCATCATCGAGGCA
GTCTACCTGCGTACACCGTTCTCGGCCGGTAACGCTACCACGTAAGAAGCTTCTT
GCTTCTTGCAAACAGCAGCTGCAACCATGGCCTGCGGATCCCAAAACGGCTCCA
GCGAGCAAGAGCTCAGAGCCATTGTCCAAGACCTGGGTTGCGGACCCTATTTTTT
GGGAACCTACGATAAGCGCTTCCCGGGGTTCATGGCTCCCGATAAGCTCGCCTG
TGCCATTGTAAATACGGCCGGACGTGAGACGGGGGGAGAGCACTGGTTGGCTTT
CGGTTGGAACCCACGTTCTAACACCTGCTACCTTTTTGATCCTTTTGGATTCTCGG
ATGATCGTCTCAAACAGATTTACCAGTTTGAATATGAGGGTCTCCTGCGCCGCAG
CGCTCTTGCTACCAAGGACCGCTGTATTACGCTGGAAAAATCTACCCAGACCGT
GCAGGGCCCCCGTTCCGCCGCCTGCGACTTTTCTGCTGCATGTTCCTTCACGCC
TTTGTGCACTGCCTGACCGTCCCATGGACGGAAACCCCACCATGAAATTGCTA
ACTGGAGTGCCAAACAACATGCTTCATTCTCCTAAAGTCCAGCCCACCCTGTGTG
ACAATCAAAAAGCACTTTATCATTTTCTCAATACCCATTCGCCTTATTTTCGCTCT
CATCGCACACACATCGAAAGGGCCACTGCGTTTGACCGTATGGATGTGCAATAA
TGATTCATGTAAACAACGTGTTCAATAAACAGCACTTTATTTTTTACATGTATCA
AGGCTCTGGATTACTTATTTATTTACAAGTCGAATGGGTTCTGACGAGAATCAGA
ATGACCCGCAGGCAGTGATACGTTGCGGAACTGATACTTGGGTTGCCACTTGAA
TTCGGGAATCACCAACTTCGGAACCGGTATATCGGGCAGGATGTCACTCCACAG
CTTTCTAGTCAGCTGCAAAGCTCCCAGCAGGTCAGGAGCCGAAATCTTGAAATC
ACAATTAGGACCAGTGCTCTGAGCGCGAGAGTTGCGGTACACCGGATTGCAGCA
CTGAAACACCATCAGCGACGGATGTCTCACGCTTGCCAGCACGGTGGGATCTGC
AATCATGCCCACATCCAGATCTTCAGCATTGGCAATGCTGAACGGGGTCATCTTG
CAGGTCTGCCTACCCATGGCGGGCACCCAATTAGGCTTGTGGTTACAATCGCAGT
GCAGGGGATCAGTATCATCTTGGCCTGATCCTGTCTGATTCCTGGATACACGGC
TCTCATGAAAGCATCATATTGCTTGAAAGCCTGCTGGGCTTTACTACCCTCGGTA
TAAAACATCCCGCAGGACCTGCTCGAAAACTGGTTAGCTGCGCAGCCGGCATCA
TTCACACAGCAGCGGGCGTCATTGTTGGCTATTTGCACCACACTTCTGCCCCAGC
GGTTTTGGGTGATTTTGGTTCGCTCGGGATTCTCCTTCAAGGCTCGTTGTCCGTTC
TCGCTGGCCACATCCATCTCGATAATCTGCTCCTTCTGAATCATAATATTGCCAT
GCAAGCACTTCAGCTTGCCCTCATAATCATTGCAGCCATGAGGCCACAACGCAC
AGCCTGTACATTCCCAATTATGGTGGGCGATCTGAGAAAAAGAATGTATCATTC
CCTGCAGAAATCTTCCCATCATCGTGCTCAGTGTCTTGTGACTAGTGAAAGTTAA
CTGGATGCCTCGGTGCTCCTCGTTTACGTACTGGTGACAGATGCGCTTGTATTGT
TCGTGTTGCTCAGGCATTAGTTTAAAAGAGGTTCTAAGTTCGTTATCCAGCCTGT
ACTTCTCCATCAGCAGACACATCACTTCCATGCCTTTCTCCCAAGCAGACACCAG
GGGCAAGCTAATCGGATTCTTAACAGTGCAGGCAGCAGCTCCTTTAGCCAGAGG
GTCATCTTTGGCGATCTTCTCAATGCTTCTTTTGCCATCCTTCTCAACGATGCGCA
CGGGCGGGTAGCTGAAACCCACTGCTACAAGTTGCGCCTCTTCTCTTTCTTCTTC
GCTGTCTTGACTGATGTCTTGCATGGGGACATGTTTGGTCTTCCTTGGCTTCTTTT
TGGGGGGTATCGGAGGAGGAGGACTGTCGCTCCGTTCCGGAGACAGGGAGGATT
GTGAAGTTTCGCTCACCATTACCAACTGACTGTCGGTAGAAGAACCTGACCCCA
CACGGCGACAGGTGTTTCTCTTCGGGGCAGAGGTGGAGGCGATTGCGAAGGGC
TGCGGTCCGACCTGGAAGGCGGATGACTGGCAGAACCCCTTCCGCGTTCGGGGG
TGTGCTCCCTGTGGCGGTCGCTTAACTGATTTCCTTCGCGGCTGGCCATTGTGTTC
TCCTAGGCAGAGAAACAACAGACATGGAAACTCAGCCATTGCTGTCAACATCGC
CACGAGTGCCATCACATCTCGTCCTCAGCGACGAGGAAAAGGAGCAGAGCTTAA
GCATTCCACCGCCCAGTCCTGCCACCACCTCTACCCTAGAAGATAAGGAGGTCG
ACGCATCTCATGACATGCAGAATAAAAAGCGAAAGAGTCTGAGACAGACATC
GAGCAAGACCCGGGCTATGTGACACCGGTGGAACACGAGGAAGAGTTGAAACG
CTTTCTAGAGAGAGGATGAAAACTGCCCAAAACAGCAAGCGGATAACTATCA
CCAAGATGCTGGAAATAGGGATCAGAACACCGACTACCTCATAGGGCTTGACGG
GGAAGACGCGCTCCTTAAACATCTAGCAAGACAGTCGCTCATAGTCAAGGATGC

TABLE 7-continued

Nucleic Acid Sequences of Vectors

| SEQ ID NO | Sequence |
|---|---|
| | ATTATTGGACAGAACTGAAGTGCCCATCAGTGTGGAAGAGCTCAGCCGCGCCTA |
| | CGAGCTCAACCTCTTTTCACCTCGTACTCCCCCCAAACGCCAGCCAAACGGCACC |
| | TGCGAGCCAAATCCTCGCTTAAACTTTTATCCAGCTTTTGCTGTGCCAGAAGTAC |
| | TGGCTACCTATCACATCTTTTTTAAAAATCAAAAAATTCCAGTCTCCTGCCGCGC |
| | TAATCGCACCCGCGCCGATGCCCTACTCAATCTGGGACCTGGTTCACGCTTACCT |
| | GATATAGCTTCCTTGGAAGAGGTTCCAAAGATCTTCGAGGGTCTGGGCAATAAT |
| | GAGACTCGGGCCGCAAATGCTCTGCAAAAGGGAGAAAATGGCATGGATGAGCA |
| | TCACAGCGTTCTGGTGGAATTGGAGGGCGATAATGCCAGACTCGCAGTACTCAA |
| | GCGAAGCGTCGAGGTCACACACTTTGCATATCCCGCTGTCAACCTGCCCCCTAAA |
| | GTCATGACGGCCGTCATGGACCAGTTACTCATTAAGCGCGCAAGTCCCCTTTCAG |
| | AAGACATGCATGACCCAGATGCCTGTGATGAGGGTAAACCAGTGGTCAGTGATG |
| | AGCAACTAACCCGATGGCTGGGCACCGACTCTCCCCGGGATTTGGAAGAGCGTC |
| | GCAAGCTTATGATGGCCGTGGTGCTGGTTACCGTAGAACTAGAGTGTCTCCGGC |
| | GTTTCTTTACCGATTCAGAAACCTTGCGCAAACTCGAAGAGAATCTGCACTACAC |
| | TTTTAGACACGGCTTTGTGCGGCAGGCATGCAAGATATCTAACGTGGAACTCAC |
| | CAACCTGGTTTCCTACATGGGTATTCTGCATGAGAATCGCCTAGGACAAAGCGT |
| | GCTGCACAGCACCCTTAAGGGGGAAGCCCGCCGTGATTACATCCGCGATTGTGT |
| | CTATCTCTACCTGTGCCACACGTGGCAAACCGGCATGGGTGTATGGCAGCAATG |
| | TTTAGAAGAACAGAACTTGAAAGAGCTTGACAAGCTCTTACAGAAATCTCTTAA |
| | GGTTCTGTGGACAGGGTTCGACGAGCGCACCGTCGCTTCCGACCTGGCAGACCT |
| | CATCTTCCCAGAGCGTCTCAGGGTTACTTTGCGAAACGGACTGCCTGACTTTATG |
| | AGCCAGAGCATGCTTAACAATTTTCGCTCTTTCATCCTGGAACGCTCCGGTATCC |
| | TGCCCGCCACCTGCTGCGCACTGCCCTCCGACTTTGTGCCTCTCACCTACCGCGA |
| | GTGCCCCCCGCCGCTATGGAGTCACTGCTACCTGTTCCGTCTGGCCAACTACCTC |
| | TCCTACCACTCGGATGTGATCGAGGATGTGAGCGGAGACGGCTTGCTGGAGTGT |
| | CACTGCCGCTGCAATCTGTGCACGCCCCACCGGTCCCTAGCTTGCAACCCCCAGT |
| | TGATGAGCGAAACCCAGATAATAGGCACCTTTGAATTGCAGGGCCCCAGCAGCC |
| | AAGGCGATGGGTCTTCTCCTGGGCAAAGTTTAAAACTGACCCCGGGACTGTGGA |
| | CCTCCGCCTACTTGCGCAAGTTTGCCCCGGAAGATTACCACCCCTATGAAATCAA |
| | GTTCTATGAGGACCAATCACAGCCTCCGAAGGCCGAACTTTCGGCCTGCGTCATC |
| | ACCCAGGGGGCAATTCTGGCCCAATTGCAAGCCATCCAAAAATCCCGCCAAGAA |
| | TTTCTACTGAAAAAGGGTAAGGGGGTCTACCTTGACCCCCAGACCGGCGAGGAA |
| | CTCAACACAAGGTTCCCTCAGGATGTCCCAACGACGAGAAAGCAAGAAGTTGAA |
| | GGTGCAGCCGCCGCCCCCAGAAGATATGGAGGAAGATTGGGACAGTCAGGCAG |
| | AGGAAGCGGAGGAGGAGGAGGACAGTCTGGAGGACAGTCTGGAGGAAGACAGT |
| | TTGGAGGAGGAAAACGAGGAGGCAGAGGAGGTGGAAGAAGTAACCGCCGACA |
| | AACAGTTATCCTCGGCTGCGGAGACAAGCAACAGCGCTACCATCTCCGCTCCGA |
| | GTCGAGGAACCCGGCGGCGTCCCAGCAGTAGATGGGACGAGACCGGACGCTTCC |
| | CGAACCCAACCAGCGCTTCCAAGACCGGTAAGAAGGATCGGCAGGGATACAAG |
| | TCCTGGCGGGGCATAAGAATGCCATCATCTCCTGCTTGCATGAGTGCGGGGGC |
| | AACATATCCTTCACGCGACGCTACTTGCTATTCCACCATGGGGTGAACTTTCCGC |
| | GCAATGTTTTGCATTACTACCGTCACCTCCACAGCCCCTACTATAGCCAGCAAAT |
| | CCCGGCAGTCTCGACAGATAAAGACAGCGGCGGCGACCTCCAACAGAAAACCA |
| | GCAGCGGCAGTTAGAAAACACACAACAAGTGCAGCAACAGGAGGATTAAAGAT |
| | TGCAGCCAACGAGCCAGCGCAAACCCGAGAGTTAAGAAATCGGATCTTTCCAAC |
| | CCTGTATGCCATCTTCCAGCAGAGTCGGGGCCAAGAGCAGGAACTGAAAATAAA |
| | AAACCGATCTCTGCGTTCGCTCACCAGAAGTTGTTTGTATCACAAGAGCGAAGA |
| | TCAACTTCAGCGCACTCTCGAGGACGCCGAGGCTCTCTTCAACAAGTACTGCGC |
| | GCTGACTCTTAAAGAGTAGGCAGCGACCGCGCTTATTCAAAAAAGGCGGGAATT |
| | ACATCATCCTCGTCATGAGTAAAGAAATTCCCACGCCTTACATGTGGAGTTACCA |
| | GCCCCAAATGGGATTGGCGGCAGGCGCCTCCCAGGACTACTCCACCCGCATGAA |
| | TTGGCTCAGCGCCGGGCCCTCTATGATTTCTCGAGTTAATGATATACGCGCCTAC |
| | CGAAACCAAATACTTTTGGAACAGTCAGCTCTTACCACCACGCCCCGCCAACAC |
| | CTTAATCCCAGAAATTGGCCCGCCGCCCTAGTGTACCAGGAAAGTCCCGCTCCC |
| | ACCACTGTATTACTTCCTCGAGACGCCCAGGCCGAAGTCCAAATGACTAATGCA |
| | GGTGCGCAGTTAGCTGGCGGCTCCACCCTATGTCGTCACAGGCCTCGGCATAAT |
| | ATAAAACGCCTGATGATCAGAGGCCGAGGTATCCAGCTTAACGACGAGTCGGTG |
| | AGCTCTCCGCTTGGTCTACGACCAGACGGAATCTTTCAGATTGCCGGCTGCGGGA |
| | GATCTTCCTTCACCCCTCGTCAGGCTGTTCTGACTTTGGAAAGTTCGTCTTCGCAA |
| | CCCCGCTCGGGCGGAATCGGGACCGTTCAATTTGTGGAGGAGTTTACTCCCTCTG |
| | TCTACTTCAACCCCTTCTCCGGATCTCCTGGGCACTACCCGGACGAGTTCATACC |
| | GAACTTCGACGCGATTAGCGAGTCAGTGGACGGCTACGATTGATGTCTGGTGAC |
| | GCGGCTGAGCTATCTCGGCTGCGACATCTAGACCACTGCCGCCGCTTTCGCTGCT |
| | TTGCCCGGGAACTCATTGAGTTCATCTACTTCGAACTCCCCAAGGATCACCCTCA |
| | AGGTCCGGCCCACGGAGTGCGGATTACTATCGAAGGCAAAATAGACTCTCGCCT |
| | GCAACGAATTTTCTCCCAGCGGCCCGTGCTGATCGAGCGAGACCAGGGAAACAC |
| | CACGGTTTCCATCTACTGCATTTGTAATCACCCCGGATTGCATGAAAGCCTTTGC |
| | TGTCTTATGTGTACTGAGTTTAATAAAAACTGAATTAAGACTCTCCTACGGACTG |
| | CCGCTTCTTCAACCCGGATTTTACAACCAGAAGAACGAAACTTTTCCTGTCGTCC |
| | AGGACTCTGTTAACTTCACCTTTCCTACTCACAAACTAGAAGCTCAACGACTACA |
| | CCGCTTTTCCAGAAGCATTTTCCCTACTAATACTACTTTCAAAACCGGAGGTGAG |
| | CTCCACGGTCTCCCTACAGAAAACCCTTGGGTGGAAGCGGGCCTTGTAGTGCTA |
| | GGAATTCTTGCGGGTGGGCTTGTGATTATTCTTTGCTACCTATACACACCTTGCTT |
| | CACTTTCCTAGTGGTGTTGTGGTATTGGTTTAAAAAATGGGCCCATACTAGTCT |
| | TGCTTGTTTTACTTTCGCTTTTGGAACCGGGTTCTGCCAATTACGATCCATGTCTA |
| | GACTTCGACCCAGAAAACTGCACACTTACTTTTGCACCCGACACAAGCCGCATCT |

TABLE 7-continued

Nucleic Acid Sequences of Vectors

SEQ ID NO Sequence

GTGGAGTTCTTATTAAGTGCGGATGGGACTGCAGGTCCGTTGAAATTACACACA
ATAACAAAACCTGGAACAATACCTTATCCACCACATGGGAGCCAGGAGTTCCCG
AGTGGTACACTGTCTCTGTCCGAGGTCCTGACGGTTCCATCCGCATTAGTAACAA
CACTTTCATTTTTTCTGAAATGTGCGATCTGGCCATGTTCATGAGCAAACAGTAT
TCTCTATGGCCTCCCAGCAAGGACAACATTGTAACGTTCTCCATTGCTTATTGCT
TGTGCGCTTGCCTCCTTACTGCTTTACTGTGCGTATGCATACACCTGCTTGTAACC
ACTCGCATCAAAAACGCCAATAACAAAGAAAAAATGCCTTAACCTCTTTCTGTTT
ACAGACATGGCTTCTCTTACATCTCTCATATTTGTCAGCATTGTCACTGCCGCTCA
CGGACAAACAGTCGTCTCTATCCCTCTAGGACATAATTACACTCTCATAGGACCC
CCAATCACTTCAGAGGTCATCTGGACCAAATTGGGAAGCGTTGATTACTTTGATA
TAATCTGTAACAAAACAAAACCAATAATAGTAACTTGCAACATACAAATCTTA
CATTAATTAATGTTAGCAAAGTTTACAGCGGTTACTATTATGGTTATGACAGATA
CAGTAGTCAATATAGAAATTACTTGGTTCGTGTTACCCAGTTCAAAACCACAAA
AATGCCAAATATGGCAAAGATTCGATCCGATGACAATTCTCTAGAAACTTTTAC
ATCTCCCACCACACCTGACGAAAAAAACATCCCAGATTCAATGATTGCAATTAT
CGCAGCGGTGGCAGTGGTGATGGCACTAATAATAATATGCATGCTTTTATATGCT
TGTCGCTACAAAAAGTTTCATCCTAAAAAACAAGATCTCCTACTAAGGCTTAAC
ATTTAATTTCTTTTTATACAGCCATGGTTTCCACTACCACATTCCTTATGCTTACT
AGTCTCGCAACTCTGACTTCTGCTCGCTCACACCTCACTGTAACTATAGGTTCAA
ACTGCACACTAAAAGGACCTCAAGGCGGCCATGTCTTTTGGTGGAGAATATATG
ACAATGGATGGTTTACAAAACCATGTGACCAACCTGGTCGATTTTTCTGCAACGG
CAGAGACCTAACCATTGTCAACGTGACAGCAAGTGACAAAGGCTTCTATTATGG
AACCGACTATCAAACTAGTTTAGATTATAACATTATTGTACTGCCATCCACCACT
CCAGCACCCCGCAAAACTACTTTCTCTAGCAGCAGTGCCGCTAACAATACAATTT
CCAATCCAACCTTTGCCGCGCTTTTAAAACGCACTGTGAATAATTCTACAACTTC
ACATACAACAATTTCCATTTCAACAATCAGCATTATTGCTGCCGTGACAATTGGA
ATATCTATTCTTGTTTTTACCATAACCTACTACGCCTGCTGCTATAGAAAAGACA
AACATAAAGGTGATCCATTACTTAGATTTGATATTTAATTTGTTCTTTTTTTAT
TTACAGTATGGTGAACACCAATCATGGTACCTAGAAATTTCTTCTTCACCATACT
CATCTGTGCTTTTAATGTTTGCGCTACTTTCACAGCAGTAGCCACAGCAACCCCA
GACTGTATAGGAGCATTTGCTTCCTATGCACTTTTTGCTTTTGTCACTTGCATCTG
CGTATGTAGCATAGTCTGCCTGGTTATTAATTTTTTCCAACTTCTAGACTGGATCC
TTGTGCGAATTGCCTACCTGCGCCACCATCCCGAATACCGCAACCAAAATATCGC
GGCACTTCTTAGACTCATCTAAAACCATGCAGGCTATACTACCAATATTTTTGCT
TCTATTGCTCCCCTACGCTGTCTCAACTCCAGCTGCCTATAGTACTCCGCCAGAA
CACCTTAGAAAATGCAAATTCCAACAACCGTGGTCATTTCTTGCTTGCTATCGAG
AAAAATCAGAAATTCCCCCAAATTTAATAATGATTGCTGGAATAATTAATATAA
TCTGCTGCACCATAATTTCATTTCTGATATACCCCCTATTTGATTTTGGCTGGAAT
GCTCCCAATGCACATGATCATCCACAAGACCCAGAGGAACACATTCCCCTACAG
AACATGCAACATCCAATAGCGCTAATAGAATACGAAAGTGAACCACAACCCCCA
CTACTCCCTGCTATTAGTTACTTCAACCTAACCGGCGGAGATGACTGAAACACTC
ACCACCTCCAATTCCGCCGAGGATCTGCTTGATATGGACGGCCGCGTCTCAGAA
CAGCGACTCGCCCAACTACGCATCCGCCAACAGCAGGAACGCGTGGCCAAAGA
GCTCAGAGATGTCATCCAAATTCACCAATGCAAAAAAGGCATATTCTGTCTGGT
AAAACAAGCCAAGATATCCTACGAGATCACCGCTACTGACCATCGCCTCTCTTAT
GAGCTTGGCCCCCAACGACAAAAATTTACCTGCATGGTGGGAATCAACCCCCATA
GTTATCACCCAGCAAAGTGGAGATACTAAGGGTTGCATTCACTGCTCCTGCGATT
CCATCGAGTGCACCTACACCCTGCTGAAGACCCTATGCGGTCTAAGAGACCTGC
TACCAATGAATTAAAAAAAATGATTAATAAAAAATCACTTACTTGAAATCAGCA
ATAAGGTCTCTGTTGAATTTTCTCCCAGCAGCACCTCACTTCCCTCTTCCCAACT
CTGGTATTCTAAACCCCGTTCAGCGGCATACTTTCTCCATACTTTAAATGGGATG
TCAAATTTTAGCTCCTCTCCTGTACCCACAATCTTCATGTCTTTCTTCCCAGATGA
CCAAGAGAGTCCGGCTCAGTGACTCCTTCAACCCTGTCTACCCCTATGAAGATGA
AAGCACCTCCCAACACCCCTTTATAAACCCAGGGTTTATTTCCCCAAACGGCTTC
ACACAAAGCCCAGACGGAGTTCTTACTTTAAAATGTTTAACCCCGCTAACAACC
ACAGGCGGGTCTCTACAGTTAAAAGTGGGAGAGGGTCTTACAGTAGATGACACC
GGGTTTTTGAAAGAAAACATAAGTGCTACCACACCACTCGTTAAGACTGGTCAC
TCTATAGGTTTGTCGCTAGGACCCGGATTAGGAACAAATGAAAATAAACTTTGT
ACCAAATTGGGAGAAGGACTTACATTCAATTCGAACAACATTTGCATTGATGAC
AATATTAACACCCTATGGACAGGAGTTAACCCCACCAGAGCCAACTGTCAAATG
ATGGACTCCAGTGAATCTAATGATTGCAAATTAATTCTAACACTAGTTAAAACTG
GAGCCCTAGTCACTGCATTTGTTTATGTTATAGGAGTATCTAACGATTTTAATAT
GCTAACTACACAGAAAATATAAATTTTACTGCAGAGTCTGTTTTTCGATTCTACT
GGTAATTTACTAACTAGCCTCTCATCCCTAAAAACTCCACTTAATCATAAATCAG
GGCAAAACATGGCTACTGGTGCCATTACTAATGCTAAAGGTTTCATGCCCAGCA
CAACTGCCTATCCTTTCAATAATAATTCCAGAGAAAAGAAAACTACATTTACG
GAACTTGTTACTACACAGCTAGTGATCACACTGCTTTTCCCATTGACATATCTGT
CATGCTTAACCGAAGAGCAATAAATGATGAGACATCATATTGTATTCGTATAAC
TTGGTCCTGGAGCACAGGAGTTGCCCCAGAAGTGCAAACCTCTGCTACTACCCT
AGTCACCTCTCCATTTACCTTTTACTACATCAGAAGACGACTGACAAATAAAG
TTTAACTTGTTTATTTGAAAATCAATTCACAAAATTCGAGTAGTTATTTTGCCTCC
CCCCTTCCCATTTAACAGAATACACCAATCTCTCCCCACGCACAGCTTTAAACATT
TGGATACCATTAGAGATAGACATAGTTTTAGATTCCACATTCCAAACAGTTTCAG
AGCGAGCCAATCTGGGGTCAGTGATAGATAAAAATGCATCTGGATAGTCTTTTA
AAGCGCTTTCACAGTCCAACTGCTGCGGGTGCGACTCCGGAGTCTGAATCACGG
TCATCTGGAAGAAGAACGATGGGAATCATAATCCGAAAACGGGATCGGGCGATT

TABLE 7-continued

Nucleic Acid Sequences of Vectors

| SEQ ID NO | Sequence |
|---|---|
| | GTGTCTCATCAAACCCACAAGCAGCCGCTGTCTGCGTCGCTCCGTGCGACTGCTG<br>TTTATGGGATCGGGGTCCACAGTGTCCTGAAGCATAATTTTAATAGCCCTTAACA<br>TTAACTTTCTGGTGCGATGCGCGCAGCAACGCATTCTGATCTCACTTAGATTACT<br>ACAGTAGGTACAGCACATTATCACAATATTGTTTAATAAACCATAATTAAAAGC<br>GCTCCAGCCAAAACTCATATCTGATATAATCGCCCCTGCATGACCATCATACCAA<br>AGTTTAATATAAATTAAATGTCGTTCCCTCAAAAACACACTACCCACATACATGA<br>TCTCTTTTGGCATGTGCATATTAACAATCTGTCTGTACCATGGACAACGTTGGTT<br>AATCATGCAACCCAATATAACCTTCCGGAACCACACTGCCAACACCGCTCCCCC<br>AGCCATGCATTGAAGTGAACCCTGCTGATTACAATGACAATGAAGAACCCAATT<br>CTCTCGACCGTGAATCACTTGAGAATGAAAAATATCTATAGTAGCACAACATAG<br>ACATAAATGCATGCATCTTCTCATAATTTTTAACTCCTCAGGATTTAGAAACATA<br>TCCCAGGGAATAGGAAGCTCTTGCAGAACAGTAAAGCTGGCAGAACAAGGAAG<br>ACCACGAACACAACTTACACTATGCATAGTCATAGTATCACAATCTGGCAACAG<br>CGGGTG |
| SEQ ID NO: 1428 | CATCATCAATAATATACCTTATAGATGGAATGGTGCCAATATGTAAATGAGGTG<br>GTTTGAAAATGGAGAGCGGAAGGGGATTGGCTTGGGGTTCAACGGTCACGGGGC<br>GGCGCGGGAAGGTGACGTATGCGTGGGTGTGGCTAAGATGCAAGCTGTCGCGGT<br>ATTTCTGACGTAAACGAGGTGGAGTTTAAACACGGAAGTACACAGTTTCCCGCG<br>CTTATTGACAGGAAATGAGGTAGTTTTGGGCGGATGCAAGTGAAAATTCCTCAT<br>TTTCGCGCGAAAACTGAATGAGGAAGTGAATATCTGAGTAATTTCGTGTTTATGA<br>CAGGGTGGAGTATTTACCGAGGGCCGAGTAGACTTTGACCGATTACGTGGAGGT<br>TTCGATTACCGTGTTTTTCACCTAAATTTCCGCGTACGGTGTCAAAGTCCTGTGTT<br>TTTACGTAGGTGTCAGCTGATCGCCAGGGTATTTAAACCTGACGAGTTCCGTCAA<br>GAGGCCACTCTTGAGTGCCAGCGAGAAGAGTTTTCTCCTCCGCGCTGCGAGTCA<br>GATCTCCACTTCGAAAATGAGACACCTGCGTTTCCTGTCCCAGGAGATAGTCTCC<br>ACTGAAACTGGGAATGAAATACTGCAGTTTGTGGTAAATACTCTGATGGGAGAC<br>GATCCAGAGCCGCCTGAGCCATCTTTTGATCCTCCTACGCTTCATGAATTATATG<br>ATTTAGAGGTAGACGGACCGGAGGACCCTAATGAGGACGACGTGAATGGGTTTT<br>TTACTGATTCTATGTTATTAGCTGCTAATGAGGGAGTGGATTTAGACCCACCTTC<br>TGGAACTCTTGATACTCCAGGGGTGATTGTGGAAAGCGACATAAATGGGAAAAA<br>TTTACCTGATTTGGGTGCTGCTGAATTGGACTTGCACTGCTATGAAGAGGGTTTT<br>CCTCCGAGTGATGATGAAGATGTGGAGAATGAGCAGTCAATTCAGACCGCAGCG<br>GGTGAGGTAGTGAAAGCAGCCAGTGATGGTTTTAAGTTGGACTGCCCGATGCTG<br>CCTGGACATGGCTGTAAGTCTTGTGAATTTCACAGGAAAAATACTGGAGTAAAA<br>GAAATATTATGCTCGCTTTGTTATATGAGAGCGCATTGCCACTTTATTTACAGTA<br>AGTGTGTTTAAGTTAAATTTAAAGGAACAGTAGCTGTTTTTATAACTCTTGGATG<br>GGTGATTTATGTTTTGCTTGTGATTTTTTATAGGTCCTGTGTCTGATGCTGATGAA<br>TCGCCTTCTCCTGATTCAACTACCTCACCTCCTGAAATTCAGGCACCCGTCCCTG<br>CAAATGTATGCAAGCCCATTCCTGTGAAGCTTAAGCCTGGGAAACGCCCTGCTG<br>TGGATAAACTTGAGGATTTGCTGGAGGGTGTGGATGAACCTTTGGACTTGTGTAC<br>CCGGAAAATACCAAGGCAATGAGTGCCCCGCACCTGTGTTTATTTAATGACGTC<br>ACTATTTATGTGAGAGTGCCATGTAATAAAATTATGTCAGCTGCTGAGTGTTTTA<br>TTGTTTCTTGGGTGGGACTTGGGATATATAAGTAGGAGCAGACCTGTGTGGTTAG<br>CTCACAGCAGCTTGCTTCCATCCATGGAGGTTTGGGCCATCTTGGAAGATCTTAG<br>GCAGACTAGGCAACTGCTAGAAAAACGCCTCGGACGGAGTCTCTGGTCTTTGGAG<br>ATTCTGGTTCGGTGGTGATCTGGCTAGACTAGTCTTTAGAATAAAACAGGATTAC<br>AGGCAAGAATTTGAAAAGTTATTGGACGACTGTCCAGGACTTTTTGAAGCTCTTA<br>ACTTGGGCCACCAGGCTCATTTTAAGGAGAAGGTTTTATCAGTTTTGGATTTTTC<br>TACCCCTGGTAGAACTGCTGCTGCTGTAGCTTTCCTTACATTCATATTTGATAAAT<br>GGATCCCACAGACCCACTTCAGCAAGGGATACGTTTTGGATTTCATAGCAGCAG<br>CTTTGTGGAGAACATGGAAGGCTCGCAGGATGAGGACAATCTTAGATTACTGGC<br>CAGTACAGCCTCTGGGCGTAGCAGGGATCCTGAGACACCCACCGACCATGCCAG<br>CGGTTTTGGAGGAGGAGCACCAAGAGGACAATCCGAGAGTCGGCCTGGACCCTC<br>CGGTGGAGGAGGCGGAGGAGTAGCTGACTTGTTTCCTGAACTGCGACGGGTGCT<br>TACTAGATCTACAACCAGTGGACGGGACAGGGGCATTAAGAGGGAAAGGGAATC<br>CTAGTGGAACTAATCCCAGATCTGAGTTGGCTTTAAGTTTGATGAGTCGCAGACG<br>TCCTGAAACTATATGGTGGCATGAGGTTCAGAATGAGGGCAGGGATGAAGTATC<br>AATATTGCAAGAGAAATATTCTCTAGAACAGGTGAAAACATGTTGGTTGGAGCC<br>TGAGGATGATTGGGAGGTTGCCATTAGGAATTATGCCAAGATAGCTTTGAGGCC<br>TGATAAATTGTACAGAATTACTAAACGGATTAATATTAGAAATGCATGTTATATA<br>TCAGGGAATGGGCTGAGGTAGTGATAGACACTCAAGACAGAACAGTTTTTAGA<br>TGCTGCATGATGGTATGTGGCCAGGGGTGGTTGGCATGGAGGCAGTAACCCTT<br>ATGAATGTAAAGTTTAGAGGGGATGGGTATAATGGTGTGGTTTTTATGGCTAAT<br>ACTAAATTGATTTTGCATGGTTGTAGCTTTTTTGGTTTTAATAATATATGTGTGGA<br>AGCTTGGGGCAGGTGAGTGTAAGAGGCTGTAGTTTCTATGCATGCTGGATTGC<br>AACATCAGGCAGGACCAAGAGTCAATTGTCTGTAAAGAAATGTATGTTTGAGAG<br>ATGTAACCTGGGCATACTGAATGAAGGAGAAGCCAGAGTCAGCCACTGTGCTTC<br>TTCCGAAACTGGCTGTTTCATATTGATAAAGGGAAATGCCAATGTGAAACATAA<br>TATGATCTGTGGACCCTCAGATGAGAGGCCTTATCAGATGCTGACATGTGCTGGC<br>GGACATTGCAATATGCTGGCTACCGTGCATATTGTTTCTCACCCACGCAAGAAT<br>GGCCTGTTTTGGAACATAATGTGATGACCAAATGCACTATGCACGTAGGTGGTC<br>GCAGAGGAATGTTAATGCCATACCAGTGTAACATGAATAATGTGAAAGTGATGT<br>TGGAGCCAGATGCATTTTCCAGAATGAGTTTAACAGGAATCTTTGACATGAATCT<br>GCAAATATGGAAGATCCTGAGATATGATGACACGAAGTCGAGGGTACGCGCATG<br>CGAGTGCGGGGGCAAACATGCCAGGTTCCAGCCGGTGTGTGTGGATGTGACTGA |

TABLE 7-continued

Nucleic Acid Sequences of Vectors

SEQ ID NO Sequence

```
AGAACTAAGGCCAGATCATTTGGTGATTGCCTGCACTGGAGCGGAGTTCGGTTC
TAGTGGTGAAGAAACTGACTAAAGTGAGTAGTAGTGGGATGGTTTGGATGGACT
CTAATGTGAATAAGATGGACAGATTGGGTAAATTTTTGTTTTTTCTGTCTTGCAG
CTGTCATGAGTGGAAGCGCTTCTTTTGAGGGGGGAGTCTTTAGCCCTTATCTGAC
GGGCCGTCTCCCACCATGGGCAGGAGTACGTCAGAATGTCATGGGATCTACTGT
GGATGGGAGACCAGTCCAGCCCGCCAATTCATCAACACTGACCTATGCCACTTT
GAGCTCTTCACCCTTGGATGCAGCTGCAGCTGCTGCCGCCTCTGCTGCCGCCAAC
ACCGTCCTTGGAATTGGCTATTATGGAAGCATCGTTGCCAATACCAGTTCCTCAA
ATAACCCTTCGACCCTGGCTGAGGACAAGCTACTTGTTCTTTTGGCGCAGCTTGA
GGCGTTGACCCAGCGCCTGGGTGAACTGTCTCAGCAGGTGGCCCAGCTGCGCGA
GCAAACTGAGTCTGCTGTTGCCACAGCAAAGTCTAAATAAAGATTAATCAATAA
ATAAAGGAGATACTTGTTGATTTTAAACTGTAATGAATCTTTATTTGATTTTTCGC
GCACGGTATGCCCTGGACCACCGGTCTCGATCATTGAGAACTCGGTGGATCTTTT
CCAGGACCCTGTAGAGGTGGGATTGAATGTTTAGATACATTGGCATTAGGCCGT
CTCGAGGGTGGAGATAGCTCCATTGAAGAGCCTCGTGTTCCGGGGTAGTGTTAT
AAATCACCCAGTCATAACAAGGTCGGAGTGCATGATGTTGCACAATATCTTTAA
GGAGCAGGCTGATTGCAACTGGGAGCCCCTTGGTGTATGTGTTTACAAATCTGTT
GAGCTGAGATGGATGCATTCTGGGTGAAATTATATGCATTTTTGACTGGATCTTG
AGGTTGGCAATGTTGCCGCCCAGATCCCGTCTCGGGTTCATGTTATGCAGGACCA
CCAAGACGGTGTATCCGGTGCACTTAGGAAATTTATCATGCAGCTTAGATGGAA
AAGCATGAAAAAATTTGGAGACGCCTTTGTGTCCGCCCAAATTCTCCATGCACTC
ATCCATAATGATAGCAATGGGGCCGTGGGCGGCGGCACGGGCAAACACGTTCCG
GGGATCTGACACATCATAGTTATGCTCCTGAGACAGGTCATCATAAGCCATTTTA
ATAAACTTTGGGCGTAGGGTGCCAGATTGGGGTATAAATGTTCCCTCGGGCCCC
GGAGCATAGTTTCCCTCACAGATTTGCATTTCCCAGGCTTTCAGTTCAGAGGGGG
GGATCATGTCCACCTGCGGGCTATAAAAAATACCGTTTCTGGGGCTGGGGTGA
TTAACTGTGATGATAGCAAATTCCTTAGCAGCTGTGACTTGCCACACCCAGTGGG
GCCGTAAATGACCCCGATTACGGGTTGCAGATGGTAGTTTAGGGAGCGGCAGCT
GCCGTCCTCTCGGAGCAGGGGGCCACTTCGTTCATCATTTCCCTTACATGGATA
TTTTCCCGCACCAAGTCCGTTAGGAGGCGCTCTCCACCTAGGGATAAAAGTTCCT
GGAGGGAGGAGAAGTTTTTGAGCGGCTTCAGCCCGTCAGCCATGGGCATTTTGG
AGAGAGTCTGTTGCAAGAGCTCGAGCCGATCCCAAAGCTCGGTTATGTGTTCTAT
GGCATCTCGATCCAGCAAACCTCCTCGTTTCGCGGATTGGGGCGGCTCCTGGAGT
AGGGTATCAGACGATGGGCGTCCAGCGCTGCCAGTGTCCGATCCTTCCATGGTC
GCAGCGTCCGAGTCAGGGTTGTTTCCGTCACGGTGAATGGGTGCGCGCCTGGTT
GTGCGCTTGCGAGGGTGCGCCTCAGGCTCATCCTGCTGGTCGAGAACCGCTGCC
GATCGGCGCCTGCATGTCGGCCAGGTAGCAGTTTACCATGAGTTCGTAGTTGA
GCGCTTCGGCCGCATGGCCTTTGGCGCGGAGCTTACCTTTGGAAGTTTTGTGACA
GGAGGGACAGTATAGACACTTAAGGGCATACAGCTTGGGTGCGAGGAAGATTG
ATTCGGGGAGTATGCATCTGCGCCGCAGGAGGCGCAGACAGTTTCGCATTCCA
CGAGCCATGTCAGATCTGGTTCATCTGGGTCAAAAACAAGTTTTCCGCCATATTT
TTTGATGCGTTTCTTACCTTTTGTCTCCATGAGTTCGTGTCCTCGCTGGGTGACAA
AGAGGCTGTCTGTGTCCCCGTAGACCGACTTTATAGGCCTGTCCTCGAGCGGAGT
GCCTCGGTCCTCTTCGTATAGGAATCCCGACCACTCTGATACAAAGGCGCGTGTC
CAGGCTAGCACAAATGAGGCTACTTGGGAAGGGTAGCGGTCGTTGTCAACCAGG
GGGTCCACCTTCTCTACAGTATGTAAACACATGTCCCCCTCCTCCACATCCAGAA
ATGTGATTGGCTTGTAAAGGTATGCCACGTGACCGGGAGTCCCAGCCGGGGGGG
TATAAAAGGGGCGGGTCTCTGTTCGTCCTCACTGTCTTCCGGATCGCTGTCCAG
GAGCGCCAACTGTTGGGGTAGGTATTCCCTCTCGAAGGCAGGCATAACCTCTGC
ACTCAGGTTGTCAGTTTCTAGGAACGATGAGGATTTGATATTGACAGTGCCTGCT
GAGATGCCTTTCATGAGACTTTCGTCCATTTGGTCAGAAAAGACAATCTTTTTGT
TGTCCAACTTGGTAGCAAAGGATCCATATAGGGCATTGGATAGGAGCTTGGCTA
TGGAGCGCATGGTTTGATTCTTTTCCTTGTCCGCGCGTTCCTTGGCGGCGATGTTC
AGCTGGACATATTCGCGCGCCAGGCACTTCCATTCAGGGAAGATGGTTGTCAGT
TCATCCGGCACAATTCTGACTTGCCAGCCCCTATTATGTAGGGTTATCAGATCCA
CACTGGTGGCCACCTCTCCTCGAAGAGGTTCGTTGGTCCAGCAGAGCCGACCCC
CCTTTCTCGAACAGAAAGGGGGTAGAGGGTCTAGCATGAGCTCATCAGGGGGT
CTGCATCCATGGTGAAGATTCCTGGAAGTAGGTCCTTGTCAAAATAGCTGATGG
GGGTGGGATCATCTAAAGCCATCTGCCATTCTCGAGCTGCTAGCGCGCGCTCATA
TGGGTTCAGTGGTGTACCCCAGGGCATGGGATGGGTGAGCGCAGAGGCATACAT
GCCACAGATGTCATAGACATAAAGGGGCTCTTCTAGTATGCCGATGTATGTGGG
ATAACATCGCCCCCCTCTGATGCTTGCTCGCACATAATTATAGAGCTCATGAGAT
GGGGCAAGGAGACCCGGGCCCAGATTAGTGCGGTTGGGCTTCTCTGCCCTGTAG
ACAATTTGGCGAAAGATGGCATGGAATTAGAAGAGATAGTTGGCCTTTGGAAT
ATGTTAAAGTGGGCATGGGTAAACCTACAGAATCCCTGATGAAGTGGGCATAT
GATTCTTGCAACTTGGCCACTAGCTCTGCGGTGACCAGGACGTCCATGGCGCAGT
AGTCGAGGGTCTCTTTGATGATGTCATAACCTGGTTGGTTTTTTTTTTCCCACAGC
TCGCGGTTGAGGAGGTATTCTTCGCGATCCTTCCAGTACTCTTCGAGGGGAAACC
CGTCTTTGTCTGCACGGTAAGAGCCCAGCATGTAGAATTGATTGACTGCCTTGTA
AGGACAGCACCCCTTCTCCACAGGGAGAGAGTATGCTTGAGCGGCTTTGCGCAG
TGAGGTATGAGTAAGGGCGAAGGTGTCCCTGACCATAACTTTGAGGAACTGGTA
CTTGAAGTCGATGTCGTCACACGTCCCCTGTTCCCAGAGTTGGAAGTCCACCCGC
TTCTTGTAGGCGGGGTTGGGCAAAGCGAAAGTAACATCGTTGAAGAGAATCTTG
CCGGCCCTGGGCAAAAATTGCGGGTAATGCGGAAAGGCTGGGGCACCTCTGCT
CGATTATTGATCACTTGCGCAGCTAGGACGATCTCGTCAAAGCCGTTAATGTTGT
GCCCCACTATGTACATTTCTATGAATCGTGGGGAGCCTCTGATGTGAGGTAGCTT
```

TABLE 7-continued

Nucleic Acid Sequences of Vectors

SEQ ID NO Sequence

TTTGAGCTCTTCGAAGGTGAGGTCTGTAGGGTCAGAGAGAGCGTAGTGTTCGAG
GGCCCATTCGTGCAGGTGAGGGTTTGCATTCATGAAAGATGACCAAAGATCCAC
TGCCAGTGCTGTTTGTAACTGGTCCCGGTACTGGCGAAAATGCTGACCGACTGCC
ATCTTTTCTGGGGTGACACAGTAGAATGTTTTGGGGTCCTGCTGCCAACGATCCC
ACTTGAGTTTCATGGCGAGATCGTAGGCGATGTTGACGAGCCGTTCGTCCCCCGA
AAGTTTCATGACCAGCATGAAGGGGACTAGCTGCTTTCCAAAGGACCCCATCCA
GGTGTAGGTTTCCACATCGTAGGTGAGGAAGAGCCTTTCTGTGCGAGGATGAGA
GCCAATCGGGAAGAACTGGATCTCCTGCCACCAGTTGGAGGAATGGCTGTTGAT
GTGATGGAAGTAGAACTCCCTTCGGCGCGCCGAGCATTCATGCTTGTGCTTGTAC
AGACGGCCGCAGTACTCGCAGCGCTGCACGGGATGCACCTCATGAATGAGTTGT
ACCTGGTTTCCTTTGACAAGAAATTTCAGTGGGAAGTTGAGGCCTGGCGTCTGTA
CCTCGTGCTCTACTATGTTATTTGCATCGGCCTGGCCATCTTCTGTCTCGATGGTG
GTCATGCTGACGAGACCCCGCGGGAGGCAAGTCCAGATCTCGGCGCGGGAGGG
GCGGAGCTCGAGGACGAGAGCGCGCAGGCCGGAACTGTCCAGGGTCCTGAGTC
GCTGCGGAGTCAGGTTAGTAGGGAGGCTCTGGAGATTGACTTGCAAGATTTTTTC
GAGGGCATGGGGGAGGTTAAGATGGTACTTGATCTCTACTGGTCCGTTGGTGGA
GATGTCGATGGCTTGCAGGGTTCCATGTCCCTTGGGCGCCACCACTGTGCCCTTG
TTTTTCCTTTTTGGCGGGAGTGGTGGTGGCTCTGTTGCTTCTTGCATGTTCAGAAT
CGGTGGCGAGGGCGAGCGCCGGGCGGTAGGGGCGGCTCGGGCCCCGGTGGCAT
GGCCGGCAGTGGCACGTCGGCGCCGCGTGCGGGTAGGTTCTGGTACTGCGCCCT
GAGAAGACTTGCGTGCGCAACGACGCGGCGGTTGACGTCTTGGATCTGCCGCCT
CTGGGTGAAAGCTACCGGACCCGTGAGCTTGAACCTGAAAGAGAGTTCAACAGA
ATCAATTTCGGTATCGTTAACGGCGGCCTGTCTCAGGATCTCTTGCACGTCGCCT
GAGTTGTCCTGGTAGGCGATCTCGGCCATGAATTGCTCGATTTCTTCCTCCTGAA
GATCTCCGCGACCCGCTCTCTCGACGGTGGCCGCGAGGTCGTTGGAAATGCGGG
CCATGAGTTGAGAGAATGCATTCATGCCCGCCTCGTTCCAGACGCGGCTGTAGA
CCACGGCCCCTTCGGGATCTCTTGCGCGCATGACCACCTGGGCAAGGTTGAGCTC
CACGTGGCGCGTGAAGACCGCATAGTTGCAGAGGCGCTGGTATAGGTAGTTGAG
TGTGGTGGCGATATGCTCGGTGACGAAGAAGTACATGATCCATCGTCTCAGCGG
CATTTCGCTGACATCGCCCAGGGCTTCCAAGCGCTCCATGGCCTCGTAGAAGTCC
ACGGCGAAGTTGAAAAACTGAGAGTTTCGCGCGGACACGGTCAACTCCTCCTCC
AGAAGACGGATGAGTTCGGCGATGGTGGCGCGCACTTCGCGCTCGAAGGCCCCC
GGGATTTCTTCCTCCTCTTCTAACTCTTCTTCCACTAACATCTCTTCTTCCTCTTCA
GGCGGGGCGGAGGAGGAGGAGGGGGTACGCGGCGACGCCGGCGGCGCACGG
GCAAACGGTCGATGAATCTTTCAATGACCTCTCCGCGGCGGCGGCGCATGGTCT
CGGTGACGGCACGGCCGTTCTCCCTGGGTCTCAAAGTGAAAACGCCTCCGCGCA
TCTCCCTGAAGTGGTGACTTGGGGGCTCTCCGTTGGGCAGTGAAAGGGCGCTGA
TTATGCACTTTATCAATTGTCCTGTAGGGACTCCGCGCAAGGACCTGATCGTCTC
AAGATCCACGGGATCTGAAAATCTTTCAACGAAAGCGTCTAACCAGTCGCAATC
GCAAGGTAGGCTGAGCACTGTTTCTTGCTGGCGGGGGTGGCTACACGCTCGGTC
GGGGTTCTCTCTTTCTTCTCCTTCCTCCTCTTGGGAGGGTGAGACGATGCTGCTGG
TGATGAAATTAAAATAGGCAGTTCTGAGACGGCGGATGGTGGCGAGGAGCACC
AGGTCTTTGGGACCGGCTTGCTGGATGCGCAGGCGATTGGCCATTCCCCAAGCA
TTATCCTGACACCTGGCCAGATTTTTGTAGTAGTCTTGCATAAGTCGCTCCACGG
GCACTTCTTCTTCGCCCGCTCTGCCATGCATGCGCGTGAGCCCAAACCCACGCAT
GGGCTGGATAAGTGCCAGGTCTGCTACGACCCTTTCTGCGAGGATGGCTTGCTGC
ACCTGAGTGAGGGTGGCTTGGAAGTCGTCGAAGTCCACAAAACGATGGTAGGCC
CCGGTGTTGATGGTGTAAGAGCAGTTGGCCATGACTGACCAGTTAACTGTCGGT
GCCCCGGGCGCACAAGCTCGGTGTACTTGAGGCGCGAGTAGGCGCGGGTGTCAA
AGATGTAATCGTTACAGGTGCGCACCAGGTACTGGTAGCCGATGAGAAAGTGCG
GCGGCGGCTGGCGGTATAGGGGCCATCGCTCTGTAGCCGGGGCGCCAGGGGCGA
GGTCTTCCAGCATGAGGCGGTGATAACCGTAGATGTACCTGGACATCCAGGTGA
TACCGGAGGCGGTGGTGGATGCCCGCGGGAACTCGCGTACGCGGTTCCAGATGT
TGCGCAGCGGCCATGAAGTAGTTCATGGTAGGCACGGTTTGGCCCGTGAGGCGCG
CACAGTCGTTGATGCTCTAGACATACGGGCAAAAACGAAAGCGGTCAGCGGCTC
GTCTCCGTGGCCTGGAGGCTAAGCGAACGGGTTGGGCTGCGCGTGTACCCCGGT
TCGAATCTCGGATCAGGCTGGAGCCGCAGCTAACGTGGTACTGGCACTCCCGTC
TCGACCCAGGCCTGCACAAAACCTCCAGGATACGGAGGCGGGTCGTTTTTTTTTT
TTTGCTTTTTCCTGGATTGGAGCCAGTGCTGCGTCAAGCTTTAGAACGCTCAGTT
CGCGGGGTTGGGAGTGGCTCGCGCCCGTAGTCTGGAGAATCAATCGCCAGGGTT
GCGTTGCGGTGTGCCCCGGTTCGAGTCTTAGCGCGCCGGATCGGCCGGTTTCCGC
GACAAGCGAGGGTTTGGCAGCCCCGTCATTTCTAAGACCCCGCCAGCCGACTTC
TCCAGTTTACGGGAGCGAGCCCTCTTTTTTTTTTTTGTTGCCCAGATGCATCCCG
TGCTGCGACAGATGCGCCCCCAGCAACAGCCCCCTTCTCAGCAGCAGCTACAGC
AACAGCCACAAAAGGCTCTTCCTGCTCCTGTAACTACTGCGGCTGCAGCCGTCA
GCGGCGCGGGACAGCCCGCCTATGATCTGGACTTGGAAGAGGGCGAGGGACTG
GCGCGCCTGGGTGCACCATCGCCCGAGCGGCACCCGGGTGCAACTGAAAAAG
GACTCTCGCGAGGCGTACGTGCCCCAGCAGAACCTGTTCAGGGACAGGAGCGGC
GAGGAGCCTGAGGAAATGCGAGCTTCCCGCTTTAACGCGGGTCGCGAACTGCGT
CACGGTCTGGACCGAAGACGGGTGCTGCGTGATGATGATTTTGAAGTCGATGAA
GTGACAGGAATAAGTCCTGCTAGGGCACATGTGGCCGCGGCCAACCTAGTATCA
GCTTACGAGCAGACCGTGAAGGAGGAGCGCAACTTTCAAAAATCTTTCAACAAC
CATGTGCGCACCCTGATTGCCCGCGAGGAAGTGACACTGGGTCTGATGCACCTG
TGGGACCTGATGGAAGCTATTACCCAGAACCCCACCAGCAAACCTCTGACCGCT
CAGCTGTTTCTGGTGGTGCAACATAGTAGAGACAATGAGGCATTTAGGGAGGCG
CTGTTGAACATTACTGAGCCCGAGGGGAGATGGTTGTATGATCTTATCAATATTC

TABLE 7-continued

Nucleic Acid Sequences of Vectors

SEQ ID NO Sequence

```
TGCAAAGTATAATAGTGCAAGAACGTAGCCTGGGTCTAGCTGAGAAGGTGGCTG
CTATTAACTACTCGGTCTTGAGCCTGGGCAAGCACTACGCTCGCAAGATCTACAA
AACCCCATACGTACCTATAGACAAGGAGGTGAAGATAGATGGGTTTTATATGCG
CATGACTCTCAAGGTGCTGACCTTGAGTGACGATCTGGGAGTGTACCGCAACGA
CAGGATGCACCGCGCAGTGAGCGCCAGCAGAAGGCGTGAGCTGAGCGACAGAG
AACTTATGCACAGCTTGCAAAGAGCTCTGACGGGGCTGGAACCGAGGGGGAG
AACTACTTTGACATGGGAGCGGACTTGCAGTGGCAGCCCAGTCGCAGGGCCCTG
GACGCAGCAGGGTATGAGCTTCCTTACATAGAAGAGGTGGATGCAGGCCAGGAT
GAGGAGGGCGAGTACCTGGAAGACTGATGGCGCGACCATCCATATTTTTGCTAG
ATGGAACAGCAGGCACCGGACCCCGCAATACGGGCGGCGCTACAGAGCCAGCC
GTCCGGCATTAACTCCTCGGACGATTGGAGCCAGGCCATGCAACGCATCATGGC
GCTGACGACCCGCAACCCCGAAGCCTTTAGACAGCAACCCCAGGCCAACCGCCT
TTCTGCCATCCTGGAGGCCGTAGTGCCCTCCCGCTCCAACCCCACACACGAGAA
GGTCCTGGCCATCGTGAACGCGCTGGTGGAGAACAAAGCCATACGTCCCGATGA
GGCTGGGCTGGTATACAATGCCCTATTGGAGCGCGTAGCCCGTTACAACAGCAG
CAACGTGCAGACCAACCTGGACCGGATGGTGACCGATGTGCGCGAGGCCGTGTC
CCAGCGCGAGCGGTTCCAGCGAGACGCCAATTTAGGGTCGCTGGTGGCTTTGAA
CGCCTTCCTCAGCACTCAGCCTGCCAACGTGCCTCGCGGTCAGCAAGACTACAC
AAACTTTCTAAGTGCATTAAGACTCATGGTGGCCGAAGTCCCTCAAAGCGAAGT
GTACCAGTCCGGGCCAGACTACTTTTTCCAGACCAGCAGACAGGGCTTGCAGAC
AGTGAACCTGAGCCAGGCTTTTAAGAACCTGAATGGTCTGTGGGGAGTGCGCGC
CCCAGTGGGAGATCGGGCGACCGTGTCTAGCTTGCTGACCCCCAACTCCCGCCT
ACTACTTCTCTTGGTAGCCCCATTCACTGACAGCGGTAGCATCGACCGTAATTCT
TACTTGGGCTATCTGTTGAACCTGTATCGCGAGGCCATAGGGCAAACTCAGGTA
GATGAGCAAACCTATCAAGAAATTACCCAAGTGAGCCGCGCTCTGGGTCAGGAG
GACACTGGCAGCTTGGAAGCCACCTTAAACTTCTTGCTGACCAACCGGTCGCAG
AAGATCCCTCCTCAGTATGCGCTTACCGCGGAGGAGGAACGGATCCTGAGATAC
GTGCAGCAGAGCGTGGGACTGTTCCTAATGCAGGAGGGGGCGACTCCTACTGCT
GCGCTCGATATGACAGCCCGAAACATGGAGCCCAGCATGTATGCCAGTAACCGG
CCTTTTATCAATAAACTGCTAGACTACTTACACAGGGCGGCTGCTATGAACTCTG
ATTATTTCACCAATGCTATCCTGAACCCCCATTGGCTGCCCCCACCTGGGTTCTA
TACGGGCGAGTATGACATGCCCGACCCCAATGACGGGTTTTTATGGGACGATGT
GGACAGTAGTGTTTTCTCCCCGCCTCCTGGTTATAACACTTGGAAGAAGGAAGGT
GGCGATAGAAGGCACTCTTCCGTGTCACTGTCCGGGGCAACGGGTGCTGCCGCA
GCGGTTCCCGAGGCTGCAAGTCCTTTCCCTAGTTTGCCATTTTCGCTAAACAGTG
TACGCAGCAGTGAGCTGGGAAGAATAACCCGTCCTCGCTTGATCGGCGAGGAGG
AGTATTTGAACGACTCCCTGTTGAGACCCGAGAGGGAGAAGAATTTCCCCAACA
ACGGGATAGAAAGCTTGGTTGACAAAATGAACCGCTGGAAGACGTACGCGCAC
GATCACAGGGACGATCCCCGGGCGCTGGGGGATAGCCGGGGCAGCGCTACCCGT
AAACGCCAGTGGCACGACAGGCAGCGGGGCCTGGTGTGGGCCGATGAGGATTC
CGCCGACGACAGCAGCGTGTTGGACTTGGGTGGGAGTGGTGGTAACCCGTTCGC
TCACCTGCGCCCCCGCGTCGGGCGCCTGATGTAAGAAACCGAAAATAAATACTT
ACCAAGGCCATGGCGACCAGCGTGCGTTCGTTTCTTCTCTGTTATATCTAGTATG
ATGAGGCGAACCGTGCTAGGCGGAGCGGTGGTGTATCCGGAGGGTCCTCCTCCT
TCGTACGAGAGCGTGATGCAGCAGGCGGCGGCGGCGGATGCAGCCACCACT
GGAGGCTCCCTTTGTACCCCCTCGGTACCTGGCACCTACGGAGGGGAGAAACAG
CATTCGTTACTCGGAGCTGGCACCATTGTATGATACCACCCGGTTGTATTTGGTG
GACAACAAGTCCGCGGACATCGCCTCACTGAACTATCAGAACGACCACAGCAAC
TTCCTCACCACGGTGGTGCAAAACAATGACTTTACCCCCACGGAGGCCAGCACC
CAGACCATCAACTTTGACGAGCGGTCGCGATGGGCGGTCAGCTGAAGACTATC
ATGCACACCAACATGCCCAACGTGAACGAGTACATGTTTAGCAACAAGTTCAAA
GCTCGGGTGATGGTGTCTAGAAAGGCTCCTGAAGGTGTCACAGTAGATGACAAT
TATGATCACAAGCAGGATATTTTGGAATATGAGTGGTTTGAGTTTACTCTACCGG
AAGGGAACTTCTCAGCCACAATGACCATTGACCTAATGAACAATGCCATCATTG
ATAATTACCTTGAAGTGGGCAGACAGAATGGAGTGTTGGAGAGTGACATTGGTG
TTAAATTTGACACCAGGAACTTTAGACTGGGTTGGGATCCGAAACTAAGTTGA
TTATGCCTGGGGTTTACACCTATGAGGCATTCCATCCTGACATTGTATTGTTGCCT
GGTTGCGGAGTTGACTTTACTGAAAGTCGCCTTAGTAACTTGCTTGGTATCAGGA
AAAGACACCCATTCCAGGAGGTTTTAAGATCTTGTATGAGGATCTTGAAGGGG
GTAATATCCCGCCCTGTTGGATGTAGAAGCCTATGAGAACAGTAAGAAAGAAC
AAGAAGCCAAAACAGAAGCCGCTAAAGCTGCTGCTATTGCTAAAGCCAACATAG
TTGTCAGCGACCCTGTAAGGGTGGCTAATGCCGAAGAAGTCAGAGGAGACAACT
ATACAGCTTCATCTGTTGCAACTGAAGAATCGCTATTGGCTGCTGTGGCCGAAAC
CGAAACTACAGAGACAAAACTCACTATTAAACCTGTAGAAAAAGACAGCAAGA
GTAGAAGTTACAATGTCTTGGAAGATAAAGTCAATACAGCCTACCGCAGCTGGT
ACCTGTCCTACAACTATGGTGACCCTGAAAAAGGAGTCCGTTCCTGGACACTGCT
CACCACCTCGGATGTCACCTGTGGAGCAGAGCAGGTGTACTGGTCGCTCCCAGA
CATGATGCAGGACCCTGTCACATTCCGTTCCACGAGACAAGTCAGCAACTATCC
AGTGGTAGGTGCAGAGCTCATGCCGGTCTTCTCAAAGAGTTTCTACAACGAGCA
AGCCGTGTACTCCCAGCAGCTTCGCCAGTCCACCTCGCTCACGCACGTCTTCAAC
CGCTTCCCTGAGAACCAGATCCTCATCCGCCCGCCAGCGCCCACCATTACCACCG
TCAGTGAAAACGTTCCTGCTCTCACAGATCACGGACCCTGCCGTTGCGCAGCA
GTATCCGGGGAGTCCAGCGCGTGACCGTTACTGACGCCAGACGCCGCACCTGCC
CCTACGTCTACAAGGCCCTGGGCATAGTCGCGCCGCGCGTCCTTTCAAGCCGCAC
TTTCTAAAAAAAAAAAAAATGTCCATTCTTATCTCACCTAGTAATAACACCGGTT
GGGGCCTGCGCGCGCCAAGCAAGATGTACGGAGGTGCTCGCAAACGCTCTACAC
```

TABLE 7-continued

Nucleic Acid Sequences of Vectors

SEQ ID NO Sequence

AGCACCCTGTGCGCGTGCGCGGGCACTTCCGCGCTCCATGGGGCGCCCTCAAGG
GTCGTACCCGCACTAGAACCACCGTCGATGATGTGATCGACCAGGTGGTGGCCG
ATGCTCGTAATTATACTCCTACTGCACCTACATCTACTGTGGATGCAGTTATTGA
CAGCGTAGTGGCTGACGCCCGCGCCTATGCTCGCCGGAAGAGCAGGCGGAGACG
CATCGCCAGGCGCCACCGGGCTACTCCCGCTATGCGAGCGGCAAGAGCTCTGCT
ACGGAGGGCCAAACGCGTGGGGCGAAGAGCTATGCTTAGAGCGGCCAGACGCG
CGGCTTCAGGTGCCAGTGCCGGCAGGTCCCGCAGGCGCGCAGCCACGGCGGCAG
CAGCGGCCATTGCCAACATGGCCCAACCGCGAAGAGGCAATGTGTACTGGGTGC
GCGACGCCACCACCGGCCAGCGCGTGCCCGTGCGCACCCGCCCCCCCTCGCTCTT
AGAAGATACTGAGCAGTCTCCGATGTTGTGTCCCAGCGAGGATGTCCAAGCGCA
AATACAAGGAAGAGATGCTCCAGGTCATCGCGCCTGAAATCTACGGTCCGCCGG
TGAAGGATGAAAAAAGCCCCGCAAAATCAAGCGGGTCAAAAAGGACAAAAAG
GAAGAAGATGGCAATGATGGTCTGGTGGAGTTTGTACGCGAGTTCGCCCCAAGG
CGGCGTGTGCAGTGGCGTGGACGCAAAGTGCGGCCTGTGCTGAGACCTGGAACC
ACGGTGGTCTTTACGCCCGGCGAGCGCACCAGCACTGCTTTTAAGCGATCCTATG
ATGAGGTGTATGGGGATGATGATATTCTGGAGCAGGCGGCCGACCGCCTGGGCG
AGTTTGCTTATGGCAAGCGCTCCCGCTCCAGCCCCAAGGAGGAGGCGGTGTCCA
TTCCCTTGGACAATGGGAATCCCACCCCTAGCCTCAAGCCAGTCACCCTGCAGCA
AGTGCTGCCCGTGCCTCCACGCAGAGGCAACAAGCGAGAGGGTGAGGATCTGTA
TCCCACGATGCAATTGATGGTGCCCAAGCGCCAGCGGCTGGAGGACGTGCTGGA
GAAAATGAAAGTGGATCCCGATATACAACCTGAGGTCAAAGTGAGACCCATCAA
GCAGGTGGCGCCAGGTTTGGGAGTACAAACCGTAGACATCAAGATTCCCACCGA
GTCCATGGAAGTCCAAACCGAACCTGCAAAGCCCACAACCACCTCCATTGAGGT
GCAAACGGATCCCTGGATGTCCGCACCCGTTACAGCTCAAGCTGCTGTCAACAC
CACTCGAAGATCCCGGCGAAAGTACGGTCAGCAAGTTTGCTGATGCCAAATTA
TGCTCTGCACCCATCTATTATTCCAACTCCGGGTTACCGAGGCACTCGCTACTAC
CGCAGCCGGAGCAGCACTTCCCGCCGTCGCCGCAAAACACCTGCAAGTCGTAGT
CACCGTCGTCGTCGCCGCCCCGCCAGCAATCTGACCCCCGCTGCTCTGGTGCGGA
GAGTGTATCGCGATGGCCGCGCAGATCCCTGACGTTGCCACGCGTACGCTACC
ATCCAAGCATCACAACTTAACGACTGTTGCCGCTGCCTCCTTGCAGATATGGCCC
TCACTTGCCGCCTTCGTGTCCCCATTACTGGCTACCGAGGAAGAAACTCGCGCCG
TAGAAGAGGGATGTTGGGGCGCGGGATGCGACGCCACAGGCGGCGGCGCGCTA
TCAGCAAAAGGCTGGGGGTGGCTTTCTGCCTGCTCTGATCCCCATCATAGCCGC
GGCGATCGGGGCGATACCAGGCATAGCTTCCGTGGCGGTTCAGGCCTCGCAGCG
CCACTGACATTGGAAAAACTTATAAATAAAATAGAATGGACTCTGATGCTCCTG
GTCCTGTGACTATGTTTTTGTAGAGATGGAAGACATCAATTTTTCATCCCTGGCT
CCGCGACACGGCACGAGGCCGTACATGGGCACCTGGAGCGACATCGGCACCAG
CCAACTGAACGGGGGCGCCTTCAATTGGAGCAGTATCTGGAGCGGGCTTAAAAA
TTTTGGCTCTACCATAAAAACCTATGGGAACAAAGCTTGGAACAGCAGCACAGG
GCAGGCACTGAGAAATAAGCTTAAAGAGCAAAACTTCCAACAGAAGGTGGTTG
ATGGGATCGCCTCTGGTATCAATGGGGTGGTGGATCTGGCCAACCAGGCCGTAC
AGAAACAGATAAACAGCCGCCTGGACCCGCCGCCGTCAGCCCCGGGCGAAATG
GAAGTGGAGGAAGATCTCCCTCCCCTTGAAAAGCGGGGCGACAAGCGTCCGCGC
CCCGATCTGGAGGAGACACTAGTCACACGCTCAGACGACCCGCCCTCCTACGAG
GAGGCAGTGAAGCTTGGAATGCCCACCACCAGACCTGTAGCCCCATGGCTACC
GGGGTAATGAAACCTTCTCAGTCACACCGACCCGCTACCTTGGACTTGCCTCCTC
CCCCTACTGCTGCAGCGCCTGCTCGCAAGCCTGTCGCTACCCCGAAGCCCACCAC
CGTACAGCCCGTCGCCGTAGCCAGGCCGCGTCCTGGGGGCACTCCACGTCCAAA
TGCAAACTGGCAGAGTACTCTGAACAGCATCGTGGGTCTGGGCGTGCAAAGTGT
AAAGCGCCGTCGCTGCTTTTAAATTAAATATGGAGTAGCGCTTAACTTGCCTGTC
TGTGTGTATGTGTCATCATCACGCCGCCGCAGCAACAGCAGAGGAGAAAAGGAA
GAGGTCGCGCGCCGAGGCTGAGTTGCTTTCAAGATGGCCACCCCATCGATGCTG
CCCCAGTGGGCATACATGCACATCGCCGGACAGGATGCTTCGGAGTACCTGAGT
CCGGGTCTGGTGCAGTTCGCCCGCGCCACAGACACCTACTTCAATCTGGGGAAC
AAGTTTAGGAACCCCACCGTGGCGCCCACCCATGATGTGACCACCGACCGCAGT
CAGCGGCTGATGCTCCGCTTTGTGCCCGTTGACCGGGAGGACAATACCTACTCAT
ACAAAGTTCGATACACCTTGGCTGTGGGCGACAACAGAGTGCTGGATATGGCCA
GCACTTTCTTTGACATTCGGGGTGTGTTGGATAGAGGCCCTAGCTTCAAGCCATA
TTCTGGCACTGCTTACAACTCATTGGCCCCTAAGGGCGCTCCCAATACATCTCAG
TGGATTGCTGAAGGCGTAAAAAAAGAAAATGGGGAAGCTGACGATGAAGCAGC
TGTCGAAGAGGAAGAGGAAGAGAAAAATCTTACCACTTACACTTTTGGAAATGC
CCCAGTGAAAGCAGAAGGTGGTGATATCACTAAAGACAAAGGTCTTCCAATTGG
TTCAGAAATTACAGACGGCGAAGCCAAACCAATTTATGCAGATAAACTATACCA
ACCAGAACCTCAGGTGGGAGAGGAAACTTGGACTGACACAGATGGAACAACTG
AGAAGTATGGTGGTAGAGCTCTAAAGCCAGAAACTAAAATGAAACCCTGCTATG
GGTCTTTTGCTAAACCCACTAACGTCAAAGGCGGACAGGCAAAACAAAAACTA
CTGAACAACTGCAAAACCAGCAGGTTGAATATGATATTGACATGAACTTTTTTG
ATCAAGCGTCACAGAAAGCAAACTTCAGTCCAAAAATTGTGATGTATGCAGAAA
ATGTAGACTTGGAAACCCCAGACACTCACGTGGTGTACAAACCTGGTACTTCAG
AAGAAAGTTCTCATGCTAATCTCGGTCAACAATCTATGCCCAACAGACCCAACT
ACATTGGCTTTAGAGATAACTTTATTGGACTTATGTACTACAACAGTACTGGCAA
CATGGGAGTGCTGGCAGGTCAAGCATCCCAATTGAATGCGGTGGTTGACTTGCA
GGACAGAAACACAGAACTATCATATCAACTACTGCTTGATTCTCTGGGTGACAG
AACCAGATACTTCAGCATGTGGAATCAAGCAGTCGATAGCTATGATCCTGATGT
GCGCATTATTGAAAATCATGGGGTGGAAGATGAGCTTCCCAACTACTGCTTTCCA
TTGGATGGAGTAGGGGTACCAACAACTAGTTACAAAATAATTGAACCAAATGGA

TABLE 7-continued

Nucleic Acid Sequences of Vectors

SEQ ID NO Sequence

GAGGGTGCAGATTGGAAAGAGCCTGACATAAATGGAACAAGTGAAATTGGACA
AGGAAATCTCTTTGCCATGGAAATTAACCTCCAAGCTAATCTCTGGAGAAGTTTT
CTTTATTCCAATGTGGCTCTGTATCTCCCAGACTCCTACAAATACACCCCAGCCA
ATGTCACTCTTCCAACTAACACCAACACTTATGACTACATGAATGGGCGGGTGGT
TCCCCCATCCCTAGTGGATACCTACGTAAACATTGGCGCCAGATGGTCTTTGGAT
GCCATGGACAATGTCAACCCCTTCAACCATCACCGCAACGCTGGCCTGCGATAC
CGGTCCATGCTTTTGGGCAATGGTCGCTACGTGCCTTTCCACATTCAAGTGCCTC
AGAAATTCTTTGCTGTGAAGAACCTGCTGCTTCTACCCGGTTCTTACACCTACGA
GTGGAACTTCAGAAAGGATGTGAACATGGTCCTGCAGAGTTCCCTTGGTAATGA
TCTCCGGGTCGATGGTGCCAGCATCAGTTTTACCAGCATCAATCTCTATGCCACC
TTCTTCCCCATGGCCCACAACACTGCCTCCACCCTTGAAGCCATGCTGCGCAATG
ACACCAATGATCAATCATTCAATGACTACCTTTCTGCAGCCAACATGCTCTACCC
CATCCCGGCCAACGCTACCAACGTTCCCATCTCCATTCCCTCTCGCAACTGGGCC
GCCTTCAGAGGCTGGTCCTTCACCAGACTCAAAACCAAAGAGACTCCCTCTTTGG
GATCAGGGTTCGATCCCTACTTTGTTTACTCTGGTTCTATACCTTACCTGGATGGT
ACCTTCTACCTTAACCACACTTTTAAGAAAGTCTCTATCATGTTTGACTCTTCAGT
CAGCTGGCCTGGTAATGACAGATTGCTAACTCCAAATGAGTTCGAAATCAAGCG
CACAGTTGATGGGGAAGGCTACAATGTGGCCCAATGTAACATGACCAAAGACTG
GTTCCTGGTCCAGATGCTTGCCAACTACAACATTGGATACCAGGGCTTCTACGTT
CCTGAGGGTTACAAGGATCGCATGTACTCCTTCTTCAGAAACTTCCAGCCCATGA
GTAGACAGGTGGTTGATGAGATTAACTACAAAGACTATAAAGCTGTCGCCGTAC
CCTACCAGCATAATAACTCTGGCTTTGTGGGTTACATGGCTCCTACCATGCGTCA
GGGTCAAGCGTACCCTGCTAACTACCCATACCCCCTAATTGGAACCACTGCAGT
AACCAGTGTCACCCAGAAAAAATTCCTGTGCGACAGGACCATGTGGCGCATCCC
ATTCTCTAGCAACTTCATGTCCATGGGTGCCCTTACAGACCTGGGACAGAACTTG
CTGTATGCCAACTCAGCCCATGCGCTGGACATGACTTTTGAGGTGGATCCCATGG
ATGAGCCCACCCTGCTTTATCTTCTTTTTGAAGTATTCGACGTGGTCAGAGTGCA
CCAACCACACCGCGGCGTCATCGAGGCCGTCTACCTGCGCACACCGTTCTCGGCT
GGTAACGCCACCACATAAGAAACCTGCTTCTTGCAAGGTGCAGCCATGGCCTGC
GGGTCCGGAAACGGCTCCAGCGAGCAAGAGCTCAGAGCCATCGTCCGAGACCTT
GGCTGTGGACCCTACTTCCTGGGAACCTTTGACAAACGCTTCCCGGGGTTTATGG
CTCCAAACAAGCTGGCCTGCGCCATTGTCAACACAGCCGGTCGCGAGACGGGGG
GAGAGCACTGGTTGGCTTTTGGTTGGAACCCGCGCTCCAACACATGCTACCTTTT
TGATCCGTTTGGATTCTCGGATGACCGTCTCAAGCAGATCTACCAGTTTGAATAC
GAGGGGTTACTGCGCCGCAGCGCCCTTGCTACTAAGGATCGCTGCATTACCTTGG
AAAAGTCCACCCAAACCGTGCAGGGTCCGCGCTCCGCCGCTTGTGGACTTTTTTG
CTGCATGTTTCTCCATGCCTTTGTACACTGGCCAGACCGCCCCATGGACGGTAAC
CCCACCATGAAGTTGCTTACGGGAGTGCCCAACAGCATGCTCCAGTCACCCCAA
GTCCAGCCCACCCTGCGCAGGAACCAGGAGGCGCTCTACCATTTCCTCAACACA
CATTCATCTTACTTTCGTTCTCACCGCGCACGTATCGAAAGGGCTACTGCGTTCG
ATCGTATGGGATATTAATAAGTCATGTAAAACCGTGTTCAATAAACAGAACTTT
ATTTTTTACATGCACTGGTGGTTTCTCATTCATTTATTCACTCAGAAGTCGAAGG
GGTTTTGGCGGGAATCAGAGTGACCCGCGGGCAGGGATACGTTGCGGAACTGGA
ACTGAGCCTGCCACTTGAATTCGGGGATCACCAGCTTGGGAACTGGCAGGTCAG
GCAGGATGTCGCTCCACAGCTTCCTGGTCAGTTGCAGGGCTCCCAACAGGTCAG
GAGCTGAAATCTTGAAATCGCAATTGGGACCCGTGCTCTGAGCGCGGGAGTTGC
GATACACAGGGTTGCAACACTGGAACACCATCAGCGACGGGTATTTCACACTCG
CCAACACAGTGGGATCGGTGATAATTCCCACATCCAGGTCTTCGGCATTGGCCAT
GCTAAAGGGGGTCATCTTGCATGTCTGTCTGCCCATAGCCGGTACCCAGCCTGGC
TTGTGGTTGCAATCGCAGCGCAGAGGGATCAGCATCATCTTGGCCTGGTCGGAT
CTCATACCGGGATACACAGCTTTCATGAAAGCTTCATATTGCTTGAAAGCCTGTT
GGGCCTTGCTACCCTCAGTGTAGAACATCCCACATGACTTGCTAGAGAACTGGTT
AGCAGCACATCCGGCATCATTCACACAACAGCGAGCGTCGTTGTTGGCTATTTGC
ACCACACTCCTGCCCCAGCGGTTCTGGGTGATCTTGGTTCGCTCAGGGTTCTCCT
TCAGCGCCCGTTGACCGTTTTCGCTTGCCACATCCATTTCTATGATATGTTCCTTC
TGAATCATGATGTTGCCATGCAAACACTTCAGCTTGCCTTCATAATCATTACATC
CATGTGACCACAGCGCGCATCCCGTACACTCCCAGTTATTGTGAGCGATCTCAGA
ATAGGAATGCACCAACCCCTGCAGGAATCTTCCCATCATGGTTGAGAGGGTCTT
GTTACTGGTGAAAGTCAGCGGGACGCCTCGATGCTCCTCGTTCACATACTGGTGG
CAAATTCGCTTGTACTGTTCATGCTGCTCTGGCATAAGCTTGAAAGAGGTTCTTA
GGTCATTCTCCAGCCTGTACTTCTCCATCAGCACAGCCATTACTTCCATGCCCTTT
TCCCAGGCAGAAACCAGGGGTAGGCTCATGGAATTTCTAACAGAAATAGCAGCT
ACTTTAGCCAGAGGGTCATCCTTGTCAATCTTCTCAACACTTCTTTTTGCCATCCTT
CTCAGTGATGCGCACGGGTGGGTAGCTGAAGCCCACGGCCACCAGCTCCGCCTC
TTCTCTTTCTTCTTCGCTGTCCTGACTGATGTCTTGTAAAGGGACATGCTTGGTCT
TCCTGGGCTTCTTTTTGGGGGGTATTGGCGGAGGGCTGCTGCTCCGCTCCGGAGA
CATGGAGGACCGCGAAGTTTCGCTCACCAGTACCACCTGGCTCTCGGTAGAAGA
ACCGGACCCCACACGGCGGTAGGTGTTCCTCTTCGGGGGCAGAGGTGGAGGTGA
CTGCGATGGGCTGCGGTCCGGCCTGGGAGGCGGATGACTGGCAGAGCCCTTCC
GCGTTCGGGGGTGTGCTCCCGGTGGCGGTCGCTTGACTGATTTCCTCCGCGGCTG
GCCATTGTGTTCTCCTAGGTAGAGAAACAACAGACATGGAGACTCAGCCATCGC
TGCCAACACCGCTGCAAGCACCATCACACCTCGCCTCCAGCGATGAGGAGGAGG
AACAAAGCTTAACCGCCCCACCACCCAGTCCCGCCACCACCACCTCTACCCTCG
AGGATGAGGAGGTCGACGCACCCCAGGAGATACGACGCAGGATATGGAGGAT
GAGAAAGCGGAAGAGATTGAGGCAGATATCGAGCAGGACCCAGGCTATGTGAC
ACCGGCCGAGCACGAGGAAGAGCTGAGACGCTTTCTAGAGAAAGATGATGACA

TABLE 7-continued

Nucleic Acid Sequences of Vectors

| SEQ ID NO | Sequence |
|---|---|
| | ACCGTCCAGAACAGCAAGCAGATGGCGATCAGCAGAATGTTGGGCTCGGGGATC |
| | ATGTTGTCGACTACCTCACCGGCCTTGGTGGGAGGACGTGCTCCTCAAACACCT |
| | AGCAAGGCAGTCGATCATAATCAAAGATGCACTGCTTGATCGCAGCGAAGTGCC |
| | CATCAGTGTGGAAGAGCTCAGCCGCGCCTACGAGCTCAACCTGTTCTCGCCTCG |
| | GGTACCCCCCAAGCGTCAGCCAAACGGCACCTGCGAGCCCAACCCTCGCCTCAA |
| | CTTCTATCCCGCATTCACCGTCCCCGAGGTGCTGGCTACCTACCACATATTTTCA |
| | AAAACCAAAAAATTCCAATTTCCTGCCGCGCCAACCGAACTCGCGCCGATGCCC |
| | TGCTCAACTTGGGACCTGGCGCTTGCTTACCTGATATAACTTCCTTGGAAGAGGT |
| | CCCAAAGATCTTCGAAGGTCTGGGCAGTGATGAGACTCGGGCCGCAAATGCTCT |
| | GCAACAGGGAGAGAATGGCATCGATGAACATCACAGCGCTCTGGTGGAGTTGG |
| | AGGGCGATAATGCCCGACTAGCAGTACTCAAGCGCAGTATCGAGGTGACCCATT |
| | TCGCATACCCCGCTGTCAACCTGCCTCCCAAAGTCATGAGCGCTGTCATGGATCA |
| | GATACTCATTAAACGCGCAAGTCCCCTTTCAGAAAACATGCAGGATCCAGACGC |
| | CTCGGATGAGGGCAAGCCAGTGGTCAGTGATGAACAGCTATCTCGCTGGCTGGG |
| | CACCAACTCCCCACGAGACTTGGAAGAGCGGCGCAAGCTCATGATGGCCGTGGT |
| | GCTAGTTACTGTGGAAATGGAGTGTCTTCGCCGCTTCTTCACTGACCCCGAGACA |
| | CTGCGCAAGCTCGAGGAGAACCTACACTACACTTTTAGACATGGATTTGTGAGA |
| | CAGGCATGCAAGATCTCCAACGTGGAGCTTACCAACCTGGTTTCCTACATGGGC |
| | ATTTTGCATGAAAACAGACTCGGACAGAGCGTGCTGCACACCACCCTGAAGGGG |
| | GAAGCCCGTCGCGACTACATCCGCGACACTGTCTACCTCTACCTCTGCCATACCT |
| | GGCAGACTGGTATGGGTGTGTGGCAGCAGTGTTTGGAAGAACAAAACCTGAAAG |
| | AACTAGACAAGCTCTTACAGAGATCCCTCAAAACCTTGTGGACGGGTTTTGACG |
| | AGCGCACAGTCGCCTCTGATCTGGCAGATCTCATCTTCCCAGAGCGTCTCAGGAC |
| | TACTCTGCGCAACGGGCTGCCTGACTTCATGAACCAGAGCATGATTAACAACTTT |
| | CGCTCTTTCATCCTGGAACGCTCCGGTATCCTGCCCGCCACCTGCTGTGCGCTAC |
| | CATCCGACTTTGTGCCTCTGACCTACCGCGAGTGCCCCCACCGCTATGGAGCCA |
| | CTGCTACCTGTTCCGCCTGGCCAACTACCTATCATACCACTCGGATGTGATCGAG |
| | GATGTGAGCGGAGATGGCCTGCTTGAGTGCCACTGCCGCTGTAATCTCTGCTCAC |
| | CACATCGCTCCCTAGTCTGTAACCCCCAGTTGCTTAGCGAAACCCAAATTATAGG |
| | CACCTTCGAATTGCAGGGTCCCAGCAGCGAAGGCGAGGGGTCTTCTCCTGGGCA |
| | AAGTTTGAAACTGACCCCGGGACTGTGGACCTCCGCCTACCTGCGCAAGTTCTCC |
| | CCCGAGGACTACCACCCCTATGAGATCAGGTTCTATGAAGACCAATCACAGCCG |
| | CCCAAAGCTGAGCTCTCAGCGTGCGTCATCACCCAGGGGGCAATTTTGGCCCAA |
| | TTGCAAGCCATCCAAAAATCCCGCCAAGAATTTTTGCTGAAAAAGGGTAACGGA |
| | GTCTACCTCGACCCCCAGACTGGTGAGGAGCTCAACACAAGGTTCTCTCAGGAT |
| | GTCTCAGCGCCGAGGAAACAAGAAGTTGAAAGTGCAGCTGCCGCCCCCAGAGG |
| | ATATGGAGGAAGACTGGGACAGTCAGACAGAGGAGATGGAAGATTGGGACAGC |
| | CAGGCAGAGGAGGAGGAGGACAGCCTGGAGGAAGACAGTTTGGAGGAGGAAG |
| | ACGAGGAGGCAGAGGAGGTGGAAGAAGCAACCGCCGCCAAACAGTTGTCCTCG |
| | GCGGCGGAAACAAGCAAGGCCACAGACAACACCACAGCTACCATCTCCGTTCCG |
| | GGTCGGGGGGTCCAGCACCGTCCCAACAGTAGATGGGATGAGACCGGGCGACTC |
| | CCGAATGCGACCACCGCTTCTAAGACTGGTAAGAAGGAGCGGCAGGGATACAA |
| | GTCCTGGCGGGGGCATAAGAACGCTATCATATCCTGCTTGCATGAATGCGGGGG |
| | CAACATATCCTTCACCCGCCGCTACCTGCTCTTCCACCACGGGGTGAACTTCCCC |
| | CGCAATGTCTTGCATTACTACCGTCACCTCCACAGCCCCTACTACAGCCAGCAAG |
| | CCTCGGCAGAAAAAGACAACAGCAGCAAGAACCTCCAGCAGAAAACCAGCAGC |
| | AGTTAGAACACCCACAGCAGGTGCAACAGGAGGAGGACTGAGAATCACAGCGA |
| | ACGAGCCAGCGCAGACCCGAGAGCTGAGAAACCGGATTTTTCCAACCCTCTATG |
| | CCATCTTCCAACAGAGTCGGGGGCAAGAGCAGGAACTGAAAGTAAAAAACCGA |
| | TCTTTGCGCTCGCTCACCCGAAGTTGTTTGTATCACAAGAGCGAAGACCAACTTC |
| | AGCGCACTCTCGAGGACGCCGAGGCTCTCTTCAACAAGTACTGCGCGCTCACTCT |
| | TAAAGAGTAGCCCGCGCCCGCGCTAGCTCGAAAAAAGGCGGGAATTACGTCACC |
| | CATTGGCGCCTGTCCTTTGCCCTCGTCATGAGTAAAGAAATTCCCACGCCTTACA |
| | TGTGGAGTTATCAACCCCAAATGGGACTGGCAGCAGGCGCCTCCCAGGACTACT |
| | CCACCCGTATGAATTGGCTCAGCGCCGGTCCCTCGATGATCTCACGGGTTAATGA |
| | TATACGAGCTTATCGAAACCAATTACTCCTAGAACAGTCAGCACTTACCGCCAC |
| | ACCCAGACAACACCTCAATCCCCGGAATTGGCCCGCCGCCCTGGTGTACCAGGA |
| | AACCCCGCTCCCACCACCGTCCTACTTCCTCGAGACGCCCAGGCCGAAGTTCAG |
| | ATGACTAACGCAGGTGTACAGCTGGCTGGCGGTTCCGCCCTGTGTCGTCACCGG |
| | CCTCAACAGAGTATAAAACGCCTGGTGATCGAGGCCGAGGTATCCAGCTCAAC |
| | GACGAGTCGGTGAGCTCTTCGCTTGGTCTACGACCAGACGGAGTCTTCCAAATTG |
| | CCGGCTGCGGGAGATCTTCCTTCACTCCTCGTCAGGCTGTACTGACTTTGGAGAG |
| | TTCGTCATCGCAGCCCCGCTCGGGTGGCATCGGGACTCTCCAATTTGTGAGGAG |
| | TTTACTCCCTCTGTCTACTTCAACCCCTTCTCCGGCTCTCCTGGGCATTACCCGGA |
| | CGAGTTCATACCAAACTTCGACGCAATCAGCGAGTCAGTGGATGGCTATGATTG |
| | ATGTCTAATGGTGGCGCGGCTGAGCTAGCTCGACTGCGACATCTAGACCACTGC |
| | CGCCGCTTTCGCTGCTTTGCCCGAGAACTCACCGAGTTCATCTACTTCGAAATAC |
| | CCGAGGAGCACCCTCAAGGACCGGCCCACGGAGTGCGTATTACCATCGAAGGGG |
| | GGATAGACTCTCGCCTGCATCGGATCTTCTGCCAGCGACCCGTGCTAATCGAGCG |
| | CGACCAGGGAAACACCACAGTCTCCATCTACTGCATCTGTAACCACCCCGGATT |
| | GCATGAAAGCCTTTGCTGTCTTATTTGTGCTGAGTTTAATAAAAACTGAGTTAAG |
| | ACTCTCCTACGGACTACCAATTCTTCAACTCGGACTTTATAACAATCAGACCCTC |
| | CGTTCAAGTCAGAAGACCCCAACCCTTCCTCTGATCCAGGAATCTAATTCTACCT |
| | CCCCAGCACCACACTTTACTAGCCTTCCCGAAACTAACAACCTCGGAGCTCAACT |
| | GCACCACTTTTCCAGAAGCCTTCTCTCTGCCAATACTACCACTCCCAGAACCGGA |
| | GGTGAGCTCCGTGGTCTTCCTAATAACAACCCCTGGGTGGTAACTGGGTTTGTAA |

TABLE 7-continued

Nucleic Acid Sequences of Vectors

| SEQ ID NO | Sequence |
|---|---|
| | CGCTAGGTGTAGTTGCGGGTGGGCTTGTGCTTGTCCTTTGCTACCTATACACACC |
| | TTGCTGTGCTTATTTAGTAATCTTGTGTTGCTGGTTTAAGAAATGGGGGCCCTAC |
| | TAGTCGCGCTTGCTTTACTTTCACTTTTGGATCTGGGCTCTACTATGCTAGTTCAG |
| | CCTGTACTATTTGATCCATGCCTCAATTTTGATCCAGACAACTGCACACTCACTTT |
| | TGCTCCAGAGGCTGGCCGCTGTGGAGTTCTTATTAGGTGCGGACGGGAATGCAG |
| | TCCCATTGAAATACACCACAATAACAAAATTTGGAACAATACCTTATTCACCAC |
| | ATGGCAGCCAGGAGACCCTGAGTGGTATACTGTCTCTGTCCGTGGTCCTGACGGT |
| | TCCATCCGCACTGCTAATAACACTTTTATTTTTGCTGAGATGTGCGATCTGACCA |
| | TGTTCATGAGCAAACAGTATAACCTATGGCCTCCAAGCAAGGAGAACATTGTGG |
| | CATTCTCCATTGCTTATTGCTTGTGTACGTGTCTCATTACTGCTATTCTATGTATC |
| | TGCATACACTTGCTTATTTGCCACCGCCACAGAAACAGCAATGAGGAAAAAGAG |
| | AAAATGCCTTGAGCTTTTTCTCATTTTTGTTTTTTTGTTTACAGCCATGGCTTCA |
| | GTTATAGCTCTAATTATTGTCAGCATTCTCACTGCCGCACAGGGACAAACAATTG |
| | TCTATATTACCTTAGGTCATAACCGCACTCTTATAGGACCCCAAATTAGTTCACA |
| | GGTTATATGGACCAAACTTGGAAGTGTTGATTATTTTGACATAATCTGCAACAGA |
| | ACTAAACCAATATTTGTAACCTGTAACAAACAAAATCTCACCTTAATTAATGTTA |
| | GCGAAATTTACAGCGGTTACTATTATGGTTATGACAGACACAGCAGTGAATATA |
| | AAAATTACCTAGTTCGCATAACTCAACCCAAAACCACAAAAATGCCAAATAAGG |
| | CAAAAATTCAAATGGTTAGCGCATTAGAACATCTTACATATCCCACCACACCCG |
| | ATGAGAGAAACATTCCAAATTCAATGATTGCCATTATTGCGGCGGTGGCAGTGG |
| | GAATGGCACTAATAATAATTTGTATGTTCCTATATGCTTGTTACTGTAGAAAGTT |
| | TCATCACAAACAGGATTCCCTACTAAATTTTTGACATTTAATTTTTTATACAGCTA |
| | TGGTTTCCACTACAGCCTTTTTTGTTATTAGTAGCCTTGCAGCTGTCACTTATGGT |
| | CGCTCACACCTCACTGTAACTGTTGGCTCAACTTGTACACTACAAGGACCCCAAG |
| | AAGGGCATGTCAGTTGGTGGAGAATATATGATAGTGGATGGTTCATTAGGCCAT |
| | GTGACCAGCCTGGTAACAAATTTTTCTGCAACGGAGAGACTTGACCATTATTA |
| | ACATCACAGTAAATGACCAGGGCTTCTATTATGGAACTAACTATAAAAATAACT |
| | TAGATTACAACATTATCGTAGTGCCAGCCACCACTCCAGCTCCCCGCAAAACCA |
| | CTTTCTTTAGCAGCAGTGCCAGTATTTCTAAAACAGCTTCTGCAAGCTTCAAAAA |
| | ATTCGCTTTACGTAATTCCACAACCTCTTCCACTTCCAATAATACAATGTCTAAA |
| | TCAGTAATCGGCATCGCTGCTGCCGCGATAGTGGGATTAATGATTATAATTCTAT |
| | GCATAATCTACTACGCCTGCTGCTATAGAAAACAACATGAACAAAAAACCGATC |
| | CCTTGCTGAATTTTGATATTTAATTTTTTTATAGAATCATGAAAAAACTAAGTAT |
| | CCTAGCTTTCATTTTGTTTCAAACATTTACCAATGTGCAGACTACTTTAAGTCATG |
| | GTATAGAGAACCACACTACCTCTTATGAGCTCACAAACATTACTACCCATCATCC |
| | TAAATATGCTATGCAACTAGAAATCACCATGCTAATTGTAGTTGGAATACTTATC |
| | CTAGCTATTATTTTCTATTTTACACTATGCCGCCAAATACCTAATATTCATAAAA |
| | ATTCTAAAAGACGTCCCATCTATTGCCCTGTGATTAGTCGACCCCATATGACTCT |
| | AAATGAAATCTAAGATCATCTATTTCTCTTTTTTACAGTATGGTGAACACCAATC |
| | ATGATTCCTAGAAATTTCTTCTTCACCATACTCATCTGTGCTTTTAATGTCTGTGC |
| | CACCTTCACAGCAGTAGCCACTGCAACCCCAGACTGTATAGGAGCATTTGCCTC |
| | ATATACACTTTTCGCTTTTGTCGCTTGCACCTGCGTGTGTAGCGTAGTCTGCCTGG |
| | TTATTAATTTTTTCCAACTTGTAGACTGGATCTTTGTACGACTTGCCTACCTGCGT |
| | CACCATCCCGAATACCGCAATCAACATGTTGCGGCACTTCTCAGACTTATTTAAA |
| | ACCATGCAGGCTATACTACCAGTCATTCTGCTTCTGTTGCTCCCCTGCGATGCCTT |
| | AACCCCCGTCGCTAATCGTACCCCACCTGAACAACTTAGAAAATGCAAATTCCA |
| | ACAACCATGGACATTCCTTGATTGCTACCGAGAAAAATCTGATTTCCCTACATAC |
| | TGGATTATGATCATTGGAATTGTCAATCTAGTTTCTTGCACACTATTCTCTTTCCT |
| | TGTTTATCATTTTTTTGATTTTGGATGGAATGCCCCAATGCACTCACTTACCCAC |
| | AAGAACCAGAGGAACATATCCCACTACAGAACATGCAACAGCCAATAGCTATA |
| | ATAGATTATGACAATGAGCCACAGCCCTCGCTGCTTCCTGCTATTAGTTACTTCA |
| | ACCTAACCGGTGGAGATGACTGACCCACTCGCCGCCTCCACTGCTGCCGAGGAA |
| | CTACTTGATATGGACGGCCGCGCCTCAGAACAGCGACTCGCCCAACTACGCATA |
| | CGCCAGCAGCAGGAACGTGCCGCCAAGGAGCTCAGGGATGCTATTGAAATTCAC |
| | CAGTGCAAAAAAGGCATATTCTGTCTGGTGAAACAAGCCAAGATTTCCTACGAG |
| | ATTACCAATACTGACCATCGCCTCTCATACGAGCTCGGACCGCAGCGGCAAAAA |
| | TTCACTTGTATGGTGGGAATCAACCCCATAATCATCACCCAGCAAGCTGGAGAT |
| | ATCAAGGGTTGCATCCACTGTTCCTGCAGTTCCACCGAGTGCATCTACACCCTGC |
| | TGAAGACCCTCTGCGGCCTTCGAGACCTCCTACCCATGAACTAATCAACCCAGCC |
| | CCTCACTTACCAATTACATAAAGCCAATTAATAAAAATCACTTACTTGAAATCAG |
| | AAATAAGGTTTCTGTCTACGTTGTTTCCAAGCAGCACCTCACTTCCCTCTTCCCA |
| | ACTCTGGTACTCTAAGCCTCGGCGGGTGGCATACTTCCTCCACACTTTGAAAGGG |
| | ATGTCAAATTTTAGTTCCTCTTCTTTGCCCACAATCTTCATTTCTTTATCCCCAGA |
| | TGGCCAAACGAGCTCGGCTAAGCAGCTCCTTCAATCCGGTCTACCCCTATGAAG |
| | ATGAAAGCAGCTCACAACACCCCTTTATAAACCCTGGTTTCATTTCCTCAAATGG |
| | TTTTACACAAAGCCCAGATGGAGTTCTAACTCTTAAATGTGTTAATCCGCTCACT |
| | ACCGCCAGCGGACCCCTCCAACTTAAAGTTGGAAGCAGTCTTACAGTAGATACT |
| | ATCGATGGGTCTTTGGAGGAAAATATAACTGCCGCAGCGCCACTCACTAAAACT |
| | AACCACTCCATAGGTTTATCAATAGGATCTGGCTTGCAAACAAAGGATGATAAA |
| | CTTTGTTTATCGCTGGGAGATGGGTTGGTAACAAAGGATGATAAACTATGTTTAT |
| | CGCTGGGAGATGGGTTAATAACAAAAGATGATACACTATGTGCCAAACTAGGAC |
| | ATGGCCTTGTGTTTGACTCTTCCAATGCTATCACCATAGAAAACAACACCTTGTG |
| | GACAGGTGCAAAACCAAGCGCCAACTGTGTAATTAAAGAGGGAGAAGATTCCC |
| | CAGACTGTAAGCTCACTTTAGTTCTAGTGAAGAATGGAGGACTGATAAATGGAT |
| | ACATAACATTAATGGGAGACTCAGAATATACTAACACCTTGTTTAAAAACAAAC |
| | AAGTTACAATCGATGTAAACCTCGCATTTGATAATACCGGCCAAATTATCACTTA |

TABLE 7-continued

Nucleic Acid Sequences of Vectors

| SEQ ID NO | Sequence |
|---|---|
| | CCTATCATCTCTTAAAAGTAACCTGAACTTCAAAGACAACCAAAACATGGCTAC<br>TGGAACCATAACCAGTGCCAAAGGCTTCATGCCAAGCACCACTGCCTATCCATTT<br>ATAACATACGCCACTCAGTCCCTAAATGAAGATTACATTTATGGAGAGTGTTACT<br>ACAAATCTACCAATGGAACTCTCTTTCCACTAAAAGTTACTGTCACACTAAACAG<br>ACGTATGTCAGCTTCTGGAATGGCCTATGCTATGAATTTTTCATGGTCTCTAAAT<br>GCAGAGGAAGCCCCGGAAACTACCGAAGTCACTCTCATTACCTCCCCCTTCTTTT<br>TTTCTTATATCAGAGAAGATGACTGACAACAAAAAAAAAAATAAAGATCAACTT<br>TTTTATTGAAAATCAGTTTACAAGATTCGAGTAGTTATTTTGCCCCCCTCTTCCCA<br>TTTTATAGAATACACAATTCTCTCCCCACGCACAGCTTTGAACATTTGAATTCCA<br>TTAGAGATA |
| SEQ ID NO: 1429 | ATAATATACCCCACAAAGTAAACAAAAGTTAATATGCAAATGAGCTTTTGAATT<br>TTAACGGTTTTGGGGCGGAGCCAACGCTGATTGGTCGAGAGAAGACGATGCAAA<br>TGACGTCACGACGCACGGCTGACGGTCGCCGCGGAGGCGTGGCCTAGCCCGGAA<br>GCAAGTCGCGGGCTGATGACGTATAAAAAAGCGGACTTTAGACCCGGAAACG<br>GCCGATTTTCCCGCGGTCACGCCAGGATATGAGGTAATTCTGGGCGGATGCAAG<br>TGAAATTAGGTCATTTTGGCGCGAAAACTGAATGAGGAAGTGAAAAGCGAAAA<br>ATACCGGGCCCGCCCAGGGCGGAATATTTACCGAGGGCCGAGAGACTTTGACCG<br>ATTACGTGGGGGTTTCGATTGCGGTGTTTTTTTCGCGAATTTCCGCGTCCGTGTCA<br>AAGTCCGGTGTTTATGTCACAGATCAGCTGATCCACAGGGTATTTAAACCAGTCG<br>AGCCCGTCAAGAGGCCACTCTTGAGTGCCAGCGAGTAGAGATTTCTCTGAGCTC<br>CGCTCCCAGAGACCGAGAAAAATGAGACACCTGCGCCTCCTGCCTTCAACTGTG<br>CCCGGTGAGCTGCTGTGCTTATGCTGGAGGACTTTGTGGATACAGTATTGGAG<br>GACGAACTGCATCCAAGTCCGTTCGAGCTGGGACCCACACTTCAGGATCTCTAT<br>GATCTGGAGGTAGATGCCCATGATGACGACCCTAACGAAGAGGCTGTGAATTTA<br>ATATTTCCAGAATCTATGATTCTCCAGGCTGACATAGCTAGCGAAGCTATAGTTA<br>CTCCACTTCATACCCCAACTCTGCCGCCCATACCTGAATTGGAAGAGGAGGATG<br>AGATAGACCTCCGGTGCTACGAGGAAGGTTTTCCTCCCAGCGATTCAGAGGACG<br>AACAGGGTGAGCGAGAGATGGCTATTCTATCGGACTTTGCTTGTGTGATTGTGG<br>AGGAGCAAGATGTGATTGAAAAATCTACTGAGCCAGTACAAGGCTGTAGGAACT<br>GCCAGTACCACCGGGATAAGTCCGGAGATGTGAACGCCTCCTGCGCTCTGTGCT<br>ATATGAAACAGACTTTCAGCTTTATTTACAGTAAGTGGAGTGAATGTGAGAGAG<br>GCTGAGTGCTTAACACATAACTGTAATGCTTGAACAGCTGTGCTAAGTGTGGTTT<br>ATTTTTGTTACTAGGTCCGGTGTCAGAGGATGAGTCATCACCCTCAGAAGAGGA<br>CCACCCGTCCCCCCCTGAGCTGTCAGGCGAAACGCCCCTGCAAGTGCACAGACC<br>CACCCCAGTCAGACCAAGTGGCGAGAGGCGAGCAGCTGTTGAAAAAATTGAGG<br>ACTTGTTACATGATATGGGTGGGGATGAACCTTTGGACCTGAGCTTGAAACGCC<br>CCAGGAACTAGGCGCATATGCGCTTAGTCATGTGTAAATAAAGTTGTACAAATA<br>AAAAGTATATGTGACGCATGCAAGGTGTGGTTTATGACTCATGGGCGGGCTTA<br>GTCCTATATAAGTGGTAACACCTGGGCACTCAGGCACAGACCTTCAGGGAGCTC<br>CTGATGGAGGTGTGGACTATCCTTGCGGACTTTTAACAAGACACGCCGGCTTGTG<br>GAGGATAGTTCAGACGGGTGCTCCGGTTTCTGGAGACACTGGTTTGGAACTCCTC<br>TAGCTCGCCTGGTGTACACAGTTAAGAAGGATTATCAGGAGGAATTTGAAAATC<br>TTTTTGCCGACTGTTCTGGCCTTCTTGATTCACTGAATCTCGGCCACCAGGCTCTA<br>TTCCAGGAAAGGGTCCTCCACAGCCTTGATTTTTCCAGCCCAGGGCGCACTACAG<br>CCGGTGTTGCTTTTGTGGTGTTTCTGGTTGACAAATGGAGCCAGCAAACCCACCT<br>AACCAGGGATTACATCCTGGACTTCACGGCCATGCATCTGTGGAAGGCCTGGGT<br>CAGGCAGCGGGACAGAGAATCTTGAACTACTGGCTTCTACAGCCAGCAGCTCC<br>GGGTCTTCTTCGTCTACACAGACAAACATCCATGTTGGAGGAAGAGATGAGGGA<br>GGCCATGGACGAGAACCCGAGGAGCGGCCTGGACCCTCCGTCGGAAGAGGAGC<br>TGGATTGAATCAGGTATCCAGCCTGTACCCAGAGCTTAGCAAGGTGCTGACAAC<br>CATGGCCAGGGGAGTGAAGAGGGAGAGGAGCGATGGGGGCAATACTGGGATGA<br>TGACCGAGCTGACAGCCAGCCTGATGAATCGCAGGCGACCTGAGCGCATTACCT<br>GGCATGAGCTACAGCAGGAGTGCAGGGATGAGATAGGCCTGATGCAGGATAAA<br>TATGGCCTGGAGCAGATAAAAACCCACTGGTTGAACCCAGATGAGGATTGGGAG<br>GAGGCCATTAAGAAATATGCCAAGATAGCCCTGCGCCCAGATTGCAAGTACAGG<br>GTGACCAAGACGGTGAATATCAGACATGCCTGCTACATCTCAGGGAACGGGCA<br>GAGGTGATCATCGATACCCTGGATAAGGCTGCCTTCAGGTGTTGCATGATGGGA<br>ATGAGAGCCGGTGTGATGAATATGAATTCAATGATATTCATGAACATCAAGTTC<br>AATGGAGAGAAGTTTAATGGGGTGCTGTTCATGGCCAACAGCCACATGACCCTG<br>CACGGCTGTAATTTCTTTGGCTTTAACAACATGTGTGCAGAAGTCTGGGGTGCTT<br>CCAAGATCAGGGGCTGTAAGTTTTATGGCTGCTGGATGGGAGTGGTCGGAAGAC<br>CCAAGAGCGAGATGTCTGTGAAGCAGTGTGTGTTTGAGAAGTGCTACCTGGCCG<br>TGTCTACCGAGGGCAATGCTAGAGTGAGACATTGCTCTTCCATGGAGACGGGCT<br>GCTTCTGCCTGGTGAAGGGCACAGCTTCTATCAAGCATAATGTGATCAAGGGGT<br>GTACTGATGAGCGCATGTACAACATGCTGACCTGCGACTCTGGGGTCTGCCATAT<br>CCTGAAGAACATCCATGTGACCTCCCACCCTAGGAAGAGGTGGCCATCATTTGA<br>AAATAATGTCCTGATCAAGTGCCATGTGCACCTGGGAGCCAGAAGGGGTACCTT<br>CCAGCCGTACCAGTGCAACTTTAGCCAGACCAAGCTGCTGCTGGAGAATGATGC<br>CTTCTCCAGGGTGAACCTGAACGGTATCTTTGACATGGATGTCTCGGTGTACAAG<br>ATCCTGAGATACGATGAGACCAGGTCCAGGGTGCGCGCTTGCGAGTACAAG<br>AGACACACCAGGATGCAGCCTGTGGCTCTGGATGTAACCGAGGAGCTGAGGCCC<br>GACCACCTGGTGATGGCCTGTACCGGGACCGAGTTCAGCTCCAGCGGGGAGGAC<br>ACAGATTAGAGGTAGGTTGAGTATTAGTGGGCGTGGCTAAGGTGACTATAAAGG<br>TGGGTGTCTTACGAGGGTCTTTTTGCTTTTCTGCAGACATCATGAACGGGACCGG<br>CGGGGCCTTCGAAGGGGGGCTTTTCAGCCCTTATTTGACAACCCGCCTGCCGGG |

TABLE 7-continued

Nucleic Acid Sequences of Vectors

SEQ ID NO Sequence

ATGGGCCGGAGTTCGTCAGAATGTGATGGGATCTACGGTGGATGGGCGCCCAGT
GCTTCCAGCAAATTCCTCGACCATGACCTACGCGACCGTGGGGACGAGCTCGTC
GCTTGACAGCACCGCCGCAGCCGCGGCAGCCGCAGCCGCCATGACAGCGACGA
GATTGGCCTCGAGCTACATGCCCAGCAGCGGTAGCAGCCCCTCTGTGCCCAGTTC
CATCATCGCCGAGGAGAAACTGCTGGCCCTGCTGGCCGAGCTGGAAGCCCTGAG
CCGCCAGCTGGCCGCCCTGACCCAGCAGGTGTCCGATCTCCGCGAGCAACAGCA
GCAGCAAAATAAATGATTCAATAAACACAGATTCTGATTCAAACAGCAAAGCAT
CTTTATTATTTATTTTTTCGCGCGCGGTAGGCCCTGGTCCACCTCTCCCGATCATT
GAGAGTGCGGTGGATTTTTTCCAGGACCCGGTAGAGGTGGGATTGGATGTTGAG
GTACATGGGCATGAGCCCGTCCCGGGGGTGGAGGTAGCACCACTGCATGGCCTC
GTGCTCTGGGGTCGTGTTGTAGATGATCCAGTCATAGCAGGGGCGCTGGGCGTG
GTGCTGGATGATGTCCTTGAGGAGGAGACTGATGGCCACGGGGAGCCCCTTGGT
GTAGGTGTTGGCGAAGCGGTTGAGCTGGGAGGGATGCATGCGGGGGGAGATGA
TGTGCAGTTTGGCCTGGATCTTGAGGTTGGCGATGTTGCCGCCCAGATCCCGCCT
GGGGTTCATGTTGTGCAGGACCACCAGGACGGTGTAGCCCGTGCACTTGGGGAA
CTTATCATGCAACTTGGAAGGGAATGCGTGGAAGAATTTGGAGACGCCCTTGTG
ACCGCCCAGGTTTTCCATGCACTCATCCATGATGATGGCAATGGGCCCGTGGGCT
GCGGCTTTGGCAAAGACGTTTCTGGGGTCAGAGACATCATAATTATGCTCCTGG
GTGAGATCATCATAAGACATTTTAATGAATTTGGGCGGAGGGTGCCAGATTGG
GGGACGATAGTTCCCTCGGGCCCCGGGGCGAAGTTCCCTCGCAGATCTGCATC
TCCCAGGCTTTCATCTCGGAGGGGGGATCATGTCCACCTGCGGGCGATGAAA
AAAACGGTTTCCGGGGCGGGGGTGATTAGCTGCGAGGAGAGCAGGTTTCTCAAC
AGCTGGGACTTGCCGCACCCGGTCGGGCCGTAGATGACCCCGATGACGGGTTGC
AGGTGGTAGTTCAAGGACATGCAGCTGCCGTCGTCCCGGAGGAGGGGGCCACC
TCGTTGAGCATGTCTCTGACTTGGAGGTTTTCCCGGACGAGCTCGCCAAGGAGGC
GGTCCCCGCCCAGCGAGAGCAGCTCTTGCAGGGAAGCAAAGTTTTTCAGGGGCT
TGAGCCCGTCGGCCATGGGCATCTTGGCGAGGGTCTGCGAGAGGAGCTCCAGGC
GGTCCCAGAGCTCGGTGACGTGTTCTACGGCATCTCGATCCAGCAGACTTCCTCG
TTTCGGGGGTTGGGACGACTGCGACTGTAGGGCACGAGACGATGGGCGTCCAGC
GCGGCCAGCGTCATGTCCTTCCAGGGTCTCAGGGTCCGAGTGAGGGTGGTCTCC
GTCACGGTGAAGGGGTGGGCCCCGGGCTGGGCGCTTGCAAGGGTGCGCTTGAGA
CTCATCCTGCTGGTGCTGAAACGGGCACGGTCTTCGCCCTGCGCGTCGGCGAGAT
AGCAGTTGACCATGAGCTCGTAGTTGAGGGCCTCGGCGGCGTGGCCCTTGGCAC
GGAGCTTGCCCTTGGAAGAGCGCCCGCAGGCGGGACAGAGGAGGGATTGCAGG
GCGTATAGCTTGGGTGCGAGAAAGACGGACTCGGGGGCGAAAGCATCCGCTCCG
CAGTGGGCGCAGACGGTCTCGCATTCGACTAGCCAGGTGAGCTCGGGCTGCTCG
GGGTCAAAAACCAGTTTTCCCCCGTTCTTTTTGATGCGCTTCTTACCTCGCGTCTC
CATGAGTCTGTGTCCGCGCTCGGTGACAAACAGGCTGTCGGTGTCCCCGTAGAC
GGACTTGATTGGCCTGTCCTGCAGGGGCGTCCCGCGGTCCTCCTCGTAGAGAAA
CTCGGACCACTCTGAGACGAAGGCGCGCGTCCACGCCAAGACAAAGGAGGCCA
CGTGCGAGGGGTAGCGGTCGTTGTCCACCAGGGGGTCCACCTTTTCCACCGTGTG
CAGACACATGTCCCCCTCCTCCGCATCCAAGAAGGTGATTGGCTTGTAGGTGTAG
GCCACGTGACCGGGGGTCCCCGACGGGGGGGTATAAAAGGGGGCGGGTCTGTG
CTCGTCCTCACTCTCTTCCGCGTCGCTGTCCACGAGCGCCAGCTGTTGGGGTAGG
TATTCCCTCTCGAGAGCGGGCATGACCTCGGCACTCAGGTTGTCAGTTTCTAGAA
ACGAGGAGGATTTGATGTTAGCCTGCCCTGCCGCGATGCTTTTGAGTAGACTTTC
ATCCATCTGGTCAGAAAATACTATTTTTTTATTGTCAAGCTTGGTGGCGAAGGAG
CCATAGAGGGCGTTGGAGAGAAGCTTGGCGATGGATCTCATGGTCTGATTTTTGT
CACGGTCGGCGCGCTCCTTGGCCGCGATGTTGAGCTGGACATACTCGCGCGCGA
CGCACTTCCATTCGGGGAAGACGGTGGTGCGCTCGTCGGGCACGATCCTGACGC
GCCAGCCGCGGTTATGCAGGGTGACCAGGTCCACGCTGGTGGCCACCTCGCCGC
GCAGGGGCTCGTTGGTCCAGCAGAGTCTGCCGCCCTTGCGCGAGCAGAACGGGG
GCAGCACATCAAGCAGATGCTCGTCAGGGGGGTCCGCATCGATGGTGAAGATGC
CCGGACAGAGTTCCTTGTCAAAATAATCTATTTTTGAGGATGCATCATCCAAGGC
CATCTGCCACTCGCGGGCGGCCAGCGCTCGCTCGTAGGGGTTGAGGGGCGGACC
CCAGGGCATGGGATGCGTGAGGGCGGAGGCATACATGCCGCAGATGTCATAGA
CATAGATGGGCTCCGAGAGGATGCCGATGTAGGTGGGATAACAGCGCCCCCGC
GGATGCTGGCGCGCACGTATTCATACAACTCGTGCGAAGGGGCCAAGAAAGCGG
GGCCGAGATTGGTGCGCTGGGGCTGCTCGGCGCGGAAGACGATCTGGCGAAAG
ATGGCGTGCGAGTTTGAGGAGATGGTGGGCCGTTGGAAGATGTTAAAGTGGGCG
TGCGGCAGTCGGACCGAGTCTCGGATGAAGTGCGCGTAGGAGTCTTGCAGCTTG
GCGACGAGCTCGGCGGTGACGAGGACGTCCATGGCGCAGTAGTCCAGCGTTTCG
CGGATGATGTCATAACCCGCCTCTCCTTTCTTCTCCCACAGCTCGCGGTTGAGGG
CGTACTCCTCGTCATCCTTCCAGTACTCCCGGAGCGGGAATCCTCGATCGTCCGC
ACGGTAAGAGCCCAGCATGTAGAAATGGTTCACGGCCTTGTAGGGACAGCAGCC
CTTCTCCACGGGGAGGGCGTAAGCTTGAGCGGCCTTGCGGAGCGAGGTGTGTGT
CAGGGCGAAGGTGTCCCTGACCATGACTTTCAAGAACTGGTACTTGAAGTCCGA
GTCGTCGCAGCCGCCGTGCTCCCAGAGCTCGAAATCGGTGCGCTTCTTCGAGAG
GGGGTTAGGCAGAGCGAAAGTGACGTCATTGAAGAGAATCTTGCCTGCCCGCGG
CATGAAATTGCGGGTGATGCGGAAAGGGCCCGGGACTGAGGCTCGGTTGTTGAT
GACCTGGGCGGCGAGGACGATCTCATCGAAGCCGTTGATGTTGTGCCCGACGAT
GTAGAGTTCCATGAATCGCGGGCGGCCTTTGATGTGCGGCAGCTTTTTGAGTTCC
TCGTAGGTGAGGTCCTCGGGGCATTGCAGGCCGTGCTGCTCGAGCGCCCACTCCT
GGGAGATGTGGGTTGGCTTGCATGAAGGAAGCCCAGAGCTCGCGGGCCATGAGG
GTCTGGAGCTCGTCGCGAAAAAGGCGGAACTGCTGGCCCACGGCCATCTTTTCT
GGGGTGACGCAGTAGAAGGTGAGGGGGTCCCGCTCCCAGCGATCCCAGCGTAA

TABLE 7-continued

Nucleic Acid Sequences of Vectors

SEQ ID NO Sequence

GCGCACGGCGAGATCGCGAGCGAGGGCGACCAGCTCGGGGTCCCCCGAGAATTT
CATGACCAGCATGAAGGGGACGAGCTGCTTGCCGAAGGACCCCATCCAGGTGTA
GGTTTCTACATCGTAGGTGACAAAGAGCCGCTCCGTGCGAGGATGAGAGCCGAT
TGGGAAGAACTGGATTTCCTGCCACCAGTTGGACGAGTGGCTGTTGATGTGATG
AAAGTAGAAATCCCGCCGCCGAACCGAGCACTCGTGCTGATGCTTGTAAAAGCG
TCCGCAGTACTCGCAGCGCTGCACGGGCTGTACCTCATCCACGAGATACACAGC
GCGTCCCTTGAGGAGGAACTTCAGGAGTGGCGGCCCTGGCTGGTGGTTTTCATGT
TCGCCTGCGTGGGACTCACCCTGGGGCTCCTCGAGGACGGAGAGGCTGACGAGC
CCGCGCGGCAGCCAGGTCCAGATCTCGGCGCGGCGGGGGCGGAGAGCGAAGAC
GAGGGCGCGCAGTTGGGAGCTGTCCATGGTGTCGCGGAGATCCAGGTCCGGGGG
CAGGGTTCTGAGGTTGACCTCGTAGAGGCGGGTGAGGGCGTGCTTGAGATGCAG
ATGGTACTTGATCTCCACTGGGGAGTTGGTGGCCGTGTCCACGCATTGCATGAGC
CCGTAGCTGCGCGGGGTCACGACCGTGCCGCGGTGCGCTTTTAGAAGCGGTGTC
GCGGACGCGCTCCCGGCGGCAGCGGCGGTTCCGGCCCCGCGGGCAGGGGCGGC
AGAGGCACGTCGGCGTGGCGCTCGGGCAGGTCCCGGTGCTGCGCCCTGAGAGCG
CTGGCGTGCGCGACGACGCGGCGGTTGACATCCTGAATCTGTCGCCTCTGCGTG
AAGACCACTGGCCCCGTGACTTTGAACCTGAAAGACAGTTCAACAGAATCAATC
TCGGCGTCATTGACGGCGGCCTGACGCAGGATCTCTTGCACGTCGCCCGAGTTGT
CCTGGTAGGCGATCTCGGACATGAACTGCTCGATCTCCTCCTCCTGGAGATCGCC
GCGGCCCGCGCGCTCCACGGTGGCGGCGAGGTCATTCGAGATGCGACCCATGAG
CTGCGAGAAGGCGCCCAGGCCGCTCTCGTTCCAGACGCGGCTGTAGACCACGTC
CCCGTCGGCGTCGCGCGCGCGCATGACCACCTGCGCGAGGTTGAGCTCCACGTG
CCGCGTGAAGACGGCGTAGTTGCGCAGGCGCTGGAAGAGGTAGTTGAGGGTGGT
GGCGATGTGCTCGGTGACGAAGAAGTACATGATCCAGCGGCGCAGGGGCATCTC
GCTGATGTCGCCGATGGCCTCCAGCCTTTCCATGGCCTCGTAGAAGTCCACGGCG
AAGTTGAAAAACTGGGCGTTGCGGGCCGAGACCGTGAGCTCGTCTTCCAGGAGC
CGGATAAGCTCGGCGATGGTGGCGCGCACCTCGCGCTCGAAATCCCCGGGGGCC
TCCTCCTCTTCCTCTTCTTCCATGACGACCTCTTCTTCTATTTCTTCCTCTGGGGGC
GGTGGTGGTGGCGGGGCCCGACGACGACGGCGACGCACCGGGAGACGGTCGAC
GAAGCGCTCGATCATCTCCCCGCGGCGGCGACGCATGGTTTCGGTGACGGCGCG
ACCCCGTTCGCGAGGACGCAGCGTGAAGACGCCGCCGGTCATCTCCCGGTAATG
GGGCGGGTCCCCGTTGGGCAGCGAGAGGGCGCTGACGATGCATCTTATCAATTG
CGGTGTAGGGGACGTGAGCGCGTCGAGATCGACCGGATCGGAGAATCTTTCGAG
GAAAGCGTCTAGCCAATCGCAGTCGCAAGGTAAGCTCAAACACGTAGCAGCCCT
GTGGACGCTGTTAGAATTGCGGTTGCTGATGATGTAATTGAAGTAGGCGTTTTTG
AGGCGGCGGATGGTGGCGAGGAGGACCAGGTCCTTGGGTCCCGCTTGCTGGATG
CGGAGCCGCTCGGCCATGCCCCAGGCCTGGCCCTGACACCGGCTCAGGTTCTTGT
AGTAGTCATGCATGAGCCTCTCAATGTCATCACTGGCGGAGGCGGAGTCTTCCAT
GCGGGTGACCCCGACGCCCCTGAGCGGCTGCACGAGCGCCAGGTCGGCGACGAC
GCGCTCGGCGAGGATGGCCTGTTGCACGCGGGTGAGGGTGTCCTGGAAGTCGTC
CATGTCGACGAAGCGGTGGTAGGCCCCGGTGTTGATGGTGTAGGTGCAGTTGGC
CATGAGCGACCAGTTGACGGTCTGCAGGCCGGGCTGCACGACCTCGGAGTACCT
GAGTCGCGAGAAGGCGCGCGAGTCGAAGACGTAGTCGTTGCAGGTGCGCACAA
GGTACTGGTAGCCGACTAGGAAGTGCGGCGGCGGCTGGCGGTAGAGCGGCCAG
CGCTGGGTGGCCGGCGCGCCCGGGGCCAGGTCCTCGAGCATGAGGCGGTGGTAG
CCGTATAGGTAGCGGGACATCCAGGTGATGCCGGCGGCGGTGGTGGAGGCGCGC
GGGAACTCGCGGACGCGGTTCCAGATGTTGCGCAGCGGCAGGAAATAGTCCATG
GTCGGCACGGTCTGGCCGGTGAGACGCGCGCAGTCATTGACGCTCTAGAGGCAA
AAACGAAAGCGGTTGAGCGGGCTCTTCCTCCGTAGCCTGGCGGAACGCAAACGG
GTTAGGCCGCGTGTGTACCCCGGTTCGAGTCCCCTCGAATCAGGCTGGAGCCGC
GACTAACGTGGTATTGGCACTCCCGTCTCGACCCGAGCCCGATAGCCGCCAGGA
TACGGCGGAGAGCCCTTTTTGCCGGCCGCGGGGTGTCGCTAGACTTGAAAGCGG
CCGAAAACCCCGCCGGGTAGTGGCTCGCGCCCGTAGTCTGGAGAAGCATCGCCA
GGGTTGAGTCGCGGCAGAACCCGGTTCGCGGACGGCCGCGGCGGAGCGGGACTTG
GTCACCCCGCCGATTTAAAGACCCACAGCCAGCCGACTTCTCCAGTTACGGGAG
CGAGCCCCCTTTTTTCTTTTTGCCAGATGCATCCCGTTCTGCGCCAAATGCGTCCC
ACCCCCCGGCGACCACCGCGACCGCGGCCGTAGCAGGCGCCGGCGCTAGCCAG
CCACCACAGACAGAGATGGACTTGGAAGAGGGCGAAGGGCTGGCGAGACTGGG
GGCGCCGTCCCCGGAGCGACATCCCCGAGTGCAGCTGCAGAAGGACGTGCGCCC
GGCGTACGTGCCTGCGCAGAACCTGTTCAGGGACCGCAGCGGGGAGGAGCCCG
AGGAGATGCGCGACTGCCGGTTTCGGGCTGGCAGGGAGCTGCGCGAGGGCCTGG
ACCGCCAGCGCGTGCTGCGCGACGAGGATTTCGAGCCGAACGAGCAGACGGGG
ATCAGCCCCGCGCGCGCACGTGGCGGCGGCCAACCTGGTGACGGCCTACGAG
CAGACGGTGAAGCAGGAGCGCAACTTCCAAAAGAGTTTCAACAACCACGTGCGC
ACGCTGATCGCGCGCGAGGAGGTGGCCCTGGGCCTGATGCACCTGTGGGACCTG
GCGGAGGCCATCGTGCAGAACCCGGACAGCAAGCCTCTGACGGCGCAGCTGTTC
CTGGTGGTGCAGCACAGCAGGGACAACGAGGCGTTCAGGGAGGCGCTGCTGAA
CATCGCCGAGCCCGAGGGTCGCTGGCTGCTGGAGCTGATCAACATCTTGCAGAG
CATCGTAGTGCAGGAGCGCAGCTTGAGCCTGGCCGAGAAGGTGGCGGCCATCAA
CTACTCGGTGCTGAGCCTGGGCAAGTTTTACGCGCGCAAGATTTACAAGACGCC
GTACGTGCCCATAGACAAGGAGGTGAAGATAGACAGCTTTTACATGCGCATGGC
GCTCAAGGTGCTGACGCTGAGCGACGACCTGGGCGTGTACCGCAACGACCGCAT
CCACAAGGCCGTGAGCACGAGCCGGCGGCGCGAGCTGAGCGACCGCGAGCTGA
TGCTGAGCCTGCGCCGGGCGCTGGTAGGGGGCGCCGCCGGCGGCGAGGAGTCCT
ACTTCGACATGGGGGCGGACCTGCATTGGCAGCCGAGCCGGCGCGCCTTGGAGG
CCGCCTACGGTCCAGAGGACTTGGATGAGGAAGAGGAAGAGGAGGAGGATGCA

TABLE 7-continued

Nucleic Acid Sequences of Vectors

SEQ ID NO Sequence

CCCGCTGCGGGGTACTGACGCCTCCGTGATGTGTTTTAGATGTCCCAGCAGCAAG
CCCCGGACCCCGCCATAAGGGCGGCGCTGCAAAGCCAGCCGTCCGGTCTAGCAT
CGGACGACTGGGAGGCCGCGATGCAACGCATCATGGCCCTGACGACCCGCAACC
CCGAGTCCTTTAGACAACAACCGCAGGCCAACAGACTCTCGGCCATTCTGGAGG
CGGTGGTCCCCTCTCGGACCAACCCCACGCACGAGAAGGTGCTGGCGATCGTGA
ACGCGCTGGCGGAGAACAAGGCCATCCGTCCCGACGAGGCCGGGCTGGTATACA
ACGCCCTGCTGGAACGCGTGGGCCGCTACAACAGCACGAACGTGCAGTCCAACC
TGGACCGGCTGGTGACGGACGTGCGCGAGGCCGTGGCGCAGCGCGAGCGGTTCA
AGAACGAGGGCCTGGGCTCGCTGGTGGCGCTGAACGCCTTCCTGGCGACGCAGC
CGGCTAACGTGCCGCGCGGGCAGGACGATTACACCAACTTTATCAGCGCGCTGC
GGCTGATGGTGACCGAGGTGCCCCAGAGCGAGGTGTACCAGTCGGGCCCGGACT
ACTTTTTCCAGACTAGCAGACAGGGCCTGCAGACGGTGAACCTGAGCCAGGCTT
TCAAGAACCTGCGCGGGCTGTGGGGCGTGCAGGCGCCCGTGGGCGACCGGTCGA
CGGTGAGCAGCTTGCTGACGCCCAACTCGCGTCTGCTGCTGCTGCTGATCGCGCC
CTTCACCGACAGCGGCAGCGTGAACCGCAACTCGTACCTGGGCCACCTGCTGAC
GCTGTACCGCGAGGCCATAGGCCAGGCGCAGGTGGACGAGCAGACCTTCCAGG
AGATCACGAGCGTGAGCCGCGCGCTGGGCCAGAACGACACCGACAGTCTGAGG
GCCACCCTGAACTTCTTGCTGACCAATAGACAGCAGAAGATCCCGGCGCAGTAC
GCACTGTCGGCCGAGGAGGAAAGGATCTTGAGATATGTGCAGCAGAGCGTAGG
GCTGTTCCTGATGCAGGAGGGCGCCACCCCCAGCGCCGCGCTGGACATGACCGC
GCGCAACATGGAACCTAGCATGTACGCTGCCAACCGGCCGTTCATCAATAAGCT
GATGGACTACCTGCACCGCGCGGCGGCCATGAACACGGACTACTTTACCAATGC
CATCCTGAACCCGCACTGGCTTCCGCCGCTGGGTTCTACACGGGCGAGTACGA
CATGCCCGACCCCAACGACGGGTTCCTGTGGGACGACGTGGACAGCGCGGTGTT
CTCGCCCGCCTTTCAAAAGAGACAGGAAGCGGTGCGCACGCCTAGCGAGGGCGC
TGTGGGACGGAGCCCCTTTCCTAGCTTGGGGAGTTTGCATAGCCTGCCGGGCTCG
GTGAACAGCGGCAGGGTGAGCCGGCCGCGCTTGCTGGGCGAGGACGAGTACCT
GAACGACTCGCTGCTGCAGCCGCCGCGGGCCAAGAACGCCATGGCCAATAACGG
GATAGAGAGTCTGGTGGACAAACTGAACCGCTGGAAGACCTACGCTCAGGACCA
TAGGGACGCACCCGCCGCGGCGACAGCGCCACGACCGGCAGCGGGGCCTGG
TGTGGGACGACGAGGACTCGGCCGACGATAGCAGCGTGTTGGACTTGGGCGGGA
GCGGTGGTGGGGCCAACCCGTTCGCGCATCTGCAGCCCAGACTGGGGCGGCGGA
TGTTTTGAAATGCAAAATAAAACTCACCAAGGCCATAGCGTGCGTTCTCTTCCTT
GTTAGAGATGAGGCGCGGTGGTGTCTTCCTCTCCTCCTCCCTCGTACGAGAGC
GTGATGGCGCAGGCGACCCTGGAGGTTCCGTTTGTGCCTCCGCGGTATATGGCTC
CTACGGAGGGCAGAAACAGCATTCGTTACTCGGAGCTGGCTCCGCTGTACGACA
CCACTCGCGTGTACTTGGTGGACAACAAGTCGGCGGACATCGCTTCCCTGAACT
ACCAAAACGACCACAGCAACTTCCTGACCACGGTGGTGCAGAACAACGATTTCA
CCCCCGCCGAGGCCAGCACGCAGACGATAAATTTTGACGAGCGGTCGCGGTGGG
GCGGTGATCTGAAGACCATTCTGCACACCAACATGCCCAATGTGAACGAGTACA
TGTTCACCAGCAAGTTTAAGGCGCGGGTGATGGTGGCTAGGAAGCATCCCAAAG
ATGTGCCAGTTAATGATTTAAGCAAAGATATCTTAGAGTACGATTGGTTTGAGTT
TACCCTGCCCGAGGGCAACTTTTCCGAGACCATGACCATAGACCTGATGAACAA
CGCCATCTTGGAAAACTACTTGCAAGTGGGGCGGCAAAATGGCGTGCTGGAGAG
CGATATCGGAGTCAAGTTTGACAGCAGAAATTTCAGACTGGGCTGGGACCCGGA
GACCAAGCTGGTGATGCCAGGGGTCTACACCTACGAGGCCTTCCACCCGGACGT
GGTGCTGCTGCCGGGCTGCGGGGTGGATTTCACCGAGAGTCGCCTGAGCAACCT
CCTGGGCATTCGCAAGAAGCAACCTTTCCAAGAGGGCTTCAGAATCATGTATGA
GGATCTAGAAGGGGGCAACATTCCCGCACTCCTTGATGTGGCCAAGTACCTTGA
AAGCAAGAAGGAACTGGAGGATGCCGCCAAGGAAGCTGCAAAGCAACAGGGAG
ATGGCGCTGTCATTAGAGGCGATACCCACCTCACTGTAGCTCAAGAAAAAGCAG
CTGGAAAGGAGCTAGTGATTGTTCCCATTGAGAAAGATGAAAGCAACAGAAGCT
ACAACCTGATCAAGGATACCCATGACACCCTGTACCGAAGTTGGTACCTGTCCT
ATACCTACGGGGACCCCGAGAAGGGGGTGCAGTCGTGGACGCTGCTCACCACCC
CGGACGTCACCTGCGGCGCGGAGCAAGTCTACTGGTCGCTGCCGGACCTCATGC
AAGACCCCGTCACCTTCCGCTCCACCCAGCAAGTCAGCAACTACCCAGTGGTCG
GCGCCGAGCTCATGCCCTTCCGCGCCAAGAGCTTTTACAACGACCTCGCCGTCTA
CTCCCAGCTCATCCGCAGCTACACCTCCTCACCCACGTCTTCAACCGCTTCCCC
GACAACCAGATCCTCTGCCGCCGCCCGCGCCCACCATCACCACCGTCAGTGAA
AACGTGCCTGCTCTCACAGATCACGGGACGCTACCGCTGCGCAGCAGTATCCGC
GGAGTCCAGCGAGTGACCGTCACTGACGCCCGTCGCCGCACCTGTCCCTACGTCT
ACAAGGCCCTGGGCATAGTCGCGCCGCGCGTGCTTTCCAGTCGCACCTTCTAAA
AAATGTCTATTCTCATCTCGCCCAGCAATAACACCGGCTGGGGTCTTACTAGGCC
CAGCACCATGTACGGAGGAGCCAAGAAGCGCTCCCAGCAGCACCCCGTCCGCGT
TCGCGGCCACTTCCGCGCTCCCTGGGCGCTTACAAGCGCGGGCGGACTTCCAC
CGCCGCCGCCGTGCGCACCACCGTCGACGATGTCATCGACTCGGTGGTCGCCGA
CGCGCGCAACTATACCCCGCCCCCTCCACCGTGGACGCGGTCATCGACGACGT
GGTGGCCGACGCGCGCGACTATGCCAGACGCAAGAGCCGGCGGCGACGGATCG
CCAGGCGCCACCGGAGTACGCCCGCCATGCGCGCCGCCCGGGCTCTGCTGCGCC
GCGCCAGACGCACGGGCCGCCGGGCCATGATGCGAGCCGCGCGCCGCGCTGCCA
CTGCACCCACCCCCGCAGGCAGGACTCGCAGACGAGCGGCCGCGCCGCCCGCG
CGGCCATCTCTAGCATGACCAGGCCCAGGCGCGGAAACGTGTACTGGGTGCGCG
ACTCCGTCACGGGCGTGCGCGTGCCCGTGCGCACCCGTCCTCCTCGTCCCTGATC
TAATGCTTGTGTCCTCCCCCGCAAGCGACGATGTCAAAGCGCAAAATCAAGGAG
GAGATGCTCCAGGTCGTCGCCCCGGAGATTTACGGACCAACCCAGGCGGACCAG
AAACCCCGCAAAATCAAGCGGGTTAAAAAAAAGGATGAGGTGGACGAGGGGGC

TABLE 7-continued

Nucleic Acid Sequences of Vectors

SEQ ID NO Sequence

```
AGTAGAGTTTGTGCGCGAGTTCGCTCCGCGGCGGCGCGTAAATTGGAAGGGGCG
CAGGGTGCAGCGCGTGTTGCGACCCGGCACGGCGGTGGTGTTCACGCCCGGCGA
GCGGTCCTCTGTCAGGAGCAAGCGTAGCTATGACGAGGTGTACGGCGACGACGA
CATCCTGGACCAGGCGGCGGAGCGGGCGGGCGAGTTCGCCTACGGGAAGCGGT
CGCGCGAAGAGGAGCTGATCTCGCTGCCGCTGGACGAAAGCAACCCCACGCCGA
GCCTGAAGCCCGTGACCCTGCAGCAGGTGCTGCCCCAGGCGGTGCTGCTGCCGA
GCCGCGGGGTCAAGCGCGAGGGCGAGAGCATGTACCCGACCATGCAGATCATG
GTGCCCAAGCGCCGGCGCGTGGAGGACGTGCTGGACGCCGTGAAAATGGATGTG
GAGCCCGAGGTCAAGGTGCGCCCCATCAAGCAGGTGGCGCCGGGCCTGGGCGTG
CAGACCGTGGACATTCAGATCCCCACCGACATGGATGTCGACAAAAAACCCTCG
ACCAGCATCGAGGTGCAGACCGACCCCTGGCTCCCAGCCTCCACCGCTACCGCC
TCCACTTCTACCGCCGCCACGGCTACCGAGCCTCCCAGGAGGCGAAGATGGGGT
GCCACCAGCCGGCTGATGCCCAACTACGTGTTGCATCCTTCCATCATCCCGACGC
CGGGCTACCGCGGCACCCGGTATTACGCCAGCCGCAGGCGCCCAGCCAGCAAAC
GCCGCCGCCGCACCACCACCGCCGCCGTCTGGCCCCCGCCCGCGTGCGCCGCG
TGACCACGCGCCGGGGCCGCTCGCTCGTTCTGCCCACCGTGCGCTACCACCCCAG
CATCCTTTAATCCGTGTGCTGTGATACTGTTGCAGAGAGATGGCTCTCACTTGCC
GCCTGCGCATCCCCGTCCCGAATTACCGAGGAAGATCCCGCCGCAGGAGAGGCA
TGGCAGGCAGCGGCCTGAACCGCCGCCGGCGGCGGGCCATGCGCAGGCGCCTG
AGTGGCGGGTTCCTGCCCGCGCTCATCCCCATAATCGCCGCGGCCATCGGCACG
ATCCCGGGCATAGCTTCCGTTGCGCTGCAGGCGTCGCAGCGCCGTTGATGTGCG
AATAAAGCCTCTTTAGACTCTGACACACCTGGTCCTGTATATTTTTAGAATGGAA
GACATCAATTTTGCGTCCCTGGCTCCGCGGCACGGCACGCGGCCGTTCATGGGC
ACCTGGAACGAGATCGGCACCAGCCAGCTGAACGGGGGCGCCTTCAATTGGAGC
AGTGTCTGGAGCGGGCTTAAAAATTTCGGCTCGACGCTCCGGACCTATGGGAAC
AAGGCCTGGAATAGTAGCACTGGGCAGTTGTTGAGGGAAAAGCTCAAAGACAA
GAACTTCCAGCAGAAGGTGGTGGACGGGCTGGCCTCGGGCATTAACGGGGTGGT
GGACATCGCGAACCAGGCCGTGCAGCGCGAGATAAACAGCCGCCTGGACCCGC
GGCCGCCCACGGTGGTGGAGATGGAAGATGCAACTCTTCCGCCGCCCAAGGGCG
AGAAGCGGCCGCGGCCCGACGCGGAGGAGACGATCCTGCAGGTGGACGAGCCG
CCCTCGTACGAGGAGGCCGTGAAGGCCGGCATGCCCACCACGCGCATCATCGCG
CCGCTGGCCACGGGTGTAATGAAGCCCGCCACCCTTGACCTGCCTCCACCACCC
ACGCCCGCTCCACCGAAGGCAGCTCCGGTCGTGCAGGCCCCCCCGGTGGCGACC
GCCGTGCCGCGTCCCCGCCCGCCGCCAGGCCCAGAACTGGCCAGAGCACGCTG
CACAGTATCGTGGGCCTGGGAGTGAAAAGTCTGAAGCGCCGCCGATGCTATTGA
GAGAGAGGAAAGAGGACACTAAAGGGAGAGCTTAACTTGTATGTGCCTTACCGC
CAGAGAACGCGCGAAGATGGCCACCCCCTCGATGATGCCGCAGTGGGCGTACAT
GCACATCGCCGGGCAGGACGCCTCGGAGTACCTGAGCCCGGGTCTGGTGCAGTT
TGCCCGCGCCACCGACACGTACTTCAGCCTGGGCAACAAGTTTAGGAACCCCAC
GGTGGCTCCCACCCACGATGTGACCACGGACCGGTCCCAGCGTCTGACGCTGCG
CTTCGTGCCCGTGGATCGCGAGGACACCACGTACTCGTACAAGGCGCGCTTCAC
TCTGGCCGTGGGCGACAACCGGGTGCTAGACATGGCCAGCACTTACTTTGACAT
CCGCGGCGTCCTGGACCGCGGTCCCAGCTTCAAACCCTACTCGGGCACGGCTTA
CAACAGCCTGGCCCCAAGGGCGCCCAAATCCAAGTCAATGGGAAACAAAAG
AAAAGCAAGGAACTACCGGAGTCCAAACGGAAAAAGATGTCACAAAAACATTT
GGTGTGGCCGCCACTGGCGGAATTAATATTACAAACCAGGGTCTGTTACTTGGA
ACTGATGAAAAAGCCGAAAATGGCAAAAAAGACATTTATGCAGACAAGACTTTT
CAACCAGAACCTCAAGTTGGAGAGGAAAACTGGCAGGAAAATGAAGCATTCTA
CGGAGGCAGAGCTCTTAAGAAGGACACCAAAATGAAACCATGCTATGGATCTTT
TGCTAGACCTACTAATGAGAAAGGAGGTCAGGCAAAGTTCAAACCAGTTAATGA
AGGAGAACAGCCTAAAGAACTGGATATAGATTTTGCTTACTTTGACACTCCAGG
TGGCAATATAACACAAGGAACAGAAGAATTAAAGGCAGATATCATTTTGTACAC
TGAAAATGTTAATCTGGAAACACCAGACACTCATGTGGTATACAAGCCAGGAAC
TTCAGATGACAGTTCAGAAATCAATCTTGTTCAGCAGTCCATGCCAAACAGACC
CAATTACATTGGTTTCAGAGACAACTTTGTGGGGCTTATGTATTACAACAGCACT
GGCAACATGGGTGTGCTGGCTGGTCAGGCCTCTCAGTTGAATGCTGTGGTTGACT
TGCAAGACAGAAACACCGAGCTGTCATACCAGCTCTTGCTAGATTCTTTGGGTG
ACAGAACCAGATACTTTAGCATGTGGAACTCTGCGGTTGACAGCTATGATCCCG
ATGTCAGGATCATTGAGAATCATGGTGTGGAAGATGAACTTCCAAACTATTGCTT
CCCCTTGGATGGCACTGGAACCAATTCCACTTACCAAGGTGTAAAGATCACAAA
TGGTAATGATGGCGCTGAAGAAAGTGAGTGGGAAAAAGACGATGCTATATCTAG
ACAAAACCAAATCTGCAAAGGCAACGTGTACGCCATGGAGATCAACCTCCAGGC
CAACCTGTGGAAGAGTTTTCTGTACTCGAACGTGGCCCTGTACCTGCCCGACTCC
TACAAGTACACGCCGGCCAACGTCACGCTGCCCGCCAACACCAACACCTACGAC
TACATGAACGGCCGTGTGGTAGCCCCCTCGCTGGTGGACGCCTACGTCAACATC
GGCGCCCGCTGGTCGCTGGACCCCATGGACAATGTCAACCCCTTTAACCACCAC
CGCAACGCGGGCCTGCGCTACCGTTCCATGCTGTTGGGCAACGGCCGCTACGTG
CCCTTCCACATCCAAGTGCCCCAAAAGTTCTTTGCCATCAAGAACCTGCTCCTGC
TCCCGGGCTCCTACACCTACGAGTGGAACTTCCGCAAGGACGTCAACATGATCC
TGCAGAGTTCCCTCGGAAACGATCTGCGCGTCGACGGCGCCTCCGTCCGCTTCGA
CAGCGTCAACCTCTACGCCACCTTTTTCCCCATGGCGCACAACACCGCCTCCACC
TTGGAAGCCATGCTGCGCAACGACACCAACGACCAGTCCTTCAACGACTACCTC
TCGGCCGCCAACATGCTCTACCCCATCCCGGCCAAGGCCACCAACGTGCCCATCT
CCATTCCCTCGCGCAACTGGGCCGCCTTCCGCGGCTGGAGTTTCACCCGGCTCAA
GACCAAGGAAACTCCCTCCCTCGGCTCGGGTTTCGACCCCTACTTTGTCTACTCG
GGATCCATCCCCTACCTCGACGGGACCTTCTACCTCAACCACACCTTCAAGAAGG
```

TABLE 7-continued

Nucleic Acid Sequences of Vectors

SEQ ID NO Sequence

```
TTTCCATCATGTTCGACTCCTCGGTCAGCTGGCCTGGCAACGACCGGCTGCTGAC
GCCGAACGAGTTCGAGATTAAGCGCAGTGTCGACGGGGAGGGCTACAACGTGG
CTCAATGCAACATGACCAAGGACTGGTTCCTCGTCCAGATGCTCTCCCACTACAA
CATCGGCTACCAGGGCTTCCACGTGCCCGAGGGCTACAAGGACCGCATGTACTC
CTTCTTCCGCAACTTCCAGCCCATGAGCAGGCAGGTGGTCGATGAGATCAACTA
CAAGGACTACAAGGCCGTCACCCTGCCCTTCCAGCACAACAACTCGGGCTTCAC
CGGCTACCTTGCGCCCACCATGCGCCAGGGGCAGCCCTACCCCGCCAACTTCCCC
TACCCGCTCATCGGCTCCACCGCAGTGCCCTCCGTCACCCAGAAAAAGTTCCTCT
GCGACAGGGTCATGTGGCGCATCCCCTTCTCCAGCAACTTCATGTCCATGGGCGC
CCTTACCGACTTGGGTCAGAACATGCTCTACGCCAACTCGGCCCACGCGCTCGAC
ATGACCTTCGAGGTGGACCCCATGGATGAGCCCACCCTCCTCTATCTTCTCTTCG
AAGTTTTCGACGTGGTCAGAGTGCACCAGCCGCACCGCGGCGTCATCGAGGCCG
TCTACCTGCGCACACCCTTCTCCGCCGGCAACGCCACCACCTAAGCATGAGCGGT
TCCAGCGAACGAGAGCTCGCGGCCATCGTGCGCGACCTGGGCTGCGGGCCCTAC
TTTTTGGGCACCCACGACAAGCGCTTCCCGGGCTTCCTCGCCGGCGACAAGCTGG
CCTGCGCCATCGTCAACACGGCCGGCCGCGAGACCGGAGGCGTGCACTGGCTCG
CCTTCGGCTGGAACCCGCGCTCGCGCACCTGCTACATGTTCGACCCCTTTGGGTT
CTCGGACCGCCGGCTCAAGCAGATTTACAGCTTCGAGTACGAGGCCATGCTGCG
CCGAAGCGCCCTGGCCTCATCGCCCGACCGCTGTCTCAGCCTCGAGCAGTCCACC
CAGACCGTGCAGGGGCCCGACTCCGCCGCCTGCGGACTTTTCTGTTGCATGTTCT
TGCATGCCTTCGTGCACTGGCCGACCGACCCATGGACGGAAACCCCACCATGA
ACTTGCTGACGGGGGTGCCCAACGGCATGCTACAATCGCCACAGGTGCTACCCA
CCCTCCGGCGCAACCAGGAGGAGCTCTACCGCTTCCTCGCGCGCCACTCCCCTTA
CTTTTCGATCCCACCGCGCCGCCATCGAACACGCCACCGCTTTTGATAAAATGAAA
CAACTGCGTGTATCTCAATAAACAGCACTTTTATTTTACATACACTGGAGTATAT
GCAAGTTATTTAAAAGTCGAAGGGGTTCTCGCGCTCGTCGTTGTGCGCCGCGCTG
GGGAGGGCCACGTTGCGGTACTGGTACTTGGGCTGCCACTTGAACTCGGGGATC
ACCAGTTTGGGCACTGGGGTCTCGGGGAAGGTCTCGCTCCACATGCGCCGGCTC
ATCTGCAGGGCGCCCAGCATGTCCGGGCCGGAGATCTTGAAATCGCAGTTGGGG
CCGGTGCTCTGCGCGCGCGAGTTGCGGTACACAGGGGTTGCAGCACTGGAACACC
ATCAGACTGGGGTACTTCACACTGGCAAGCACGCTCTTGTCGCTGATCTGTTCCT
TGTCCAGGTCCTCGGCGTTGCTCAGGCCGAACGGGGTCATCTTGCACAGCTGGC
GGCCCAGGAAGGGCACGCTCTGAGGCTTGTGATTACACTCGCAGTGAACGGGCA
TCAGCATCATTCCCGCGCGCGCTGCATATTCGGGTAGAGGGCCTTGACAAAGG
CCGTGATCTGCTTGAAAGCTTGCTGGGCCTTGGCCCCCTCGCTGAAAAACAGCCC
GCAGCTCTTCCCGCTGAACTGGTTATTCCCGCACCCGGCATCATGCACGCAGCAG
CGCGCGTCATGGCTGGTCAGTTGCACCACGCTCCGTCCCCAGCGGTTCTGGGTCA
CCTTGGCCTTGCTGGGCTGCTCCTTCAGCGCGCGCTGCCCGTTCTCACTGGTCAC
ATCCATCTCCACCACGTGGTCCTTGTGGATCATCACCGTCCCATGCAGACACTTG
AGCTGGCCTTCCACCTCGGTGCAGCCGTGATCCCACAGGGCGCATCCGGTGCAC
TCCCAATTCTTGTGTGCGATCCCGCTGTGGCTGAAGATGTAACCTTGCAACATGC
GGCCCATGATGGTGCTAAAGCTCTTCTGGGTGGTGAAGGTCAGTTGCAGACCGT
GGGCCTCCTCGTTCATCCAGGTCTGGCACATCTTTTGGAAGATCTCGGTCTGCTC
GGGCATGAGCTTGTAGGCATCGCGCAGGCCGCTGTCGACGCGGTAGCGTTCCAT
CAGCACGTTCATGGTATCCATGCCCTTCTCCCAGGACGAGACCAGAGGCAGACT
CAGGGGGTTGCGCACGTTCAGGACACCGGGGGTCGCGGGCTCGACGATGCGTTT
TCCGTCCTTGCCTTCCTTCAACAGAACCGGCGGCTGGCTGAATCCCACTCCCACG
ATCACGGCATCTTCCTGGGGCATCTCTTCGTCGGGGTCTACCTTGGTCACATGCT
TGGTCTTCCTGGCTTGCTTCTTTTTTGGAGGGCTGTCCACGGGGACCACGTCCTCC
TCGGAAGACCCGGAGCCCACCCGCTGATACTTTCGGCGCTTGGTGGGCAGAGGA
GGTGGTGGCGGCGAGGGGCTCCTCTCCTGCTCCGGCGGATAGCGCGCCGACCCG
TGGCCCCGGGGCGGAGTGGCCTCTCGCTCCATGAACCGGCGCACGTCCTGACTG
CCGCCGGCCATTGTTTCCTAGGGGAAGATGGAGGAGCAGCCGCGTAAGCAGGAG
CAGGAGGAGGACTTAACCACCCACGAGCAACCCAAATCGAGCAGGACCTGGG
CTTCGAAGAGCCGGCTCGTCTAGAACCCCCACAGGATGAACAGGAGCACGAGCA
AGACGCAGGCCAGGAGGAGACCGACGCTGGGCTCGAGCATGGCTACCTGGGAG
GAGAGGAGGATGTGCTGCTGAAACACCTGCAGCGCCAGTCCCTCATCCTCCGGG
ACGCCCTGGCCGACCGGAGCGAAACCCCCCTCAGCGTCGAGGAGCTGTGTCGGG
CCTACGAGCTCAACCTCTTCTCGCCGCGCGTGCCCCCCAAACGCCAGCCCAACG
GCACCTGCGAGCCCAACCCGCGTCTCAACTTCTATCCCGTCTTTGCGGTCCCCGA
GGCCCTCGCCACCTATCACATCTTTTTCAAGAACCAAAAGATCCCCGTCTCCTGC
CGCGCCAACCGCACCCGCGCCGACGCGCTCCTCGCTCTGGGGCCCGGCGCGCGC
ATACCTGATATCGCTTCCCTGGAAGAGGTGCCCAAGATCTTCGAAGGGCTCGGT
CGGGACGAGACGCGCGGCGAACGCTCTGAAAGAAACAGCAGAGGAAGAGGG
TCACACTAGCGCCCTGGTAGAGTTGGAAGGCGACAACGCCAGGCTGGCCGTGCT
CAAGCGCAGCGTCGAGCTCACCCACTTCGCCTACCCCGCCGTCAACCTCCCGCCC
AAGGTCATGCGTCGCATCATGGATCAGCTCATCATGCCCCACATCGAGGCCCTC
GATGAAAGTCAGGAGCAGCGCCCCGAGGACGCCCGGCCCGTGGTCAGCGACGA
GATGCTCGCGCGCTGGCTCGGGACCCGCGACCCCCAGGCTTTGGAACAGCGGCG
CAAGCTCATGCTGGCCGTGGTCCTGGTCACCCTCGAGCTCGAATGCATGCGCCGC
TTCTTCACCGACCCCGAGACCCTGCGCAAAGTCGAGGAGACCCTGCACTACACT
TTCAGACACGGCTTCGTCAGGCAGGCCTGCAAGATCTCCAACGTGGAGCTGACC
AACCTGGTCTCCTGCCTGGGGATCCTTCACGAGAACCGCCTGGGCAGACCGTG
CTCCACTCTACCCTGAAGGGCGAGGCGCGTCGGGACTATGTCCGCGACTGCGTC
TTTCTCTTTCTCTGCCACACATGGCAAGCAGCCATGGGCGTGTGGCAGCAGTGTC
TCGAGGACGAGAACCTGAAGGAGCTGGACAAGCTTCTTGCTAGAAACCTTAAAA
```

TABLE 7-continued

Nucleic Acid Sequences of Vectors

| SEQ ID NO | Sequence |
|---|---|
| | AGCTGTGGACGGGCTTCGACGAGCGCACCGTCGCCTCGGACCTGGCCGAGATCG
TTTTTCCCGAACGCCTGAGGCAGACGCTGAAAGGCGGGCTGCCCGACTTCATGA
GCCAGAGCATGTTGCAAAACTACCGCACTTTTATTCTCGAGCGCTCGGGGATCCT
GCCCGCCACCTGCAACGCCTTCCCCTCCGACTTTGTCCCGCTGAGCTACCGCGAG
TGTCCCCCGCCGCTGTGGAGCCACTGCTACCTCTTGCAGCTGGCCAACTACATCG
CCCACCACTCGGATGTGATCGAGGACGTGAGCGGCGAGGGGCTTCTCGAGTGCC
ACTGCCGCTGCAACCTGTGCTCCCCGCACCGCTCCCTGGTCTGCAACCCCCAGCT
CCTAAGCGAGACCCAGGTCATCGGTACCTTCGAGCTGCAAGGTCCGCAGGAGTC
CACCGCTCCGCTGAAACTCACGCCGGGGTTGTGGACTTCCGCGTACCTGCGCAA
ATTTGTACCCGAGGACTACCACGCCCATGAGATAAAGTTCTTCGAGGACCAATC
GCGTCCGCAGCACGCGGATCTCACGGCCTGCGTCATCACCCAGGGCGCGATCCT
CGCCCAATTGCACGCCATCCAAAAATCCCGCCAAGAGTTTCTTCTGAAAAAGGG
TAGAGGGGTCTACCTGGACCCCCAGACGGGCGAGGTGCTCAACCCGGGTCTCCC
CCAGCATGCCGAGGAAGAAGCAGGAGCCGCTAGTGGAGGAGATGGAAGAAGAA
TGGGACAGCCAGGCAGAGGAGGACGAATGGGAGGAGGAGACAGAGGAGGAAG
AATTGGAAGAGGTGGAAGAGGAGCAGGCAACAGAGCAGCCCGTCGCCGCACCA
TCCGCGCCGGCAGCCCCTCCGGTCACGGATACAACCTCCGCAGCTCCGGCCAAG
CCTCCTCGTAGATGGGATCGAGTGAAGGGTGACGGTAAGCACGAGCGGCAGGG
CTACCGATCATGGAGGGCCCACAAAGCCGCGATCATCGCCTGCTTGCAAGACTG
CGGGGGGAACATCGCTTTCGCCCGCCGCTACCTGCTCTTCCACCGCGGGGTGAA
CATCCCCCGCAACGTGTTGCATTACTACCGTCACCTTCACAGCTAAGAAAAAGC
AAGTAAGAGGAGTCGCCGGAGGAGGAGGCCTGAGGATCGCGGCGAACGAGCCC
TTGACCACCAGGGAGCTGAGGAACCGGATCTTCCCCACTCTTTATGCCATTTTTC
AGCAGAGTCGAGGTCAGCAGCAAGAGCTCAAAGTAAAAAATCGGTCTCTGCGCT
CGCTCACCCGCAGTTGCTTGTACCACAAAAACGAAGATCAGCTGCAGCGCACTC
TCGAAGACGCCGAGGCTCTGTTCCACAAGTACTGCGCGCTGACTCTTAAAGACT
AAGGCGCGCCACCCGGAAAAAAGGCGGGAATTACCTCATCGCCACCATGAGCA
AGGAGATTCCCACCCCTTACATGTGGAGCTATCAGCCCCAAATGGGCCTGGCCG
CGGGCGCCTCCCAGGACTACTCCACCCGCATGAACTGGCTCAGTGCCGGCCCCT
CGATGATCTCACGGGTCAACGGGGTCCGTAACCATCGAAACCAGATATTGTTGG
AGCAGGCGGCGGTCACCTCCACGCCCAGGGCAAAGCTCAACCCGCGTAATTGGC
CCTCCACCCTGGTGTATCAGGAAATCCCCGGGCCGACTACCGTACTACTTCCGCG
TGACGCACTGGCCGAAGTCCGCATGACTAACTCAGGTGTCCAGCTGGCCGGCGG
CGCTTCCCGGTGCCCGCTCCGCCCACAATCGGGTATAAAAACCCTGGTGATCCG
AGGCAGAGGCACACAGCTCAACGACGAGTTGGTGAGCTCTTCGATCGGTCTGCG
ACCGGACGGAGTGTTCCAACTAGCCGGAGCAGGGAGATCGTCCTTCACTCCCAA
CCAGGCCTACCTGACCTTGCAGAGCAGCTCTTCGGAGCCTCGCTCCGGAGGCAT
CGGAACCCTCCAGTTCGTGGAGGAGTTTGTGCCCTCGGTCTACTTCAACCCCTTC
TCGGGATCGCCAGGCCTCTACCCGGACGAGTTCATACCGAACTTCGACGCAGTG
AGAGAAGCGGTGGACGGCTACGACTGAATGTCCCATGGTGACTCGGCTGAGCTC
GCTCGGTTGAGGCATCTGGACCACTGCCGCCGCCTGCGCTGCTTCGCCCGGGAG
AGCTGCGGACTCATCTACTTTGAGTTTCCCGAGGAGCACCCCAACGGCCCTGCAC
ACGGAGTGCGGATCACCGTAGAGGGCACCACCGAGTCTCACCTGGTCAGGTTCT
TCACCCAGCAACCCTTCCTGGTCGAGCGGGACCGGGGCGCCACCACCTACACCG
TCTACTGCATCTGTCCTACCCCGAAGTTGCATGAGAATTTTTGCTGTACTCTTTGT
GGTGAGTTTAATAAAAGCTGAAATAAGACTCTACTCTGGGATCAAGTGTCGTCA
TAATCGCACCGAGACCATCAACTTCACCACCCAGGAACAGGTGAACTTTACCTG
CAAACCCCACAAGAAGTACCTCATCTGGTTCTTCGAGAACACTACTCTTGCAGTA
GTTAACACCTGTGACAACGACGGTGTTCTTCTTCCCAACAATCTCACCAGTGGAC
TAGCCTTCTCTGTTAAAAGGGCAAAGCTAATTCTTCATCGCCCTATTGTAGAAGG
AACTTACCATTGTCAGAGCGGACCTTGTCACCACATTTTCCATTTGGTGAACGTC
ACCAGCAGCAGCAACAGCTCAGAAACTAACCTCTCTTCTCGTACTAACAGACCT
CAATTCGGAGGTGAGCTAAGGCTTCCCCCTTCTGAGGAGGGGGTTAGTCCATAC
GAAGTGGTCGGGTATTTGATTTTAGGGGTGGTCCTGGGTGGGTGCATAGCAGTG
CTAGCTCAGCTGCCTTGCTGGATCGAAATCAAAATCTTTATCTGCTGGGTCAGAC
ATTGTGGGGAGGAACCATGAAGGGGCTCTTGCTGATTATCCTTTCCCTGGTGGGG
GGTGTACTGTCATGCCACGAACAGCCACTATGTAACATCACCACAGGCAATGAG
AGAAGCGAATGCTCTGTAGTTATCAAATGTGAGCACAAATGTTCTCTCAACATTA
CATTCAAGAATAAGACCATGGGAAATGTATGGGTGGCTTCTGGCAACCAGGAG
ATGAGCAGAACTACACGGTCACTGTCCATGGTAGCGATGGCAATCACACTTTCG
GTTTCAAATTCATTTTTGAAGTCATGTGTGATATCACACTGCATGTGGCTAGACT
TCATGGCTTGTGGCCCCTACCAAGGAGAACATGGTGGGTTTTTCTTTGGCTTTT
GTGATCATGGCCTGCTTTATGTCAGGTCTGCTGGTAGGGGCTCTAGTGTGGTTTC
TGAAGCGCAAGCCCAGATATGGAAATGAGGAAAAGGAAAAATTGCTATAAATC
TTTTTCTCTTCGCAGAACCATGAATACTTTGACCAGTGTCGTGCTGCTCTCTCTTC
TTGTAGCTTTTAGTCAAGGACTATTAGAATCTAAAGTTGTAAAAATACCATATGG
CAGTACCTATGTTTTAGTTGGACCAAGAGATCCACCAGTTCAATGGTTTGGGGGT
GGAGATTTTACTATGTTCTGTAATGGAAGTAAAACTCACTTGCAAAACATAAGA
CACACTTGTAATGAACAGAACCTGACTTTACTGTCAGTTGGCTATGCCATAGAG
GTGATTACTATGGTTTTAGACATGATAACACAGGCAGAAAACATTATAAGGTTA
TAATCGAAGCACCTCCGCCAGTAACCAGAAAACCACTTTCAGAAATAAAATATG
TTAATGTTACCATGGGTCAAAATCTAACACTAAGTGGACCACCAGGAACGCCAG
TTACATGGCATGGAGAGGGTCACAAACTTTGCGAAGGCAAAATGTTTTCTATC
GCGAACTTAACCACACTTGTACAGAAAAGGACCTTATCCTGTTATTTGTAAACAG
AACTCATAATGTCCTTATATTGGTTACAACAAAGAAGGTACAGACAGAGAGCA
TTATGAAGTATCAGTGTTAGATTTAATGCCAATTGCAGGACAAGGTTTGGATTCA |

TABLE 7-continued

Nucleic Acid Sequences of Vectors

| SEQ ID NO | Sequence |
|---|---|
| | AAAAATAAAGAACAAAAAATACCTCCTAAAAGAAAATCAAAAGATAAAGTCAA
AGAAGTTAACTTTCCAACAGGAACTGATCAGACACTAATTGGACCTCCTGGGCA
AAAAATTGATTGGCATGTGAGCAGTAATGATGGTCAGTTTAAAAAACTGTGTGA
AACTAAAGATGGAAAACATTCTTGCCATGGGCGGAACATAACAATATTCAACAT
TAGCAGAGCAGATGAAGGGTCTTATTATGGCTCCAGCCATGATGGTTCGTCGCA
CTACAAAGTTACTGTGTATGACAAATCAAGCTTTGGTAAAGCAAAAATCAAAAT
TGATCCATACACCACAAAGGGAACAACCACTGAAAATTATCACGAGTTTGAATT
ACAACAGGGAAATGATGAATCAGACGATCAAAAACAAATTCCTTCAACTACTGT
GGCTATCGTGGTGGGTGTGATTGCGGGCTTCGTAACTCTGATCATTGTCTTTATC
TGCTACATCTGCTGCCGCAAGCGACCAAGGTCATACAATCATATGGTAGACCCA
CTACTCAGCTTCTCTTACTGAAACTCAGTTACTCTCATTTCAGAACCATGAAGGC
TTTCACAGCTTGCGTTCTGATTAGCTTAGTCACACTTAGTCTATCTCAAATGATTA
ATGTTAATGTTACCAGAGGAGGTAGTATTACATTGAATGGAACTTACAAAGATA
CTACATGGACAAGATATCACTTAGACTCATGGAAAAATTTATGCGAGTGGAACA
TTACAGCTTACAAATGTTATGAAAATGGAAGCATTACTATCACTGCCACTGGTGA
TATTACATCTGGCAGATACAAGGCAGAAAGTTACAAAAATGAAATTAAAAAATC
AATATTAAAAACTAATAAAACTACATTTGAAGATTCTGGAAACTATGAACATCA
AAAAATAACTTTCTATCAGCTAACAATAATCGAACTACCTACTACTAAGGCATCC
ACCACAGTTAGATCAACCCAGCCTACTACAGTCAGTACAACGATTGAAAGCACT
ACTCACACTACACAGTTAGACACTACAGTGAAGAACAGTACTGTGTTGGTTAGG
TTTTTGTTTAGGGAGGAAAGTACTACTGAACAGACAGAGGCTACCTCAAGTGCC
TTCAGCAGCACTGCAAATTTAACTTCGCTTGCTTCGGTAAATGAGACGATCGTGC
CGATGATGTATGGCCAACATTACCCAGGTTTGGATATGCAAATTACTTTCCTGAT
TGTCTGTGGGGTCTTTATCCTCACTGTCCTTCTCTACTTTGTCTGCTGCAAGGCCA
GAGAAAAATCTAGGCGGCCCATCTACAGGCCAGTAATCGGGGAACCTCAGCCCC
TCCAAGTGGATGGAGGCTTAAGAAATCTTCTCTTCTCTTTTACAGTATGGTGATC
AGCCATGATTCCTAGGTTCTTCCTATTTAACATCCTCTTCTGTCTCTTCAACATCT
GCGCTGCCTTCGCGGCCGTCTCGCACGCCTCGCCCGACTGTCTAGGGCCTTTCCC
CACCTACCTCCTCTTTGCCCTACTCACCTGCACCTGCGTCTGCAGCATTGTCTGCC
TGGTCATTACCTTCCTGCAGCTCATAGACTGGTGCTGCGCGCGCTACAATTACCT
GCATCATAGTCCCGAATACAGGGACGAGAACGTAGCCAGAATCTTAAGGCTCAT
ATGACCATGCAGACTCTGCTCATACTGCTATCCCTCCTATCCCCTGTCCTCGCTG
ATGATTACTCTAAATGCAAATTCGCGGACATATGGAATTTCTTAGACTGCTATCA
GGAGAAAATTGATATGCCCTCCTATTACTTGGTGATTGTTGGGGTAGTCATGGTC
TGCTCCTGCACTTTCTTTGCCATCATGATCTACCCCTGTTTTGATCTCGGCTGGAA
CTCTGTTGAGGCATTCACATACACACTAGAAAGCAGTTCACTAGCCTCCACGCCA
CCACCCACACCGCCTCCCCGCAGAAATCAGTTTCCCATGATTCAGTACTTAGAAG
AGCCCCCTCCCCGGCCCCCTTCCACTGTTAGCTACTTTCACATAACCGGCGGCGA
TGACTGACCACCACCTGGATCTCGAGATGGACGGGCAGGCCTCCGAGCAGCGCA
TCCTGCAACTGCGCGTCCGTCAGCAGCAGGAGCGGGCCGCCAAGGAGCTCCTCG
ATGCCATCAACATCCACCAGTGCAAGAAGGGCATCTTTTGCCTGGTCAAACAGG
CAAAGATCACCTACGAGCTCGTGTCCGGCGGCAAGCAGCATCGCCTCGCCTATG
AGCTGCCCCAGCAGAAGCAGAAGTTCACCTGCATGGTGGGCGTCAACCCCATAG
TCATCACCCAGCAGTCGGGCGAGACCAGCGGCTGCATCCACTGCTCCTGCGAAA
GCCCCGAGTGCATCTACTCCCTCCTCAAGACCCTTTGCGGACTCCGCGACCTCCT
CCCCATGAACTGATGTTGATTAAAAGCCCAAAACCAATCAGCCCCATCCCCAAT
TACTCATAAGAATAAATCATTGGAATTAATCATTCAATAAAGATCACTTACTTGA
AATCTGAAAGTATGTCTCTGGTGTAGTTGTTCAGCAGCACCTCAGTACCCTCCTC
CCAGCTCTGGTACTCCAGTCCCCGGCGGGCGGCAAACTTCCTCCACACCTTGAAA
GGGATGTCAAATTCCTGGTCCACAATTTTCATTGTCTTTCCTCTCAGATGTCAAA
GAGGCTCCGGGTGGAAGATGACTTCAATCCCGTCTACCCCTATGGCTACGCGCG
GAATCAGAATATCCCCTTCCTTACTCCCCCCTTTGTCTCCTCCGATGGATTCCAAA
ACTTCCCCCCTGGGGTCTTGTCACTCAAACTGGCTAACCCAATTGCTATCACCAA
TGGGAATGTCTCACTCAAGGTGGGAGGAGGACTCACTGTAGAACAAGACTCTGG
AAACCTAAGTGTGTCCCCTAAACCTCCATTGCAAATTGGAACAGACAAAAAACT
GGAATTGGCTTTGGCACCTCCATTTGATGTTAAAGAGAACAAGCTATCTTTGCTA
GTAGGAGATGGATTAAAGATAATAGATAGATCAATATCTGATTTGCCAGGATTG
TTAAACTATCTTGTAGTTTTAACTGGCAAAGGAATTGGAAATGAAGAATTAAAG
AATAACGATGGTAGTAATAAAGGAGTCGGTTTATGTGTGAGAATTGGAGAAGGA
GGTGGTTTAACTTTTGATGATAAAGGTTATTTAGTGGCATGGAACAATAAACATG
ACATCCGCACACTTTGGACAACTTTGGACCCTTCTCCAAATTGCAAAATAGATCT
AGAAAAAGACTCAAAACTAACTTTGGTACTGACAAAATGCGGAAGTCAGATTTT
GGCAAATGTATCTCTAATTATAGTTAAAGGAAAGTTTCAGAACCTTAACAACAA
AACAAACCCAACCCTACCTAAAACATTTAGCATCAAACTACTGTTTGATCGAAA
TGGAGTTCTATTGGAAAACTCAAACATTGAAAAACAGTACCTAAACTTTAGAAG
TGGAGACTCAATTCTTCCAAATCCATATAAAAATGCAATTGGGTTTATGCCTAAT
TTATTAGCTTATTCTAAATCTACAACTGATCAGTCTAAAATTTATGCAAGGAACA
CTATATATGGAAATATATACTTAGATAATCAGCCATATAATCCAGTTGTAATTAA
AGTTACTTTTAATAATGAAGCAGATAGTGCTTATTCTATCACTTTTAACTATTCAT
GGACCAAGGACTATGATAATATCCCTTTTGATTCTACTTCATTTACCTTCTCCTAT
ATCGCCCAAGAATGAAAGACCAATAAACGTGTTTTTCATTTGAAAATTTCATGTA
TCTTTATTTATTTTTACACCAGCACGGGTAGTCAGTTTCCCACCACCAGCCCATTT
CACAGTATAAACAACTCTCTCAGCACGGGTGGCCTTAAATAGGGAAATATTCTG
ATTAGTGCGGGAACTGGACTTAGGGTCTATAATCCACACAGTTTCCTGGCGAGC
CAAACGGGGGTCGGTGATTGAGATGAAGCCGTCCTCTGAAAAGTCATCCAAGCG
GGCCTCGCAGTCCAAGGTCACAGTCTGGTGGAATGAGAAGAACGCACAGATTCA |

TABLE 7-continued

Nucleic Acid Sequences of Vectors

| SEQ ID NO | Sequence |
|---|---|
| | TACTCGGAAAACAGGATGGGTCTGTGCCTCTCCATCAGCGCCCTCAACAGTCTTT
GCCGCCGGGGCTCGGTGCGGCTGCTGCAGATGGGATCGGGATCGCAAGTCTCTC
TGACTATGATCCCCACAGCCTTCAGCATCAGTCTCCTGGTGCGTCGGGCACAGCA
CCGCATCCTGATCTCGCTCATGTTCTCACAGTAAGTGCAGCACATAATCACCATG
TTATTCAGCAGCCCATAATTCAGGGTGCTCCAGCCAAAGCTCATGTTGGGGATG
ATGGAACCCACGTGACCATCATACCAGATGCGGCAGTATATCAGGTGCCTGCCC
CTCATGAACACACTGCCCATATACATGATCTCTTTGGGCATGTTTCTGTTCACAA
TCTGCCGGTACCAGGGGAATCG |
| SEQ ID NO: 1430 | ATAATATACCCCACAAAGTAAACAAAAGTTAATATGCAAATGAGCTTTTGAATT
TTAACGGTTTCGGGGCGGAGCCAACGCTGATTGGACGAGAAGCGGTGATGCAAA
TGACGTCACGACGCACGGCCGACGGTCGCCGCGGAGGCGTGGCCTAGCCCGGAA
GCAAGTCGCGGGGCTGATGACGTATAAAAAAGCGGACTTTAGACCCGGAAACG
GCCGATTTTCCCGCGGTCACGCCCGGATATGAGGTAATTCTGGGCGGATGCAAG
TGAAATTAGGTCATTTTGGCGCGAAAACTGAATGAGGAAGTGAAAAGTGAAAA
ATACCGGGCCCGCCCAGGGCGGAATATTTACCGAGGGCCGAGAGACTTTGACCG
ATTACGTGGGGGTTTCGATTGCGGTGTTTTTTCGCGAATTTCCGCGTCCGTGTCA
AAGTCCGGTGTTTATGTCACAGATCAGCTGATCCACAGGGTATTTAAACCAGTCG
AGCCCGTCAAGAGGCCACTCTTGAGTGCCAGCGAGTAGAGATTTCTCTGAGCTC
CGCTCCCAGAGACCGAGAAAAATGAGACACCTGCGCCTCCTGCCTTCAACTGTG
CCCGGTGAGCTGGCTGTGCTTATGCTGGAGGACTTTGTGGATACAGTATTGGAG
GACGAACTGCATCCAAGTCCGTTCGAGCTGGGACCCACACTTCAGGATCTCTAT
GATCTGGAGGTAGATGCCCATGATGACGACCCTAACGAAGAGGCTGTGAATTTA
ATATTTCCAGAATCTATGATTCTCCAGGCTGACATAGCTAGCGAAGCTATAGTTA
CTCCACTTCATACCCCAACTCTGCCGCCCATACCTGAATTGGAAGAGGAGGATG
AGATAGACCTCCGGTGCTACGAGGAAGGTTTTCCTCCCAGCGATTCAGAGGACG
AACAGGGTGAGCGAGAGATGGCTATTCTATCGGACTTTGCTTGTGTGATTGTGG
AGGAGCAAGATGTGATTGAAAAATCTACTGAGCCAGTACAAGGCTGTAGGAACT
GCCAGTACCACCGGGATAAGTCCGGAGATGTGAACGCCTCCTGCGCTCTGTGCT
ATATGAAACAGACTTTCAGCTTTATTTACAGTAAGTGGAGTGAATGTGAGAGAG
GCTGAGTGCTTAACACATAACTGTAATGCTTGAACAGCTGTGCTAAGTGTGGTTT
ATTTTTGTTACTAGGTCCGGTGTCAGAGGATGAGTCATCACCCTCAGAAGAAGA
CCACCCGTCTCCCCCTGAGCTGTCAGGCGAAACGCCCCTGCAAGTGCACAGACC
CACCCCAGTCAGACCCAGTGGCGAGAGGCGAGCAGCTGTTGAAAAAATTGAGG
ACTTGTTACATGATATGGGTGGGGATGAACCTTTGGACCTGAGCTTGAAACGCC
CCAGGAACTAGGCGCATATGCGCTTAGTCATGTGTAAATAAAGTTGTACAAATA
AAAAGTATATGTGACGCATGCAAGGTGTGGTTTATGACTCATGGGCGGGGCTTA
GTCCTATATAAGTGGTAACACCTGGGCACTCAGGCACAGACCTTCAGGGAGCTC
CTGATGGAGGTGTGGACTATCCTTGCGGACTTTAACAAGACACGCCGGCTTGTG
GAGGATAGTTCAGACGGGTGCTCCGGTTTCTGGAGACACTGGTTTGGAACTCCTC
TAGCTCGCCTGGTGTACACAGTTAAGAAGGATTATCAGGAGGAATTTGAAAATC
TTTTTGCCGACTGTTCTGGCCTTCTTGATTCACTGAATCTCGGCCACCAGGCTCTA
TTCCAGGAAAGGGTCCTCCACAGCCTTGATTTTTCCAGCCCAGGGCGCACTACAG
CCGGTGTTGCTTTTGTGGTGTTTCTGGTTGACAAATGGAGCCAGCAAACCCACCT
AACCAGGGATTACATCCTGGACTTCACGGCCATGCATCTGTGGAAGGCCTGGGT
CAGGCAGCGGGGACAGAGAATCTTGAACTACTGGCTTCTACAGCCAGCAGCTCC
GGGTCTTCTTCGTCTACACAGACAAACATCCATGTTGGAGGAAGAGATGAGGGA
GGCCATGGACGAGAACCCGAGGAGCGGCCTGGACCCTCCGTCGGAAGAGGAGC
TGGATTGAATCAGGTATCCAGCTTGTACCCAGAGCTTAGCAAGGTGCTGACAAC
CATGGCCAGGGGAGTGAAGAGGGAGAGGAGCGATGGGGGCAATACTGGGATGA
TGACCGAGCTGACAGCCAGCCTGATGAATCGCAGGCGACCTGAGCGCATTACCT
GGCATGAGCTACAGCAGGAGTGCAGGGATGAGATAGGCCTGATCAGGATAAA
TATGGCCTGGAGCAGATAAAAACCCACTGGTTGAACCCAGATGAGGATTGGGAG
GAGGCCATTAAGAAATATGCCAAGATAGCCCTGCGCCCAGATTGTAAGTACAGG
GTGACCAAGACGGTGAATATCAGACATGCCTGCTACATCTCAGGGAACGGGCA
GAGGTGATCATCGATACCCTGGATAAGGCTGCCTTCAGGTGTTGCATGATGGGA
ATGAGAGCCGGTGTGATGAATATGAATTCAATGATATTCATGAACATCAAGTTC
AATGGAGAGAAGTTTAATGGGGTGCTGTTCATGGCCAACAGCCACATGACCCTG
CACGGCTGTAATTTCTTTGGCTTTAACAACATGTGTGCAGAAGTCTGGGGTGCTT
CCAAGATCAGGGGCTGTAAGTTTTATGGCTGCTGGATGGGAGTGGTCGGAAGAC
CCAAGAGCGAGATGTCTGTGAAGCAGTGTGTGTTTGAAGTGCTACCTGGCCG
TGTCTACCGAGGGCAATGCTAGAGTGAGACATTGCTCTTCCATGGAGACGGGCT
GCTTCTGCCTGGTGAAGGGCACAGCTTCTATCAAGCATAATGTGATCAAGGGGT
GTACTGATGAGCGCATGTACAACATGCTGACCTGCGACTCTGGGTCTGCCATAT
CCTGAAGAACATCCATGTGACCTCCCACCCTAGGAAGAGGTGGCCATCATTTGA
AAATAATGTCCTGATCAAGTGCCATGTGCACCTGGGAGCCAGAAGGGTACCTT
CCAGCCGTACCAGTGCAACTTTAGCCAGACCAAGCTGCTGCTGGAGAATGATGC
CTTCTCCAGGGTGAACCTGAACGGTATCTTTGACATGGATGTCTCGGTGTACAAG
ATCCTGAGATACGATGAGACCAGGTCCAGGGTGCGCGCTTGCGAGTGCGGGGC
AGACACACCAGGATGCAGCCTGTGGCTCTGGATGTAACCGAGGAGCTGAGGCCC
GACCACCTGGTGATGGCCTGTACCGGGACCGAGTTCAGCTCCAGCGGGAGGAC
ACAGATTAGAGGTAGGTTGAGTATTAGTGGGCGTGGCTAAGGTGACTATAAAGG
TGGGTGTCTTACGAGGGTCTTTTTGCTTTTCTGCAGACATCATGAACGGGACCGG
CGGGGCCTTCGAAGGGGGGCTTTTCAGCCCTTATTTGACAACCCGCCTGCCGGG
ATGGGCCGGAGTTCGTCAGAATGTGATGGGATCTACGTGGATGGGCGCCCAGT
GCTTCCAGCAAATTCCTCGACCATGACCTACGCGACCGTGGGGACGAGCTCGTC |

TABLE 7-continued

Nucleic Acid Sequences of Vectors

| SEQ ID NO | Sequence |
|---|---|
| | GCTTGACAGCACCGCTGCAGCCGCGGCAGCCGCAGCCGCCATGACAGCGACGAG |
| | ATTGGCCTCGAGCTACATGCCCAGCAGCGGTAGCAGCCCCTCTGTGCCCAGTTCC |
| | ATCATCGCCGAGGAGAAACTGCTGGCCCTGCTGGCCGAGCTGGAAGCCCTGAGC |
| | CGCCAGCTGGCCGCCCTGACCCAGCAGGTGTCCGATCTCCGCGAGCAACAGCAG |
| | CAGCAAAATAAATGATTCAATAAACACAGATTCTGATTCAAACAGCAAAGCATC |
| | TTTATTATTTATTTTTTCGCGCGCGGTAGGCCCTGGTCCACCTCTCCCGATCATTG |
| | AGAGTGCGGTGGATTTTTTCCAGGACCCGGTAGAGGTGGGATTGGATGTTGAGG |
| | TACATGGGCATGAGCCCGTCTCCCGGGGGTGGAGGTAGCACCACTGCATGGCCTCG |
| | TGCTCTGGGGTCGTGTTGTAGATGATCCAGTCATAGCAGGGGCGCTGGGCGTGG |
| | TGCTGGATGATGTCCTTGAGGAGGAGACTGATGGCCACGGGGAGCCCCTTGGTG |
| | TAGGTGTTGGCGAAGCGGTTGAGCTGGGAGGGATGCATGCGGGGGGAGATGAT |
| | GTGCAGTTTGGCCTGGATCTTGAGGTTGGCGATGTTGCCGCCCAGATCCCGCCTG |
| | GGGTTCATGTTGTGCAGGACCACCAGGACGGTGTAGCCCGTGCACTTGGGGAAC |
| | TTATCATGCAACTTGGAAGGGAATGCGTGGAAGAATTTGGAGACGCCCTTGTGA |
| | CCGCCCAGGTTTTCCATGCACTCATCCATGATGATGGCAATGGGCCCGTGGGCTG |
| | CGGCTTTGGCAAAGACGTTTCTGGGGTCAGAGACATCATAATTATGCTCCTGGGT |
| | GAGATCATCATAAGACATTTTAATGAATTTGGGGCGGAGGGTGCCAGATTGGGG |
| | GACGATAGTTCCCTCGGGCCCCGGGGCGAAGTTCCCCTCGCAGATCTGCATCTCC |
| | CAGGCTTTCATCTCGGAGGGGGGATCATGTCCACCTGCGGGCGATGAAAAAA |
| | ACGGTTTCCGGGCGGGGGTGATGAGCTGCGAGGAGAGCAGGTTTCTCAACAGC |
| | TGGGACTTGCCGCACCCGGTCGGGCCGTATATGACCCCGATGACGGGTTGCAGG |
| | TGGTAGTTCAAGGACATGCAGCTGCCGTCGTCCCGGAGGAGGGGGGCCACCTCG |
| | TTGAGCATGTCTCTGACTTGGAGGTTTTCCCGGACGAGCTCGCCGAGGAGGCGG |
| | TCCCCGCCCAGTGAGAGCAGCTCTTGCAGGGAAGCAAAGTTTTTTAGGGGCTTG |
| | AGTCCGTCGGCCATGGGCATCTTGGCGAGGGTCTGCGAGAGGAGCTCCAGGCGG |
| | TCCCAGAGCTCGGTGACGTGCTCTACGGCATCTCGATCCAGCAGACTTCCTCGTT |
| | TCGGGGGTTGGGACGACTGCGACTGTAGGGCACGAGACGATGGGCGTCCAGCGC |
| | GGCCAGCGTCATGTCCTTCCAGGGTCTCAGGGTCCGCGTGAGGGTGGTCTCCGTC |
| | ACGGTGAAGGGGTGGGCCCCGGGCTGGGCGCTTGCAAGGGTGCGCTTGAGACTC |
| | ATCCTGCTGGTGCTGAAACGGGCACGGTCTTCGCCCTGCGCGTCGGCGAGATAG |
| | CAGTTGACCATGAGCTCGTAGTTGAGGGCCTCGGCGGCGTGGCCCTTGGCGCGG |
| | AGCTTGCCCTTGGAAGAGCGCCCGCAGGCGGGACATAGGAGGGATTGCAGGGC |
| | GTATAGCTTGGGCGCGAGAAAGACCGACTCGGGGGCGAAGGCGTCCGCTCCGCA |
| | GTGGGCGCAGACGGTCTCGCACTCGACGAGCCAGGTGAGCTCGGGCGTGCTCGGG |
| | GTCAAAAACCAGTTTTCCCCCGTTCTTTTTGATGCGCTTCTTACCTCGCGTCTCCA |
| | TGAGTCTGTGTCCGCGCTCGGTGACAAACAGGCTGTCGGTGTCCCCGTAGATGG |
| | ACTTGATTGGCCTGTCCTGCAGGGGCGTCCCGCGGTCCTCCTCGTAGAGAAACTC |
| | GGACCACTCTGAGACAAAGGCGCGCGTCCACGCCAAGACAAAGGAGGCCACGT |
| | GCGAGGGGTAGCGGTCGTTGTCCACCAGGGGGTCCACCTTTTCCACCGTGTGCA |
| | AGCACATGTCCCCCTCCTCCGCATCCAAGAAGGTGATTGGCTTGTAGGTGTAGGC |
| | CACGTGACCGGGGGTCCCCGACGGGGGGGTATAAAAGGGGGCGGGTCTGTGCTC |
| | GTCCTCACTCTCTTCCGCGTCGCTGTCCACGAGCGCCAGCTGTTGGGGTAGGTAT |
| | TCCCTCTCGAAAGCGGGCATGACCTCGGCACTCAGGTTGTCAGTTTCTAGAAACG |
| | AGGAGGATTTGATGTTGGCCTGCCCTGCCGCGATGCTTTTCAGGAGACTTTCATC |
| | CATCTGGTCAGAAAAGACTATTTTTTATTGTCAAGCTTGGTGGCAAAGGAGCCA |
| | TAGAGGGCGTTGGAGAAGCTTGGCGATGGATCTCATGGTCTGATTTTTGTCAC |
| | GGTCGGCGCGCTCCTTGGCCGCGATGTTGAGCTGGACATACTCGCGCGCGACGC |
| | ACTTCCATTCGGGGAAGACGGCGGTGCGATCGTCGGGCACGATCCTGACGCGCC |
| | AGCCGCGGTTATGCAGGGTGACCAGGTCCACGCTGGTGGCCACCTCGCCGCGCA |
| | GGGGCTCGTTGGTCCAGCAGAGTCTGCCGCCCTTGCGCGAGCAGAACGGGGGCA |
| | GCACATCAAGCAGATGTTCGTCAGGGGGGTCCGCATCGATGGTGAAGATGCCCG |
| | GACAGAGTTCCTTGTCAAAATAATCGATTTTTGAGGATGCATCATCCAAGGCCAT |
| | CTGCCACTCGCGGGCGGCCAGCGCTCGCTCGTAGGGGTTGAGGGGCGGACCCCA |
| | GGGCATGGGATGCGTGAGGGCGGAGGCGTACATGCCGCAGATGTCGTAGACAT |
| | AGATGGGCTCCGAGAGGATGCCGATGTAGGTGGGATAACAGCGCCCCCCGCGG |
| | ATGCTTGCGCGCACGTAGTCATACAACTCGTGCGATGGGGCCAAGAAAGCGGGG |
| | CCGAGATTGGTGCGCTGGGGCTGCTCGGCGCGGAAGACGATCTGGCGAAAGATG |
| | GCGTGCGAGTTGGAGGAGATGGTGGGCCGTTGGAAGATGTTAAAGTGGGCGTGG |
| | GGCAGGCGGACCGAGTCGCGGATGAAGTGCGCGTAGGAGTCTTGCAGCTTGGCG |
| | ACGAGCTCGGCGGTGACAAGGACGTCCATGGCGCAGTAGTCCAGCGTTTCGCGA |
| | ATAATGTCATAACCCGCCTCTCCTTTCTTCTCCCACAGCTCGCGGTTGAGGGCAT |
| | ACTCCTCGTCATCCTTCCAGTACTCCCGGAGCGGGAATCCTCGATCGTCCGCACG |
| | GTAAGAGCCCAGCATGTAGAAATGGTTCACGGCCTTGTAGGGACAGCAGCCCTT |
| | CTCCACGGGGAGGGCGTAAGCTTGAGCGGCCTTGCGGAGCGAGGTGTGCGTCAG |
| | GGCGAAGGTGTCCCTGACCATGACTTTCAAGAACTGGTACTTGAAATCCGAGTC |
| | GTCGCAGCCACCGTGCTCCCAGAGCTCGAAATCGGTGCGCTTCTTCGAGAGCGG |
| | GTTAGGCAGAGCGAAAGTGACATCATTGAAGAGAATCTTGCCTGCCCGCGGCAT |
| | GAAATTGCGGGTGATGCGAAAGGGCCCGGGACGGAGGCTCGGTTGTTGATGAC |
| | CTGGGCGGCGAGGACGATCTCGTCGAAGCCGTTGATGTTGTGCCCGACGATGTA |
| | GAGTTCCATGAATCGCGGACGGCCTTTGATGTGAGGCAGCTTTTTGAGCTCCTCG |
| | TAGGTGAGGTCCTCGGGACATTGCAAGCCGTGCTGCTCGAGCGCCCACTCGTGA |
| | AGATGTGGGTTGGCTTGCATGAAGGAAGCCCAGAGCTCGCGGGCCATGAGGGTC |
| | TGGAGCTCGTCGCGAAAGAGGCGGAACTGCTGGCCCACGGCCATCTTTTCTGGG |
| | GTGACGCAGTAGAAGGTGAGGGGGTCCCGCTCCCAGCGATCCCAGCGTAAGCGC |
| | ACGGCGAGATCGCGAGCGAGGGCGACCAGCTCTGGGTCCCCGAGAATTTCATG |
| | ACCAGCATGAAGGGGACGAGCTGTTTGCCAAAGGACCCCATCCAGGTGTAGGTT |

TABLE 7-continued

Nucleic Acid Sequences of Vectors

| SEQ ID NO | Sequence |
|---|---|
| | TCTACATCGTAGGTGACAAAGAGCCGCTCCGTGCGAGGATGAGAGCCGATTGGG
AAGAACTGGATTTCCTGCCACCAGTTGGACGAGTGGCTGTTGATGTGATGAAAG
TAGAAATCCCGCCGGCGAACAGAGCACTCGTGCTGATGCTTGTAAAAGCGTCCG
CAGTACTCGCAGCGCTGCACGGGCTGTACCTCATCCACGAGATACACAGCGCGT
CCCTTGAGGAGGAACTTCAGGAGTGGCGGCCCTGGCTGGTGGTTTTCATGTTCGC
CTGCGTGGGACTCACCCTGGGGCTCCTCGAGGACGGAGAGGCTGACGAGCCCGC
GCGGGAGCCAGGTCCAGATCTCGGCGCGGCGGGGGCGGAGAGCGAAGACGAGG
GCGCGCAGTTGGGAGCTGTCCATGGTGTCGCGGAGATCCAGGTCCGGGGGCAGG
GTTCTGAGGTTGACCTCGTAGAGGCGGGTGAGGGCGTGCTTGAGATGCAGATGG
TACTTGATTTCTACGGGTGAGTTGGTGGTCGTGTCCACGCATTGCATGAGCCCGT
AGCTGCGCGGGGCCACGACCGTGCCGCGGTGCGCTTTTAGAAGCGGTGTCGCGG
ACGCGCTCCCGGCGGCAGCGGCGGTTCCGGCCCCGCGGGCAGGGCGGCAGAG
GCACGTCGGCGTGGCGCTCGGGCAGGTCCCGGTGCTGCGCCCTGAGAGCGCTGG
CGTGCGCGACGACGCGGCGGTTGACATCCTGGATCTGCCGCCTCTGCGTGAAGA
CCACGGGCCCCGTGACTTTGAACCTGAAAGACAGTTCAACAGAATCAATCTCGG
CGTCATTGACGGCGGCCTGACGCAGGATTTCTTGCACGTCGCCCGAGTTGTCCTG
GTAGGCAATCTCGGACATGAACTGCTCGATCTCCTCCTCCTGGAGATCGCCGCGG
CCCGCGCGCTCGACGGTGGCGGCGAGGTCATTCGAGATGCGACCCATGAGCTGC
GAGAAGGCGCCCAGGCCGCTCTCGTTCCAGACGCGGCTGTAGACCACGTCCCCG
TCGGCGTCGCGCGCGCATGACCACCTGCGCGAGGTTGAGCTCCACGTGCCGC
GTGAATACGGCGTAGTTGCGCAGGCGCTGGAAGAGGTAGTTGAGGGTGGTGGCG
ATGTGCTCGGTGACGAAGAAGTACATGATCCAGCGGCGCAGGGGCATCTCGCTG
ATGTCGCCGATGGCCTCCAGCCTTTCCATGGCCTCGTAGAAATCCACGGCGAAGT
TGAAAAACTGGGCGTTGCGGGCCGAGACCGTGAGCTCGTCTTCCAGGAGCCGGA
TGAGTTCGGCGATGGTGGCGCGCACCTCGCGCTCGAAATCCCCGGGGGCCTCCT
CCTCTTCCTCTTCTTCCATGACGACCTCTTCTTCTATTTCCTCCTCTGGGGGTGGT
GGTGGTGGCGGGGCCCGACGACGACGGCGACGCACCGGGAGACGGTCGACGAA
GCGCTCGATCATCTCCCCGCGGCGGCGACGCATGGTTTCGGTGACGGCGCGACC
CCGTTCGCGAGGACGCAGCGTGAAGACGCCGCCGGTCATCTCCCGGTAATGGGG
CGGGTCCCCGTTGGGCAGCGAGAGGGCGCTGACGATGCATCTTATCAATTGCGG
TGTAGGGGACGTGAGCGCGTCGAGATCGACCGGATCGGAGAATCTTTCGAGGAA
AGCGTCTAGCCAATCGCAGTCGCAAGGTAAGCTCAAACACGTAGCAGCCCTGTG
GACGCTGTTAGAGTTGCGGTTGCTGATGATGTAATTAAAGTAGGCGTTTTTAAGG
CGGCGGATGGTGGCGAGGAGGACCAGGTCCTTGGGTCCCGCTTGCTGGATGCGG
AGCCGCTCGGCCATGCCCCAGGCCTGGCCCTGACACCGGCTCAAGTTCTTGTAGT
AGTCATGCATGAGCCTCTCGATGTCATCACTGGCGGAGGCGGAGTCTTCCATGC
GGGTTACCCCGACGCCCTGAGCGGCTGCACGAGCGCCAGGTCGGCGACGACG
GCTCGGCGAGGATGGCCTGTTGCACGCGGGTGAGGGTGTCCTGGAAGTCGTCCA
TGTCGACGAAGCGGTGGTAGGCCCCGGTGTTGATGGTGTAGGTGCAGTTGGCCA
TGAGCGACCAGTTGACGGTCTGCAGGCCGGGCTGCACGACCTCGGAGTACCTGA
GCCGCGAGAAGGCGCGCGAGTCGAAGACATAGTCGTTGCAGGTGCGCACGAGG
TACTGGTAGCCGACTAGGAAGTGCGGCGGCGGCTGGCGGTAGAGCGGCCAGCG
CTGGGTGGCCGGCGCGCCCGGGGCAGGTCCTCGAGCATGAGGCGGTGGTAGCC
GTAGAGGTAGCGGGACATCCAGGTGATGCCGGCGGCGGTGGTGGAGGCGCGCG
GGAACTCGCGGACGCGGTTCCAGATGTTGCGCAGCGGCAGGAAATAGTCCATGG
TCGGCACGGTCTGGCCGGTGAGACGCGCGCAGTCATTGACGCTCTAGAGGCAAA
AACGAAAGCGGTTGAGCGGGCTCTTCCTCCGTAGCCTGGCGGAACGCAAACGGG
TTAGGCCGCGCGTGTACCCCGGTTCGAGTCACCTCGAATCAGGCTGGAGCCGCG
ACTAACGTGGTATTGGCACTCCCGTCTCGACCCGAGCCCGATAGCCGCCAGGAT
ACGGCGGAGAGCCCTTTTTGCCGGCCGAGTGGGGTCGCTAGACTTGAAAGCGGC
GGAAAACCCTGCCGGGTAGTGGCTCGCGCCCGTAGTCTGGAGAAGCATCGCCAG
GGTTGAGTCGCGGCAGAACCCGGTTCGCGGACGGTCGCGGCGAGCGGGACTTGG
TCACCCCGCCGATTTAAAGACCCACAGCCAGCCGACTTCTCCAGTTACGGGAGC
GAGCCCCCTTTTTTCTTTTTGCCAGATGCATCCCGTCCTGCGCCAAATGCGTCCCA
CCCCCCGGCGACCACCGCAACCGCGGCCGTAGCAGGCGCCGGCGCTAGCCAGC
CACAGCCACAGACAGAGATGGACTTGGAAGAGGGCGAAGGCTGGCAAGACTG
GGGGCGCCGTCCCCGGAGCGACACCCCCGCGTGCAGCTGCAGAAGGACGTGCGC
CCGGCGTACGTGCCTCCGCAGAACCTGTTCAGGGACCGCAGCGGGGAGGAGCCC
GAGGAGATGCGCGACTGCCGGTTTCGGGCGGGCAGGGAGCTGCGCGAGGGCCT
GGACCGCCAGCGCGTGCTGCGCGACGAGGATTTCGAGCCGAACGAGCAGACGG
GGATCAGCCCCGCGCGCGCACGTGGCGGCGGCCAACCTGGTGACGGCCTACG
AGCAGACGGTGAAGCAGGAGCGCAACTTCCAAAAGAGTTTCAACAACCACGTG
CGCACGCTGATCGCGCGCGAGGAGGTGGCCCTGGGCCTGATGCACCTGTGGGAC
CTGGCGGAGGCCATCGTGCAGAACCCGGACAGCAAGCCTCTGACGGCGCAGCTG
TTCCTGGTGGTGCAGCACAGCAGGGACAACGAGGCGTTCAGGGAGGCGCTGCTG
AACATCGCCGAGCCCGAGGGTCGCTGGCTGCTGGAGCTGATTAACATCTTGCAG
AGCATCGTAGTGCAGGAGCGCAGCCTGAGCCTGGCCGAGAAGGTGGCGGCGAT
CAACTACTCGGTGCTGAGCCTGGGCAAGTTTTACGCGCGCAAGATTTACAAGAC
GCCGTACGTGCCCATAGACAAGGAGGTGAAGATAGACAGCTTTTACATGCGCAT
GGCGCTCAAGGTGCTAACGCTGAGCGACGACCTGGGCGTGTACCGCAACGACCG
CATCCACAAGGCCGTGAGCGCGAGCCGGCGGCGCGAGCTGAGCGACCGCGAGC
TGATGCTGAGCCTGCGCCGGGCGCTGGTAGGGGGCGCCGCCGGCGGCGAGGAGT
CCTACTTCGACATGGGGCGGACCTGCATTGGCAGCCGAGCCGGCGCGCCTTGG
AGGCCGCCTACGGTCCAGAGGACTTGGAAGAGGATGAGGAAGAGGAGGAGGAT
GCACCCGCTGCGGGGTACTGACGCCTCCGTGATGTGTTTTTAGATGCAGCAAGCC
CCGGACCCCGCCATAAGGGCGGCGCTGCAAAGCCAGCCGTCCGGTCTAGCATCG |

TABLE 7-continued

Nucleic Acid Sequences of Vectors

SEQ ID NO Sequence

```
GACGACTGGGAGGCCGCGATGCAACGCATCATGGCCCTGACGACCCGCAACCCC
GAGTCCTTTAGACAACAGCCGCAGGCCAACAGACTTTCGGCCATTCTGGAGGCG
GTGGTCCCCTCTCGGACCAACCCCACGCACGAGAAGGTGCTGGCGATCGTGAAC
GCGCTGGCGGAGAACAAGGCCATCCGTCCCGACGAGGCCGGGCTGGTGTACAAC
GCCCTGCTGGAGCGCGTGGGCCGCTATAACAGCACGAACGTGCAGTCCAACCTG
GACCGGCTGGTGACGGACGTGCGCGAGGCCGTGGCGCAGCGCGAGCGGTTCAA
GAACGAGGGCCTGGGCTCGCTGGTGGCGCTGAACGCCTTCCTGGCGACGCAGCC
GGCGAACGTGCCGCGCGGGCAGGACGATTACACCAACTTTATCAGCGCGCTGCG
GCTCATGGTGACCGAGGTGCCCCAGAGCGAGGTGTACCAGTCTGGCCCGGACTA
CTTTTTCCAGACGAGCCGGCAGGGCTTGCAGACGGTGAACCTGAGCCAGGCTTT
CAAGAACCTGCGCGGGCTGTGGGGCGTGCAGGCGCCCGTGGGCGACCGGTCGAC
GGTGAGCAGCTTGCTGACGCCCAACTCGCGGCTGCTGCTGCTGCTGATCGCGCCC
TTCACCGACAGCGGCAGCGTAAACCGCAACTCGTACCTGGGTCACTTGCTAACG
CTGTACCGCGAGGCCATAGGCCAGGCACAGGTGGACGAGCAGACCTTCCAGGA
GATCACAAGCGTGAGCCGCGCGCTGGGGCAGAACGACACCGACAGTCTGAGGG
CCACCCTGAACTTCTTGCTGACCAATAGACAGCAGAAGATCCCGGCGCAGTACG
CGCTGTCGGCCGAGGAGGAAAGGATCCTGAGATATGTGCAGCAGAGCGTAGGG
CTTTTCCTGATGCAGGAGGGGGCCACCCCCAGCGCCGCGCTGGACATGACCGCG
CGCAACATGGAACCTAGCATGTACGCCGCCAACCGGCCGTTCATCAATAAGCTG
ATGGACTATCTGCACCGCGCGGCGGCCATGAACTCGGACTACTTTACTAATGCTA
TACTAAACCCGCACTGGCTCCCGCCGCCGGGGTTCTACACGGGCGAGTACGACA
TGCCCGACCCCAACGACGGGTTCCTGTGGGACGACGTGGACAGCGCGGTGTTCT
CACCGACCTTGCAAAAGCGCCAGGAGGCGGTGCGCACGCCCGCGAGCGAGGGC
GCGGTGGGTCGGAGCCCCTTTCCTAGCTTAGGGAGTTTGCATAGCTTGCCGGGCT
CGGTGAACAGCGGCAGGGTGAGCCGGCCGCGCTTGCTGGGCGAGGACGAGTAC
CTGAACGACTCGCTGCTGCAGCCGCCGCGGGTCAAGAACGCCATGGCCAATAAC
GGGATAGAGAGTCTGGTGGACAAACTTAACCGCTGGAAGACCTACGCTCAGGAC
CATAGAGAACCTGCGCCCGCGCCGCGGCGACAGCGCCACGACCGGCAGCGGGG
CCTGGTGTGGGACGACGAGGACTCGGCCGACGATAGCAGCGTGTTGGACTTGGG
CGGGAGCGGTGGGGTCAACCCGTTCGCGCATTTGCAGCCCAGACTGGGGCGACG
GATGTTTTGAATGCAAAATAAAACTCACCAAGGCCATAGCGTGCGTTCTCTTCCT
TGTTAGAGATGAGGCGTGCGGTGGTGTCTTCCTCTCCTCCTCCCTCGTACGAGAG
CGTGATGGCGCAGGCGACCCTGGAGGTTCCGTTTGTGCCTCCGCGGTATATGGCT
CCTACGGAGGGCAGAAACAGCATTCGTTACTCGGAGCTGGCTCCGCAGTACGAC
ACCACTCGCGTGTACTTGGTGGACAACAAGTCGGCGGACATCGCTTCCCTGAAC
TACCAAAACGACCACAGCAACTTCCTGACCACGGTGGTGCAGAACAACGATTTC
ACCCCCGCCGAGGCCAGCACGCAGACGATAAATTTTGACGAGCGGTCGCGGTGG
GGCGGTGATCTGAAGACCATTCTGCACACCAACATGCCCAATGTGAACGAGTAC
ATGTTCACCAGCAAGTTTAAGGCGCGGGTGATGGTGGCTAGAAAAAAGGCGGA
AGGGGCTGATGCAAATGATAGAAGCAAGGATATTTTAGAGTATGAATGGTTTGA
GTTTACCCTGCCCGAGGGCAACTTTTCCGAGACCATGACCATAGACCTGATGAA
CAACGCCATCTTGGAAAACTACTTGCAAGTGGGGCGGCAGAATGGCGTGCTGGA
GAGCGATATCGGAGTCAAGTTTGACAGCAGAAATTTCAAGCTGGGCTGGGACCC
GGTGACCAAGCTGGTGATGCCAGGGGTCTACACCTACGAGGCCTTCCACCCGGA
CGTGGTGCTGCTGCCGGGCTGCGGGGTGGACTTCACCGAGAGCCGCCTGAGCAA
CCTCCTGGGCATTCGCAAGAAGCAACCTTTTCCAAGAGGGCTTCAGAATCATGTA
TGAGGATCTAGTAGGGGGCAACATCCCCGCCCTGCTTGATGTGCCCAAGTACTT
GGAAAGCAAGAAGAAACTGGAGGAAGCCGCTAAGGAATCTGGCAATACCAAAG
CTGAGGAAGAGGCTGCTAAAAAAGAGCTAGTTATTTTGCCAGTAACAGAAGATG
AAAGCAAAAGAAGCTATAATTTAATTCAGGGAACCACAGACACGCTGTACCGAA
GCTGGTACCTGTCCTATACCTACGGGGACCCCGAGAAGGGGGTGCAGTCGTGGA
CGCTGCTTACCACCCCTGATGTCACCTGCGGCGCGGAGCAAGTCTACTGGTCGCT
GCCGGACCTCATGCAAGACCCCGTCACCTTCCGCTCTACCCAGCAAGTCAGCAA
CTACCCCGTGGTCGGCGCCGAGCTCATGCCCTTCCGCGCCAAGAGCTTTTACAAC
GACCTCGCCGTCTACTCCCAGCTCATCCGCAGCTACACCTCCCTCACCCACGTCT
TCAACCGCTTCCCCGACAACCAGATCCTCTGCCGCCCGCCCGCGCCCACCATCAC
CACCGTCAGTGAAAACGTGCCTGCTCTCACAGATCACGGGACGCTACCGCTGCG
CAGCAGTATCCGCGGAGTCCAGCGAGTGACCGTCACTGACGCCCGTCGCCGCAC
CTGTCCCTACGTCTACAAGGCCCTGGGCATAGTCGCGCCGCGCGTGCTTTCCAGT
CGCACCTTCTAAAAAATGTCTATTCTCATCTCGCCCAGCAATAACACCGGCTGGG
GTCTTACTAGGCCCAGCACCATGTACGGAGGAGCCAAGAAGCGCTCCCAGCAGC
ACCCCGTCCGCGTCCGCGGCCACTTCCGCGCTCCCTGGGGCGCTTACAAGCGCG
GGCGGACTTCTACCGCCGCCGCCGTGCGCACCACCGTCGACGACGTTATCGACT
CGGTGGTCGCCGACGCGCGCAACTACACCCCCGCCCCTCCACCGTGGACGCGG
TCATCGACAGCGTGGTGCCGACGCGCGCGACTATGCCAGACGCAAGAGCCGGC
GGCGACGGATCGCCAGGCGCCACCGGAGCACGCCCGCCATGCGCGCCGCTCGGG
CTCTGCTGCGCCGCGCCAGACGCACGGGCCGCCGGGCCATGATGCGAGCCGCGC
GCCGCGCTGCCGCTGCACCCCCCGCAGGCAGGACTCGCAGACGAGCGGCCGCCG
CCGCCGCCGCGGCCATCTCTAGCATGACTAGACCCAGGCGCGGAAACGTGTACT
GGGTGCGCGACTCCGTCACGGGCGTGCGCGTGCCCGTGCGCACCCGTCCTCCTC
GTCCCTGATCTAATGCTTGTGTCCTCCCCCGCAAGCGACGATGTCAAAGCGCAAA
ATCAAGGAGGAGATGCTCCAGGTCGTCGCCCCGGAGATTTACGACCCCCGGAC
CAGAAACCCCGCAAAATCAAGCGGGTTAAAAAAAGGATGAGGTGGACGAGGG
GGCAGTAGAGTTTGTGCGCGAGTTCGCTCCGCGGCGGCGCGTAAATTGGAAGGG
GCGCAGGGTGCAGCGCGCGTTGCGGCCCGGCACGGCGGTGGTATTCACGCCCGG
CGAGCGGTCCTCGGTCAGGAGCAAGCGTAGCTATGACGAGGTGTACGGCGACGA
```

TABLE 7-continued

Nucleic Acid Sequences of Vectors

SEQ ID NO Sequence

CGACATCCTGGACCAGGCGGCGGAGCGGGCGGGCGAGTTCGCCTACGGGAAGC
GGTCGCGCGAAGAGGAGCTGATCTCGCTGCCGCTGGACGAGAGCAACCCCACGC
CGAGCCTGAAGCCCGTGACCCTGCAGCAGGTGCTGCCCCAGGCGGTGCTGCTTC
CGAGCCGCGGGGTCAAGCGCGAGGGCGAGAGCATGTACCCGACCATGCAGATC
ATGGTGCCCAAGCGCCGGCGCGTGGAGGACGTGCTGGACACCGTGAAAATGGAT
GTGGAGCCCGAGGTCAAGGTGCGCCCCATCAAGCAGGTGGCGCCGGGCCTGGGC
GTGCAGACCGTGGACATTCAGATCCCCACCGACATGGATGTCGACAAAAAACCC
TCGACCAGCATCGAGGTGCAGACCGACCCCTGGCTTCCAACCTCCACCGCTACC
GCCTCCACTTCTACCGCCGCCACGGCTACCGAGCCTCCCAGGAGGCGAAGATGG
GGCGCCGCCAGCCGGCTAATGCCCAACTACGTGTTGCATCCTTCCATCATCCCGA
CGCCGGGCTACCGCGGCACCCGGTACTACGCCAGCCGCAGGCGCCCAGCCAGCA
AACGCCGCCGCCGCACCGCCACCCGCCGCCGTCTGGCCCCCGCCCGCGTGCGCC
GCGTAACCACGCGCCGGGGCCGCTCGCTCGTTCTGCCCACCGTGCGCTACCACCC
CAGCATCCTTTAATCCGTGTGCTGTGATACTGTTGCAGAGAGATGGCTCTCACTT
GCCGCCTGCGCATCCCCGTCCCGAATTACCGAGGAAGATCCCGCCGCAGGAGAG
GCATGGCAGGCAGCGGCCTGAACCGCCGCCGGCGGCGGGCCATGCGCAGGCGC
CTGAGTGGCGGCTTTCTGCCCGCGCTCATCCCCATAATCGCCGCGGCCATCGGCA
CGATCCCGGGCATAGCTTCCGTTGCGCTGCAGGCGTCGCAGCGCCGTTGATGTGC
GAATAAAGCCTCTTTAGACTCTGACACACCTGGTCCTGTATATTTTTAGAATGGA
AGACATCAATTTTGCGTCCCTGGCTCCGCGGCACGGCACGCGGCCGTTCATGGG
CACCTGGAACGAGATCGGCACCAGCCAGCTGAACGGGGGCGCCTTCAATTGGAG
CAGTGTCTGGAGCGGGCTTAAAAATTTCGGCTCGACGCTCCGGACCTATGGGAA
CAAGGCCTGGAATAGTAGCACGGGGCAGATGTTGAGGGAAAAGCTCGCAGACC
AGAACTTCCAGCAGAAGGTGGTGGACGGGCTGGCCTCGGGCATTAACGGGGTGG
TGGACATCGCGAACCAGGCCGTGCAGCGCGAGATAAACAGCCGCCTGGACCCGC
GTCCGCCCACGGTGGTGGAGATGGAAGATGCAACTCTTCCGCCGCCCAAGGGCG
AGAAGCGACCGCGGCCCGACGCGGAGGAGACGACCCTGCAGGTGGACGAGCCG
CCCTCGTACGAGGAGGCTGTCAAGGCCGGCATGCCCACCACGCGCATCATCGCG
CCGCTGGCCACGGGTGTAATGAAACCCGCCACCCTAGACCTGCCTCCACCACCC
ACGCCCGCTCCACCGAAGGCAACTCCGGTTGTGCAGCCCCCTCCGGTGGCAACC
GCCGTGCGCCGCGTCCCCGCCCGCCGCCAGGCCCAGAACTGGCAAAGCACGCTG
CACAGTATCGTGGGCCTGGGAGTGAAAAGTCTGAAGCGCCGCCGATGCTATTGA
GAGAGAGGAAAGAGGACACTAAAGGAGAGCTTAACTTGTATGTGCCTTACCGCC
AGAGAACGCGCGAAGATGGCCACCCCCTCGATGATGCCGCAGTGGGCGTACATG
CACATCGCCGGGCAGGACGCCTCGGAGTACCTGAGCCCGGGTCTGGTGCAGTTT
GCCCGCGCCACCGACACGTACTTCAGCCTGGGCAACAAGTTTAGGAACCCCACG
GTGGCTCCCACCCACGATGTGACCACGGACCGGTCCCAGCGTCTGACGCTGCGC
TTCGTGCCCGTGGATCGCGAGGACACCACGTACTCGTACAAGGCGCGCTTCACT
CTGGCCGTGGGCGACAACCGGGTGCTAGACATGGCCAGCACTTACTTTGACATC
CGCGGCGTCCTGGACCGCGGTCCCAGCTTCAAACCCTACTCTGGCACGGCCTAC
AACAGCCTGGCCCCCAAGGGCGCCCCAATCCCAGTCAGTGGACTACGAAAGAG
AATAATGGTCAACAAAAAGAAATAACGCACACTTTTGGTGTGGCTGCTATGGGA
GGGGAATCAATAGATAAAGATAAAGGTTTACAAATTGGAACTGAAGAAACAAC
AGACAATGGACAGCAAAAGATCTATGCAAATAAAATCTTCCAGCCAGAACCTCA
AGTAGGAGAGGATAACTGGAGTGAAAATTACCCAGTTTATGGCGGAAGAGCGCT
TAAGAAAGATACCAAGATGAAGCCTTGCTATGGCTCGTTTGCTAGACCTACTAA
TGAAAAAGGTGGGCAGGCGAAACTAAAGGACCCAGAAAATAACCAGAAAGAAT
TCGACATCGACTTGGCTTTCTTTGATCCAAATGACATCAACACTCCAGACGTTGT
GCTTTACACTGAAAATGCACATCTGGAAACACCAGACACCCATGGTGTATAA
AGCTGGCAAAGAAGACGACAGTTCCGAAATCAACCTGGTTCAGCAGTCCATGCC
AAACAGGCCCAACTACATCGGCTTCAGGGACAACTTTGTGGGGCTCATGTATTA
CAACAGCACTGGCAACATGGGTGTGCTGGCCGGCCAGGCCTCTCAGTTGAATGC
TGTGGTTGATTTGCAAGACAGAAACACAGAGCTGTCTTACCAGCTATTGCTAGAT
TCTCTGGGTGACAGAACCAGATACTTTAGCATGTGGAACTCTGCGGTGGACAGC
TATGATCCCGATGTCAGGATCATTGAGAATCACGGTGTGGAAGATGAACTTCCA
AACTATTGCTTCCCATTGGATGGAGTGGCAACTAATGCAGTTTTCCAAGGTGTTA
AACCTGATCCAGCTGCTGGTGATCAAGACAAATGGGTTAAGGATGAAAACAGCG
ATGAACATAACAGAATAGGCAAGGGAAACATCTATGCCATGGAGATCAACCTCC
AGGCCAACCTGTGGAAGAGTTTTCTGTACTCGAACGTGGCCCTGTACCTGCCCGA
CTCATACAAGTACACGCCGGCCAACGTCACGCTGCCCACCAACACCAACACCTA
CGACTACATGAACGGCCGCGTGGTAGCCCCCTCGCTGGTGGACGCCTACGTCAA
TATCGGCGCGCGCTGGTCGCTGGACCCCATGGACAATGTCAACCCCTTCAACCA
CCACCGCAATGCGGGTCTGCGCTACCGTTCCATGCTTCTGGGCAACGGCCGCTAC
GTGCCCTTCCACATCCAAGTGCCCAAAAGTTCTTTGCCATCAAGAACCTGCTTC
TGCTTCCCGGCTCCTACACCTACGAGTGGAACTTCCGCAAGGACGTCAACATGAT
CCTGCAGAGTTCCCTCGGAAACGACCTGCGCGTCGACGGCGCCTCCGTCCGCTTC
GACAGCGTCAACCTCTACGCCACCTTCTTCCCCATGGCGCACAACACCGCCTCCA
CCCTGGAAGCCATGCTGCGCAACGACACCAACGACCAGTCCTTCAACGACTACC
TGTCGGCCGCCAACATGCTCTACCCCATCCCGGCCAAGGCCACCAACGTGCCCA
TCTCCATCCCCTCGCGCAACTGGGCCGCCTTCCGCGGCTGGAGTTTCACCAGGCT
CAAGACCAAGGAAACTCCCTCCCTGGGCTCGGGTTTCGACCCCATACTTTGTCTAC
TCGGGCTCCATTCCCTACCTCGACGGAACCTTCTACCTCAACCACACTTTCAAGA
AGGTCTCCATCATGTTCGACTCCTCGGTCAGCTGGCCAGGCAACGACCGGCTGCT
TACGCCGAACGAGTTCGAGATCAAGCGCAGCGTCGACGGGGAGGGCTACAACG
TGGCCCAATGCAACATGACCAAGGACTGGTTCCTCGTCCAGATGCTCTCCCACTA
CAACATCGGCTACCAGGGCTTCTACGTGCCCGAGGGCTACAAGGACCGCATGTA

TABLE 7-continued

Nucleic Acid Sequences of Vectors

SEQ ID NO Sequence

```
CTCCTTCTTCCGCAACTTCCAGCCCATGAGCAGGCAGGTGGTCGATGAGATCAAC
TACAAGGACTACAAGGCCGTCACCCTGCCCTTCCAGCACAACAACTCGGGCTTC
ACCGGCTACCTTGCACCCACCATGCGTCAGGGGCAGCCCTACCCCGCCAACTTCC
CCTACCCGCTCATCGGCCAGACAGCCGTGCCCTCTGTCACCCAGAAAAAGTTCCT
CTGCGACAGGGTCATGTGGCGCATCCCCTTCTCCAGCAACTTCATGTCCATGGGC
GCCCTCACCGACCTGGGTCAGAACATGCTCTACGCCAACTCGGCCCACGCGCTC
GACATGACCTTCGAGGTGGACCCCATGGATGAGCCCACCCTCCTCTATCTTCTCT
TCGAAGTTTTCGACGTGGTCAGAGTGCACCAGCCGCACCGCGGCGTCATCGAGG
CCGTCTACCTGCGCACGCCCTTCTCCGCCGGCAACGCCACCACCTAAGCATGAGC
GGCTCCAGCGAACGAGAGCTCGCGGCCATCGTGCGCGACCTGGGCTGCGGGCCC
TACTTTTTGGGCACCCACGACAAGCGCTTCCCGGGCTTCCTCGCCGGCGACAAGC
TGGCCTGTGCCATCGTCAACACGGCCGGCCGCGAGACCGGGGCGTGCACTGGC
TCGCCTTTGGCTGGAACCCGCGCTCGCGCACCTGCTACATGTTCGACCCCTTTGG
GTTCTCGGACCGCCGGCTCAAGCAGATTTACAGCTTCGAGTACGAGGCCATGCT
GCGCCGCAGCGCCCTGGCCTCCTCACCCGACCGGTGTCTCAGCCTCGAGCAGTCC
ACCCAGACCGTGCAGGGGCCCGACTCCGCCGCCTGCGGACTTTTTTGTTGCATGT
TCTTGCATGCCTTCGTGCACTGGCCCGACCGACCCATGGACGGGAACCCCACCAT
GAACTTGCTGACGGGGGTGCCCAACGGCATGCTACAATCGCCACAGGTGCTGCC
CACCCTCCGGCGCAACCAGGAGGAGCTCTACCGCTTCCTCGCGCGCCACTCCCCT
TACTTTCGATCCCACCGCGCCGCCATTGAACACGCCACCGCTTTTGACAAAATGA
AACAACTGCGTGTATCTCAATAAACAGCACTTTTATTTTACATGCACTGGAGTAT
ATGCAAGTTATTTAAAAGTCGAAGGGGTTCTCGCGCTCGTCGTTGTGCGCCGCGC
TGGGGAGGGCCACGTTGCGGTACTGGAACTTGGGCTGCCACTTGAACTCGGGGA
TCACCAGTTTGGGCACTGGGGTCTCGGGGAAGGTCTCGCTCCACATGCGCCGGC
TCATCTGCAGAGCGCCCAGTATGTCAGGCGCGGAGATCTTGAAATCGCAGTTGG
GGCCGGTGCTCTGCGCGCGCGAGTTGCGGTACACGGGGTTGCAGCACTGGAACA
CCATCAGACTGGGGTACTTCACACTGGCCAGCACGCTCTTGTCGCTGATCTGATC
CTTGTCCAGGTCCTCGGCGTTGCTCAGGCCGAACGGGGTCATCTTGCACAGCTGG
CGGCCCAGGAAGGGCACGCTCTGAGGCTTGTGGTTACACTCGCAGTGCACGGGC
ATCAGCATCATCCCCGCGCCGCGCTGCATATTCGGGTAGAGGGCCTTGACAAAG
GCCGAGATCTGCTTGAAAGCTTGCTGGGCCTTGGCCCCCTCGCTGAAGAACAGA
CCGCAGCTCTTCCCGCTGAACTGGTTATTCCCGCACCCGGCATCATGGACGCAGC
AGCGCGCGTCATGGCTGGTCAGTTGCACCACACTCCGGCCCCAGCGGTTCTGGG
TCACCTTGGCCTTGCTGGGCTGCTCCTTCAGCGCGCGCTGCCCGTTCTCGCTGGT
CACATCCATCTCCACCACGTGGTCCTTGTGGATCATCACCGTTCCATGCAGACAC
TTGAGCTGGCCTTCCACCTCGGTGCAGCCGTGATCCCACAGGGCGCAGCCGGTG
CACTCCCAGTTCTTGTGCGCGATCCCGCTGTGGCTAAAGATGTAACCTTGCAACA
GGCGACCCATGACGGTGCTAAATGCTTTCTGGGTGGTGAAGGTCAGTTGCATCC
CGCGGGCCTCCTCGTTCATCCAGGTCTGGCACATCTTTTGGAAGATTTCGGTCTG
CTCTGGCATGAGCTTGTAAGCATCGCGCAGGCCGCTGTCGACGCGGTAGCGTTC
CATCAACACGTTCATGGCATCCATGCCCTTCTCCCAGGACGAGACCAGAGGCAG
ACTTAGGGGGTTGCGCACGTTCAGGACACCGGGGGTCGCGGGCTCGACGATGCG
TTTTCCGTCCTTGCCTTCCTTCAACAGAACCGGCGGCTGGCTGAATCCCACTCCC
ACGATCACGGCGTCTTCCTGGGGCATCTCTTCGTCGGGGTCTACCTTGGTCACAT
GCTTGGTCTTTCTGGCTTGCTTCTTTTTTGGAGGGCTGTCCACGGGGACCACGTCC
TCCTCGGAAGACCCCGAGCCCACCCGCTGATACTTTCGGCGCTTGGTGGGCAGA
GGAGGCGGCGGCGAGGGGCTCCTCTCCTGCTCCGGCGGATAGCGCGCTGAACCG
TGGCCCCGGGGCGGAGTGGCCTCTCGGTCCATGAACCGGCGCACGTCCTGACTG
CCGCCGGCCATTGTTTCCTAGGGGAAGATGGAGGAGCAGCCGCGTAAGCAGGAG
CAGGAGGAGGACTTAACCACCCACGAGCAACCCAAAATCGAGCAGGACCTGGG
CTTCGAAGAGCCGGCTCGTCTAGAACCCCCACAGGATGAACAGGAGCACGAGCA
AGACGCAGGCCAGGAGGAGACCGACGCTGGGCTCGAGCATGGCTACCTGGGAG
GAGAGGAGGATGTGCTGCTGAAACACCTGCAGCGCCAGTCCCTCATCCTCCGGG
ACGCCCTGGCCGACCGGAGTGAAACCCCCCTCAGCGTCGAGGAGCTGTGTCGGG
CCTACGAGCTCAACCTCTTCTCGCCGCGCGTGCCCCCCAAACGCCAGCCCAACG
GCACATGTGAGCCCAACCCGCGTCTCAACTTCTATCCCGTTTTCGCGGTCCCCGA
GGCCCTTGCCACCTATCACATCTTTTTCAAGAACAAAAGATCCCCGTCTCCTGC
CGCGCCAACCGCACCCGCGCCGACGCGCTCCTCGCTCTGGGGCCCGGCGCACGC
ATACCTGATATCGCTTCCCTGGAAGAGGTGCCCAAGATCTTCGAAGGGCTCGGT
CGGGACGAGACGCGCGGCGAACGCTCTGAAAGAAACAGCAGAAGAAGAGGG
TCACACTAGCGCCCTGGTAGAGTTGGAAGGCGACAACGCCAGGCTAGCCGTGCT
CAAGCGCAGCGTCGAGCTCACCCACTTCGCCTACCCCGCCGTCAACCTCCCGCCA
AAGGTCATGCGTCGCATCATGGATCAGCTCATCATGCCCCACATCGAGGCCCTC
GATGAAAGTCAGGAGCAGCGCCCCGAGGACGCCCGGCCCGTGGTCAGCGACGA
GCAGCTCGCGCGCTGGCTCGGGACCCGCGACCACCAGACCCTGGAGCAGCGGCG
CAAACTCATGCTGGCCGTGGTCCTGGTCACCCTAGAGCTGGAATGCATGCGCCG
CTTCTTCAGCGACCCCGAGACCCTGCGCAAGGTCGAGGAGACCCTGCACTACAC
TTTCAGGCACGGTTTCGTCAGGCAGGCATGCAAGATTTCCAACGTGGAGCTGAC
CAACCTGGTCTCCTGCCTGGGAATCCTGCACGAGAACGCCTGGGGCAGACCGT
GCTCCACTCGACCCTGAAGGGCGAGGCGCGGCGAGACTATGTCCGCGACTGCGT
CTTTCTATTTCTCTGCCACACATGGCAAGCAGCCATGGGCGTGTGGCAGCAGTGT
CTCGAGGATGAGAACCTGAAGGAGCTGGACAAGCTTCTTGCTAGAAACCTTAAA
AAGCTGTGGACGGGCTTCGACGAGCGCACCGTCGCCTCGGACCTGGCCGAGATC
GTCTTCCCCGAGCGCCTGAGGCAGACGCTGAAAGGCGGGCTGCCCGACTTCATG
AGCCAGAGCATGTTGCAAAACTACCGCACTTTCATTCTCGAGCGATCTGGGATG
CTACCCGCCACCTGCAACGCTTTCCCCTCCGACTTTGTCCCACTGAGCTACCGCG
```

TABLE 7-continued

Nucleic Acid Sequences of Vectors

SEQ ID NO Sequence

```
AGTGTCCCCGCCGCTGTGGAGCCACTGCTATCTCTTGCAGCTGGCCAACTACAT
TGCCTACCACTCGGACGTGATCGAGGACGTGAGCGGCGAGGGCTGCTCGAGTG
CCACTGCCGCTGCAACCTGTGCTCCCCGCACCGCTCCCTGGTCTGCAATCCCCAG
CTCCTAAGCGAGACCCAGGTCATTGGTACCTTCGAGCTGCAAGGTCCGCAGGAG
TCCACCGCTCCGCTGAAACTCACGCCGGGGTTGTGGACTTCCGCGTACCTGCGCA
AATTTGTACCCGAGGACTACCACGCCCATGAGATAAAATTCTTCGAGGACCAAT
CGCGGCCGCAGCACGCGGATCTCACGGCCTGCGTCATCACCCAGGGCGCGATCC
TCGCCCAATTGCACGCCATCCAAAAATCCCGCCAAGAGTTTCTTCTGAAAAAGG
GTAGAGGGGTCTACCTGGACCCCCAGACGGGCGAGGTGCTCAACCCGGGTCTCC
CCCAGCATGCCGAGGAAGAAGCAGGAACCGCTAGTGGAGGAGATGGAAGAAGA
ATGGGACAGCCAGGCAGAGGAGGACGAATGGGAGGAGGAGACAGAGGAGGAA
GAATTGGAAGAGGTGGAAGAGGAGCAGGCAACAGAGCAGCCCGTCGCCGCACC
ATCCGCGCCGGCAGCCCCGCCGGTCACGGATACAACCTCCGCTCCGGTCAAGCC
TCCTCGTAGATGGGATCGAGTGAAGGGTGACGGTAAGCACGAGCGGCAGGGCT
ACCGATCATGGAGGGCCCACAAAGCCGCGATCATCGCCTGCTTGCAAGACTGCG
GGGGGAACATCGCTTTCGCCCGCCGCTACCTGCTCTTCCACCGCGGGGTGAACAT
CCCCCGCAACGTGTTGCATTACTACCGTCACCTTCACAGCTAAGAAAAAGCAAG
TAAGAGGAGTCGCCGGAGGAGGAGGAGGCCTGAGGATCGCGGCGAACGAGCCC
TTGACCACCAGGGAGCTGAGGAACCGGATCTTCCCCACTCTTTATGCCATTTTTC
AGCAGAGTCGAGGTCAGCAGCAAGAGCTCAAAGTAAAAAACCGGTCTCTGCGCT
CGCTCACCCGCAGTTGCTTGTACCACAAAAACGAAGATCAGCTGCAGCGCACTC
TCGAAGACGCCGAGGCTCTGTTCCACAAGTACTGCGCGCTCACTCTTAAAGACT
AAGGCGCGCCCACCCGGAAAAAAGGCGGGAATTACCTCATCGCCACCATGAGC
AAGGAGATTCCCACCCCTTACATGTGGAGCTATCAGCCCCAGATGGGCCTGGCC
GCGGGCGCCTCCCAGGACTACTCCACCCGCATGAACTGGCTCAGTGCCGGCCCC
TCGATGATCTCACGGGTCAACGGGGTCCGTAGCCATCGAAACCAGATATTGTTG
GAGCAGGCGGCGGTCACCTCCACGCCCAGGGCAAAGCTCAACCCGCGTAATTGG
CCCTCCACCCTGGTGTATCAGGAAATCCCCGGGCCGACTACCGTACTACTTCCGC
GTGACGCACTGGCCGAAGTCCGCATGACTAACTCAGGTGTCCAGCTGGCCGGCG
GCGCTTCCCGGTGCCCGCTCCGCCCACAATCGGGTATAAAAACCCTGGTGATCC
GAGGCAGAGGCACACAGCTCAACGACGAGTTGGTGAGCTCTTCGATCGGTCTGC
GACCGGACGGAGTGTTCCAACTAGCCGGAGCCGGGAGATCGTCCTTCACTCCCA
ACCAGGCCTACCTGACCTTGCAGAGCAGCTCTTCGGGAGCCTCGCTCCGGAGGCA
TCGGAACCCTCCAGTTCGTGGAGGAGTTTGTGCCCTCGGTCTACTTCAACCCCTT
CTCGGGATCGCCAGGCCTCTACCCGGACGAGTTCATACCGAACTTCGACGCAGT
GAGAGAAGCGGTGGACGGCTACGACTGAATGTCCATGGTGACTCGGCTGAGCT
CGCTCGGTTGAGGCATCTGGACCACTGCCGCCGCCTGCGCTGCTTCGCCCGGGA
GAGCTGCGGACTCATCTATTTTGAGTTTCCCGAGGAGCACCCCAACGGCCCTGCA
CACGGAGTGCGGATCACCGTAGAGGGCACCACCGAGTCTCACCTGGTCAGGTTC
TTCACCCAGCAACCATTCCTGGTCGAGCGGGACCGGGCGCCACCACCTACACC
GTCTACTGCATCTGTCCTACCCCGAAGTTGCATGAGAATTTTTGCTGTACTCTTTG
TGCTGAGTTTAATAAAAGCTGAAATAAGAATCTTCTCTGGACCTTGTCATCGACC
TCGGAATCGCACCGTCTTACTCACCAACCAGACCAAGGTTCGTCTTAACTGTGCA
ACCAACAGGAAGTACCTTCTTTGGTCCTTCCAAAACACCTCACTCGCTGTTGTCA
ACGCCCGTGACGACGACGGTGTTTTAATCCCAAACAACCTCACCAGTGGACTTA
CTTTCTCTACCAACAAAACAAAGCTCATCCTTCACCACCCTTTTGTAGAGGGAAC
CTACCAGTGCCGACACGGACCTTGTGTTCACAACTTCCATTTGGTGAACCTTACC
AGCAGCAGTACAGTTGCTCCTGAAACAACTAACCTTTCTTCTGATACTAACAAAC
CTCGTGTCGGAGGTGAGCTTTGGGTTCCCTCTCTAACAGAGGGTGGGAAACATA
TTGAAGTGGTTGGGTATTTGATTTTAGGGGCGGTCCTGGGTGGGTGCATAGCAGT
GCTATATCAACTTCCTTGCTGGGTCGAAATCAAAATCTTTATCTGCTGGGTCAGA
CATTGTGGGGAGGAACCATGAAGGGGCTCTTGTTGATTATCCTTTCCCTGGTTGG
GGGTGTACTGTCATGCCACGAACAGCCACGATGTAACATCACCACAGGCAATGA
GAGAAGCGAATGCTCTATAGTGATCAAATGTGAGCACAAATGTTCTCTCAACAT
CACATTCAAGAATAAGACCATGGGAAATGTATGGGTGGGATTCTGGCAACCAGG
AGATGAGCAGAACTACACGGTCACTGTCCATGGTAGCGATGGAAATCACACTTT
CGGTTTCAAATTCATTTTTGAAGTCATGTGTGATATCACACTGCATGTGGCTAGA
CTTCATGGCTTGTGGCCCCTACCAAGGAGAACATGGTGGGTTTTTCTTTGGCTT
TTGTGATCATGGCCTGCTTTATGTCAGGTCTGCTGGTAGGGGCTCTAGTGTGGTT
CCTGAAGCGCAAGCCCAGGTACGGAAATGAGGAGAAGGAAAAATTGCTATAAA
TCTTTTTCTTTTCGCAGAACCATGAATACAGTGATCCGTATCGTGCTGCTCTCTCT
TCTTGTAGCTTTTAGTCAGGGAAAAACAGAACGTAAAAATATCACTGTTGAATG
GGGAAAGGATGTAATACTAGTCGGACCACAAGATCTGCCAGTTAATTGGCACGG
GCCTAGAAATGAACTTTGTAAGGGAACTGAAACTCTTCATAGGCAGCTTAGTCA
TAAGTGTGATGGGCAGAATTTAACACTTATAAGAGTTAATAACACTTTTCAGGGT
ACATATTATGGTTTTAGAAAAGATGGAACTGGAATGAACCAATATACAGTTAAA
GTTTATGCACCAAAGGCCTATACTCGCAAACCATTGCCAAAAACAATACAATAT
GATGTATACAAAGGCCAAAATATTACACTAACAGGACCTCCATATGATCATGTC
GATTGGTATGGTCCGACTCACCAACTTTGTAATGGTGATGAGACTTTACATCCAG
AAATTAATCACACATGCACTAAACAAAACCTAACGCTTACATTTGTAAATTCGA
CTTACTGGGGCGCCTATTATGGAATAAACAAAGATGGAGATGACAGAACAAGTT
ATGAGGTTACTGTGTTAGATGGTTATGAAAATGCAGGGCAACATAAAGATGAAG
ACCCAGAAATTGAAAACTCTAGAGAGCAGACTAAACCAAAAACAAAAAGCAAA
AGTGCCCAAAAGACAAACAAGCATAGGCCAGACAAGCAGCTCAAAAAAGATAT
TGAAAAAGATTTCGCTAGCGGAACCAATCAAACTTTAGTGGGTCCACCAGGTTC
AAAAACTGAATGGTATAATGGAAAACTTGACAAACTGTGCGGTGGAAAGACTG
```

TABLE 7-continued

Nucleic Acid Sequences of Vectors

| SEQ ID NO | Sequence |
|---|---|
| | GTTTAAAGATTTTGTGTAATGATCAGAACATTACATTGATCAATGTAAATGAAAC<br>ATATGCAGGAACCTATTATGGTTCTAACAAAGATGACCATAGGCAGTACAGAGT<br>TACTGTTTATACAAGACCACGTAATGAAACTGTGAGAATTCAACCATACACCAC<br>TAAGGGAACTACAAAAACAACCTTAGGTAATCACAGCTTTGAACTGCAATTGGG<br>AAATGGCGAATCAGAAGATGATCAAAAACAAATTCCATCTACTACTGTGGCAAT<br>CGTGGTGGGTGTGATTGCGGGCTTCATAACTATAATCATTGTCATTCTGTGCTAC<br>ATCTGCTGCCGCAAGCGTCCCAGGTCATACAATCATATGGTAGACCCACTACTCA<br>GCTTCTCTTACTGAAACTCAGTCACTCTCATTTCAGAACCATGAAGGCTTTCACA<br>GCTTGCGTTCTGATTAGCATAGTCACACTTAGTTTAGCTGCTAAGAGAGAACAAT<br>ACCATAGTTACAATGTTACTAGAAATGGATTTATAACGTTAAATGTAACAATTGA<br>AAATACAACATGGACGCGTTATCATCAAGATGGATGGAAACAAATTTGTTTGTG<br>GAAAGATCCATCTTACACATGTCACACAAATAATGGAAGCATTACTATTCATGC<br>CTTCAATATTACTTCTGGACAATATAGAGCTGAAAGCTACACTTACTGGTATAAA<br>TATTATGGTAATCATAAACATGAAATTCATATTTTTAACATAACTGTGATTGAGC<br>ATCCTACAACAAAAGCGCCAACCACTGCTAATACAGCCACATTAACCACACAGC<br>CTACTACTAGGAAAACAACTACACAGTCAACTACTAGGGAGACAACGCGGCCAA<br>CCACACATCAAACCACCCACAGCCAGTACAACTGCTGAGACCACTACTCATACTA<br>CACAGCTAGACACTACAGTGCAGAATAGTACTGTGTTGGTTAGGTTTTTGTTGAG<br>GGAGGAAAGTACTACTGAACAGACAGAGGCTACCTCAAGTGCCTTCAGCAGCAC<br>TGCAAATTTAACTTCGCTTGCTTCAATAAATGAGACCCTCGTGCCGATGAAACAG<br>GATCAACCTAATTACTCAGGTTTGGATATGCAAATTACTTTCTTAATTGTCTGTG<br>GGGTCTTTATTCTTGTGGTTCTTCTTTACTTTGTCTTTTGCAAAGCCAGACAAAAA<br>TCTCATAGAACAATCTACAGGCCAGTGATCGGGGAACCCCAGCCACTCCAAGTG<br>GATGGAGGCTTAAGAAATCTTCTCTTCTCTTTTACAGTATGGTGATCAGCCATGA<br>TTCCTAGGTTTTTCCTATTTAACATCCTCTTCTGTCTCTTCAACATCTGCGCTGCA<br>TTCGCGGCCGTCTCGCACGCCTCGCCCGACTGTCTCGGGCCCTTCCCAACCTACC<br>TCCTCTTTGCCCTGCTCACCTGCACCTGCGTCTGCAGCATTGTCTGCGTGGTTATC<br>ACCTTCCTGCAGCTCATCGACTGGTGCTGCGCGCGCTACAATTACATACAGCACA<br>GTCCCGAATACAGGGACGAGAACGTAGCCAGAATATTAAGGCTCATCTGACCAT<br>GCAGACTCTGCTCATACTGTTATCCCTCCTATCCCCTGCCCTCGCTACTAAAGAC<br>TATTCTCAATGTAAATTTGCGGACATATGGAATTTCTTAGAATGCTATGATGCGA<br>AAATTGATATGCCCTCCTATTACTTGGTGATTGTTGGGGTAGTCATGGTCTGCTC<br>ATGCACTTTCTTTGCCATTATGATCTACCCCTGTTTTGATCTCGGCTGGAACTCTG<br>TTGAAGCATTCACATACACACTAGAAAGCAGTTCACTAGCCTCCACGCCACCAC<br>CCACACCGCCTACCCGCAGAAATCAGTTTCCCCTGATTCAGTACTTAGAAGAGCC<br>CCCTCCCCGGCCCCCTTCCACTGTTAGCTACTTTCACATAACCGGCGGCGATGAC<br>TGACCACCACCTGGACCTCGAGATGGACGGCCAGGCCTCCGAGCAGCGCATCCT<br>GCAACTGCGCGTCCGTCAGCAGCAGGAGCGGGCCGCCAAGGAGCTCCTCGATGC<br>CATCAACATCCACCAGTGCAAGAAGGGCATCTTCTGCCTGGTCAAACAGGCAAA<br>GATCACCTACGAGCTCGTGTCCGGCGGCAAGCAGCATCGCCTCGCCTATGAGCT<br>GCCCCAGCAGAAGCAGAAGTTCACCTGCATGGTGGGCGTCAACCCCATAGTCAT<br>CACCCAGCAGTCGGGCGAGACCAACGGCTGCATCCACTGCTCCTGCGAAAGCCC<br>CGAGTGCATCTACTCCCTCCTCAAGACCCTTTGCGGACTCCGCGACCTCCTCCCC<br>ATGAACTGATGTTGATTAAAAGCCCAGAAACCAATCAGCCCCTTCCCCATCCCC<br>AATTACTCATAAGAATAAATCAATGGAATTAATCATTCAATAAAGATCACTTACT<br>TGAAATCTGAAAGTATGTCTCTGGTGTAGTTGTTTAGCAGCACCTCAGTACCCTC<br>CTCCCAGCTCTGGTACTCCAATCCCCGGCGGGCGGCGAACTTCCTCCACACCTTG<br>AAAGGGATGTCAAATTCCTGGTCCACAATTTTCATTGTCTTCCCTCTCAGATGTC<br>AAAGAGGCTCCGGGTGGAAGATGACTTCAACCCCGTCTACCCCTATGGCTACGC<br>GCGGAATCAGAATATCCCCTTCCTCACTCCCCCCTTTGTCTCCTCCGATGGATTCC<br>AAAACTTCCCCCCTGGTGTCCTGTCGCTCAAACTGGCTAACCCAATCACCATTGC<br>CAATGGAAATGTTTCACTTAAGGTGGGAGGGGGACTTACTTTGCAAGATGTAAC<br>TGGAGACCTAACAGTCAATGCTAAGACACCCTTGCAAGTTGCAGATGATAAAAA<br>ACTTGAGCTTGCTTACGGTGAGCCTTTTGAAATAAAGAATGGCAAACTTGCAAT<br>AAAAACAGGTCATGGATTAAAGGTTATAAATGAAGAAATTTCAACATTACCAGG<br>TTTGGCAGGACACCTTGTAGTTTTAACTGGAGTTGGAATTGGCACTGAGACACTT<br>AAAGACAAAGACGATAAAGTAATTGGATCTGCTGTAAATGTAAGACTTGGAAAA<br>GATGGTGGTCTTGATTTTAATAAAAAAGGAGACTTGGTTGCCTGGAACAGAGAT<br>AATGACAGGCGTACTCTTTGGACCACTCCAGATCCATCTCCAAATTGCAAGGTCA<br>GCGAAGCAAAGGATTCTAAACTAACTTTAGTATTAACCAAGTGTGGAAGTCAGA<br>TTTTAGCTAGTGTTGCACTGCTTATTGTTAAAGGAAAATACCAAACAATAAGCGA<br>ATCAACCATACCAAAAAACGAAAGAAACTTTAGCATTAAGCTGATGTTTGATGA<br>CAAAGGAAAGCTTCTTAACACGTCCAGTCTGGATAAGGAATATTGGAACTTCAG<br>AAGCAATGACAGTGTTGTTGGAACTGCTTATGATAATGCAGTACCATTTATGCCT<br>AATCTAAAGCATATCCAAAAAATACTACAACGTCTTCCACAAATCCAGATGAT<br>AAAATAAGTGCTGGGAAAAGAACATTGTGTCAAATGTGTATCTTGAAGGAAGG<br>GTATATCAGCCAGTGGCTTTACTGTAAAATTTAACAGTGAAAATGATTGTGCTT<br>ATTCCATTACATTTGACTTTGTTTGGAGCAAGACATATGAATCTCCTGTGGCATT<br>TGATAGCTCCTCATTTACCTTCTCATATATTGCCCAAGAAAACAAAGACACGGAC<br>GAATAAAGTGTTTTAAAAAGAATTATGTATCTTTATTGATTTTTACACCAGCAC<br>GGGTAGTCAGTCTCCCACCACCAGCCCATTTCACAGTATAAACAATTCTTTCGC<br>ACGGGTGGCCTTAAATAGGGGAATGTTCTGATTAGTGCGGGAACTGAACTTGGG<br>GTCTATAATCCACACAGTTTCCTGGCGAGCCAAACGGGGTCGGTAATTGAGAT<br>GAAGCCGTCCTCTGAAAAGTCATCCAAGCGGGCCTCACAGTCCAAGGTCACAGT<br>CTGGTGGAATGAGAAGAACGCACAGATTCATACTCGGAAAACAGGATGGGTCTG<br>TGCCTCTCCATCAGCGCCCTCAACAGTCTCTGCCGCCGGGGCTCGGTGCGGCTGC |

TABLE 7-continued

Nucleic Acid Sequences of Vectors

| SEQ ID NO | Sequence |
|---|---|
| | TGCAGATGGGATCGGGATCACAAGTCTCTCTGACTATGATCCCCACAGCCTTCAG<br>CATCAGTCTCCTGGTGCGTCGGGCACAGCACCGCATCCTGATCTCTGCCATGTTC<br>TCACAGTAAGTGCAGCACATAATCACCATGTTATTCAGCAGCCCATAATTCAGG<br>GTGCTCCAGCCAAAGCTCATGTTGGGAATGATGGAACCCACGTGACCATCGTAC<br>CAGATGCGGCAGTATATCAGGTGCCTGCCCCTCATGAACACACTGCCCATATAC<br>ATGATCTCTTTGGGCATGTTTCT |
| SEQ ID NO: 1431 | ATAATATACCCCACAAAGTAAACAAAAGTTAATATGCAAATGAGCTTTTGAATT<br>TTAACGGTTTTGGGGCGGAGCCAACGCTGATTGGTCGAAAGAAGACGATGCAAA<br>TGACGTCACGACGCACGGCCGACGGTCGCCGCGGAGGCGTGGCCTAGCCCGGAA<br>GCAAGTCGCGGGCTGATGACGTATAAAAAAGCGGACTTTAGACCCGGAAACG<br>GCCGATTTTCCCGCGGCCACGCCCGGATATGAGGTAATTCTAGGCGGATGCAAG<br>TGAAATTAGGTCATTTTGGCGCGAAAACTGAATGAGGAAGTGAAAAGTGAAAA<br>ATACCGGGCCCGCCCAGGGCGGAATATTTACCGAGGGCCGAGAGACTTTGACCG<br>ATTACGTGGGGGTTTCGATTGCGGTGTTTTTTTCGCGAATTTCCGCGTCCGTGTCA<br>AAGTCCGGTGTTTATGTCACAGATCAGCTGATCCACAGGGTATTTAAACCAGCC<br>GAGCCCGTCAAGAGGCCACTCTTGAGTGCCAGCGAGTAGAGATTTCTCTGAGCT<br>CCGCTCCCAGAGACCGAGAAAAATGAGACACCTGCGCCTCCTGCCTGGAACTGT<br>GCCTATGGACATGGCCGCATTATTGCTGCAGGACTTTGTGGATACAGTATTGGAG<br>GACGAACTGCAACCAACTCCGTTCGAGCTGGGACCCACACTTCAGGACCTATAT<br>GATCTGGAGGTAGATGCCCAGGATGACGACCCGAACGAAGAGGCTGTGAATTTA<br>ATATTTCCAGAATCTCTGATTCTTCAGGCTGACATAGCCAGCGAAGCTGTACCTA<br>CACCCACTTCATACACCGACTCTGTCGCCCATACCTGAATTGGAAGAGGAGGACG<br>AACTAGACCTCCGGTGTTATGAGGAAGGTTTTCCTCCCAGCGATTCAGAGGACG<br>AACGGGGTGAGCAGAGTATGGCTATAATCTCAGACTATGCTTGTGTGGTTGTGG<br>AAGAGCATTTTGTGTTGGACAATCCTGAGGTGCCAGGGCAAGGATGTAGATCCT<br>GCCAATATCACCGGGATCAGACCGGAGACCCAAATGCTTCCTGCGCTCTGTGTT<br>ACATGAAATGAGCTTCAGCTTTATTTACAGTAAGTGGAGTGAATGTGAGAGAG<br>GCTGAGTGCTTAACACATCATTGTGTATCGCTTGAACAGCTGTGCTAAGTGTGGT<br>TTATTTTTGTTACTAGGTCCGGTGTCAGAGGATGAGTCATCACCCTCAGAAGAAG<br>ACCACCCGTCTCCCCCTGAGCTGTCAGGCGAAACGCCCCTGCAAGTGCACAGAC<br>CCACCCCAGTCAGAGCTAGTGGCGAGAGGCGAGCAGCTGTTGACAAAATTGAGG<br>ACTTGTTACATGACATGGGTGGGGATGAACCTTTGGACCTGAGCTTGAAACGCC<br>CCAGGAATTAGGCGCAGCTGCGCTTAGTCATGTGTAAATAAAGTTGTACAATAA<br>AAGTGTATGTGACGCATGCAAGGTGTGGTTTATGACTCATGGGCGGGCTTAGT<br>CCTATATAAGTGCCAACACCTGGGCACTTGGGCACAGACCTTCAGGGAGTTCCT<br>GATGGATGTGTGGACTATCCTTGCAGACTTTAGCAAGACACGCCGGCTTGTAGA<br>GGATAGTTCAGACGGGTGCTCCGGGTTCTGGAGACACTGGTTTGGAACTCCTCTA<br>TCTCGCCTGGTGTACACAGTTAAGAAGGATTATAAAGAGGAATTTGAAAATCTT<br>TTTGCTGACTGCTCTGGCCTGCTAGATTCTCTGAATCTTGGTCACCAGTCCCTTTT<br>CCAGGAAAGGGTACTCCACAGCCTTGATTTTTCCAGCCCAGGGCGCACTACAGC<br>CGGGGTTGCTTTTGTGGTTTTTCTGGTTGACAAATGGAGCCAGGACACCCAACTG<br>AGCAGGGGCTACATCCTGGACTTCGCAGCCATGCACCTGTGGAGGGCCTGGATC<br>AGGCAGCGGGACAGAGAATCTTGAACTACTGGCTTCTACAGCCAGCAGCTCCG<br>GGTCTTCTTCGTCTACACAGACAAACATCCATGTTGGAGGAAGAAATGAGGCAG<br>GCCATGGACGAGAACCCGAGGAGCGGCCTGGACCCTCCGTCGGAAGAGGAGCT<br>GGATTGAATCAGGTAGCCAGCCTGTACCCAGAGCTTAGCAAGGTGCTGACATCC<br>ATGGCCAGGGGAGTGAAGAGGGAGAGGAGCGATGGGGCAATACCGGGATGAT<br>GACCGAGCTGACTGCCAGTCTGATGAATCGCAAGCGCCCAGAGCGCCTTACCTG<br>GTACGAGCTTCAGCAGGAGTGCAGGGATGAGATAGGCCTGATGCAGGATAAAT<br>ATGGCCTGGAGCAGATAAAAACCCATTGGTTGAACCCAGATGAGGATTGGGAGG<br>AGGCCATTAAGAAGTATGCCAAGATAGCCCTGCGCCCAGATTGCAAGTACATGG<br>TGACCAAGACCGTGAATATCAGACATGCTTGCTACATCTCGGGGAACGGGGCAG<br>AGGTGGTCATCGATACACTGGACAAGGCCGCCTTCAGGTGTTGCATGATGGGAA<br>TGAGAGCCGGAGTGATGAATATGAATTCCATGATCTTCATGAACATGAAGTTCA<br>ATGGAGAGAAGTTTAATGGGGTGCTGTTCATGGCCAACAGTCACATGACCCTGC<br>ATGGCTGCAGTTTCTTTGGCTTCAACAATATGTGTGCAGAGGTTTGGGGCGCTTC<br>CAAGATCAGGGGATGTAAGTTTTATGGCTGCTGGATGGGCGTGGTCGGAAGACC<br>CAAGAGCGAGATGTCTGTGAAGCAGTGTGTGTTTGAGAAATGCTACCTGGGAGT<br>CTCTACCGAGGGCAATGCTAGAGTGAGACACTGCTCTTCCCTGGAGACGGGCTG<br>CTTCTGCCTGGTGAAGGGCACGGCCTCTCTGAAGCATAATATGGTGAAGGGCTG<br>CACGGATGAGCGCATGTACAACATGCTGACCTGCGACTCGGGGGTCTGTCATAT<br>CCTGAAGAACATCCATGTGACCTCCCACCCCAGAAAGAAGTGCCAGTGTTTGA<br>GAATAACCTGCTGATCAAGTGCCATATGCACCTGGGTGCCAGAAGGGGCACCTT<br>CCAGCCGTACCAGTGCAACTTTAGCCAGACCAAGCTGCTGTTGGAGAACGATGC<br>CTTCTCCAGGGTGAACCTGAACGGCATCTTTGACATGGATGTCTCGGTGTACAAG<br>ATCCTGAGATATGATGAGACCAAGTCCAGGGTGCGCGCTTGCGAGTGCGGGGC<br>AGACATACCAGGATGCAGCCAGTGGCCCTGGATGTGACCGAGGAGCTGAGACC<br>AGACCACCTGGTGATGCCTGTACCGGGACCGAGTTTAGCTCCAGTGGGGAGGA<br>CACAGATTAGAGGTAGGTTTTTGAGTAGTGGGCGTGGCTAATGTGAGTATAAAG<br>GTGGGTGTCTTACGAGGGTCTTTTGCTTTTCTGCAGACATCATGAACGGGACCGG<br>CGGGGCTTTCGAAGGGGGGCTTTTTAGCCCTTATTTGACAACCCGCTGCCGGA<br>TGGGCCGGAGTTCGTCAGAATGTGATGGGATCTACGGTGGATGGCGTCCAGTG<br>CTTCCAGCAAATTCCTCGACCATGACCTACGCGACCGTGGGGAGCTCGTCACTCG<br>ACAGCACCGCCGCAGCCGCGGCAGCCGCAGCCGCCATGACAGCGACGAGACTG<br>GCCTCGAGCTACATGCCCAGCAGCGGCAGCAGCCCCTCCGTGCCCAGTTCCATC |

TABLE 7-continued

Nucleic Acid Sequences of Vectors

SEQ ID NO Sequence

```
ATCGCCGAGGAGAAACTGCTGGCCCTGCTGGCCGAGCTGGAAGCCCTGAGTCGC
CAGCTGGCCGCCCTGACCCAGCAGGTGTCCGATCTCCGCGAGCAACAGCAGCAG
CAAAATAAATGATTCAATAAACACAGATTCTGATTCAAACAGCAAAGCATCTTT
ATTATTTATTTTTTCGCGCGCGGTAGGCCCTGGTCCACCTCTCCCGATCATTGAG
AGTGCGGTGGATTTTTTCCAGGACCCGGTAGAGGTGGGATTGGATGTTGAGGTA
CATGGGCATGAGCCCGTCCCGGGGATGGAGGTAGCACCACTGCATGGCCTCGTG
CTCTGGGGTCGTGTTGTAGATGATCCAGTCATAGCAGGGGCGCTGGGCGTGGTG
CTGGATGATGTCCTTGAGGAGGAGACTGATGGCCACGGGGAGCCCCTTGGTGTA
GGTGTTGGCGAAGCGGTTGAGCTGGGAGGGATGCATGCGGGGGGAGATGATGT
GGAGTTTGGCCTGGATCTTCAGGTTGGCAATGTTGCCGCCCAGATCCCGCCTGGG
GTTCATGTTGTGCAGGACCACCAGGACGGTGTAGCCCGTGCACTTGGGGAACTT
ATCATGCAACTTGGAAGGGAATGCGTGGAAGAATTTGGAGACGCCTTTGTGCCC
GCCCAGGTTTTCCATGCACTCATCCATGATGATGGCGATGGGCCCGTGGGCTGCG
GCTTTTGGCAAAGACGTTTCTGGGGTCAGAGACATCATAATTATGCTCCTGGGTGA
GATCATCATAAGACATTTTAATGAATTTGGGGCGGAGGGTGCCAGATTGGGGGA
CGATGGTTCCCTCGGGCCCCGGGGCGAAGTTCCCCTCACATATTTGCATCTCCCA
GGCTTTCATCTCGGAGGGGGGAATCATGTCCACCTGCGGGGCGATGAAAAAAAC
GGTTTCCGGGGCGGGGGTGATGAGCTGCGAGGAGAGCAGGTTTTCTCAACAGCTG
GGACTTGCCGCACCCGGTCGGGCCGTAGATGACCCCGATGACGGGTTGCAGGTG
GTAGTTCAAGGACATGCAGCTGCCGTCGTCCCGGAGGAGGGGGCCACCTCGTT
GAGCATGTCTCTGACTTGGAGGTTTTCCCGGACGAGCTCGCCGAGGAGGCGGTC
TCCGCCCAGCGAGAGCAGCTCTTGCAGGGAAGCAAAGTTTTTCAGGGGCTTGAG
CCCGTCGGCCATGGGCATCTTGGCGAGGGTCTGCGAGAGGAGCTCCAGGCGGTC
CCAGAGCTCGGTGACGTGCTCTACGGCATCTCGATCCAGCAGACTTCCTCGTTTC
GGGGGTTGGGACGACTGCGACTGTAGGGCACGAGACGATGGGCGTCCAGCGCG
GCCAGCGTCATGTCCTTCCAGGGTCTCAGGGTCCGCGTGAGGGTTGTCTCCGTCA
CGGTGAAGGGGTGGGCCCCGGGTTGGGCGCTTGCAAGGGTGCGCTTGAGACTCA
TCCTGCTGGTGCTGAAACGGGCACGGTCTTCGCCCTGCGCGTCGGCGAGATAGC
AGTTGACCATGAGCTCGTAGTTGAGGGCCTCGGCGGCGTGGCCCTTGGCGCGGA
GCTTGCCCTTGGAAGAGCGCCCGCAGGCGGGACAGAGGAGGGATTGCAGGGCG
TAGAGCTTGGGCGCGAGAAAGACGGACTCGGGAGCGAAAGCGTCCGCTCCGCA
GTGGGCGCAGACTGTCTCGCACTCGACGAGCCAGGTGAGCTCGGGCTGCTCGGG
GTCAAAAACCAGTTTTCCCCCGTTCTTTTTGATGCGCTTCTTACCTCGCGTCTCCA
TGAGTCTGTGTCCGCGCTCGGTGACAAACAGGCTGTCGGTGTCCCCGTAGACGG
ACTTGATTGGCCTGTCCTGCAGGAGCGTCCCGCGGTCCTCCTCGTAGAGAAACTC
GGACCACTCTGAGACAAAGGCGCGCGTCCACGCCAAGACAAAGGAGGCCACGT
GCGAGGGGTAGCGGTCGTTGTCCACCAGGGGGTCCACCTTTTCCACCGTGTGCA
GACACATGTCCCCCTCCTCCGCATCCAAGAAGGTGATTGGCTTGTAGGTGTAGGC
CACGTGACCGGGGGTTCCCGACGGGGGGGTATAAAAGGGGGCGGGTCTGTGCTC
GTCCTCACTCTCTTCCGCGTCGCTGTCCACGAGCGCCAGCTGTTGGGGTAGGTAT
TCCCTCTCGAGAGCGGGCATGACCTCGGCACTCAGGTTGTCAGTTTCTAGAAACG
AGGAGGATTTGATGTTGGCTTGCCCTGCCGCGATGCTTTTTAGGAGACTTTCATC
CATCTGGTCAGAAAAGACTATTTTTTATTGTCAAGCTTGGTGGCGAAGGAGCCA
TAGAGGGCGTTGGAGAGAAGCTTGGCGATGGATCTCATGGTCTGATTTTTGTCAC
GGTCGGCGCGCTCCTTGGCCGCGATGTTTAGCTGGACATACTCGCGCGCGACGC
ACTTCCATTCGGGGAAGACGGCGGTGCGCTCGTCGGGCACGATCCTGACGCGCC
AGCCGCGGTTATGCAGGGTGACCAGGTCCACGCTGGTGGCCACCTCGCCGCGCA
GGGGCTCGTTGGTCCAGCAGAGTCTGCCGCCCTTGCGCGAGCAGAAAGGGGGCA
ACACATCAAGCAGATGCTCGTCAGGGGGGTCCGCATCGATGGTGAAGATGCCCG
GACAGAGTTCCTTGTCAAAATAGTCTATTTTTGAGGATGCATCATCCAAGGCCAT
CTGCCACTCGCGGGCGGCCAGCGCTCGCTCGTAGGGGTTGAGGGGCGGACCCCA
GGGCATGGGATGCGTGAGGGCGGAGGCATACATGCCGCAGATGTCATACACATA
GATGGGCTCTGAGAGGATGCCGATGTAGGTGGGATAACAGCGCCCCCCGCGGAT
GCTGGCGCGCACGTAGTCATACAACTCGTGCGAGGGGGCCAAGAAGGCGGGC
CGAGATTGGTGCGCTGGGGCTGCTCGGCGCGAAGACGATCTGGCGAAAGATGG
CGTGCGAGTTGGAGGAGATGGTGGGCGTTGGAAGATGTTAAAGTGGGCGTGGG
GCAAGCGGACCGAGTCGCGGATGAAGTGCGCGTAGGAGTCTTGCAGCTTGGCGA
CGAGCTCGGCGGTGACGAGGACGTCCATGGCGCAGTAGTCCAGCGTTTCTCGGA
TGATGTCATAACCCGCCTCTCCTTTCTTCTCCCACAGCTCGCGGTTGAGGGCATA
CTCCTCGTCATCCTTCCAGTACTCCCGGAGCGGGAATCCTCGATCGTCCGCACGG
TAAGAGCCCAGCATGTAGAAATGGTTCACGGCCTTGTAGGGACAGCAGCCCTTC
TCCACGGGGAGGGCGTAAGCTTGAGCGGCCTTGCGGAGCGAGGTGTGAGTCAGG
GCGAAGGTGTCCCTGACCATGACTTTCAAGAACTGGTACTTGAAGTCCGAGTCG
TCGCAGCCGCCGTGCTCCCAGAGCTCGAAATCGGTGCGCTTCTTTGAGAGGGGG
TTAGGCAGAGCGAAAGTGACGTCATTGAAGAGAATCTTGCCTGCCCGCGGCATG
AAATTGCGGGTGATGCGGAAAGGGCCCGGGACGGAGGCTCGGTTGTTGATGACC
TGGGCGGCGAGGACGATCTCGTCGAAGCCGTTGATGTTGTGCCCGACGATGTAG
AGTTCCATGAATCGCGGGCGGCCTTTGATGTGCGGCAGCTTTTTGAGCTCCTCGT
AGGTGAGGTCCTCGGGACATTGCAGGCCGTGCTGCTCAGCGCCCACTCCTGGA
GATGTGGGTTGGCTTGCATGAAGGAAGCCCAGAGCTCGCGGGCCATGAGGGTCT
GGAGCTCGTCGCGAAAGAGGCGGAACTGCTGGCCCACGGCCATCTTTTCTGGGG
TGACGCAGTAGAAGGTGAGGGGGTCCCGCTCCCAGCGATCCCAGCGTAAGCGCA
CGGCGAGATCGCGAGCGAGGGCGACCAGCTCGGGGTCTCCCGAGAATTTCATGA
CCAGCATGAAGGGGACGAGCTGCTTGCCGAAGGACCCCATCCAGGTGTAGGTTT
CTACATCGTAGGTGACAAAGAGCCGCTCCGTGCGAGGATGAGAGCCGATTGGGA
AGAACTGGATTTCCTGCCACCAGTTGGACGAGTGGCTGTTGATGTGATGAAAGT
```

TABLE 7-continued

Nucleic Acid Sequences of Vectors

SEQ ID NO Sequence

```
AGAAATCCCGCCGGCGAACCGAGCACTCGTGCTGATGCTTGTAAAAGCGTCCGC
AGTACTCGCAGCGCTGCACGGGCTGTACCTCATCCACGAGATACACAGCGCGTC
CCTTGAGGAGGAACTTCAGGAGTGGCGGCCCTGGCTGGTGGTTTTCATGTTCGCC
TGCGTGGGACTCACCCTGGGGCTCCTCGAGGACGGAGAGGCTGACGAGCCCGCG
CGGGAGCCAGGTCCAGATCTCGGCGCGGCGGGGGCGGAGAGCGAAGACGAGGG
CACGCAGTTGGGAGCTGTCCATGGTGTCGCGGAGATCCAGGTCCGGGGGCAGGG
TTCTGAGGTTGACCTCGTAGAGGCGGGTGAGGGCGTGCTTGAGATGCAGATGGT
ACTTGATCTCCACTGGGGAGTTGGTGGCCGTGTCCACGCATTGCATGAGCCCGTA
GCTGCGCGGGGCCACGACCGTGCCGCGGTGCGCTTTTAGAAGCGGTGTCGCGGA
CGCGCTCCCGGCGGCAGCGGCGGTTCCGGCCCCGCGGGCAGGGGCGGCAGAGG
CACGTCGGCGTGGCGCTCGGGCAGGTCCCGGTGCTGCGCCCTGAGAGCGCTGGC
GTGCGCGACGACGCGGCGGTTGACATCCTGGATCTGCCGCCTCTGCGTGAAGAC
CACGGGCCCCGTGACTTTGAACCTGAAAGACAGTTCAACAGAATCAATCTCGGC
GTCATTGACGGCGGCCTGACGCAGGATCTCTTGCACGTCGCCCGAGTTGTCCTGG
TAGGCGATCTCGGACATGAACTGCTCGATCTCCTCCTCCTGGAGATCGCCGCGGC
CCGCGCGTTCGACGGTGGCGGCGAGGTCATTCGAGATGCGACCCATGAGCTGCG
AGAAGGCGCCCAGGCCGCTCTCGTTCCAGACGCGGCTGTAGACCACGTCCCCGT
CGGCGTCGCGCGCTCGCATGACCACCTGCGCGAGGTTGAGCTCCACGTGCCGCG
TGAAGACAGCGTAGTTGCGCAGGCGCTGGAAGAGGTAGTTGAGGGTGGTGGCG
ATGTGCTCGGTGACGAAGAAGTACATGATCCAGCGGCGCAGGGGCATTTCGCTG
ATGTCGCCGATGGCCTCCAGCCTTTCCATGGCCTCGTAGAAGTCCACGGCGAAGT
TGAAAAACTGGGCATTGCGGGCCGAGACCGTGAGCTCGTCTTCCAGGAGCCTGA
TGAGCTCGGCGATGGTGGCGCGCACCTCGCGCTCGAAATCCCCGGGGGCCTCCT
CCTCTTCCTCTTCTTCCATGACGACCTCTTCTTCTATTTCTTCCTCTGGGGCGGT
GGTGGTGGCGGGGCCCGACGACGACGGCGACGCACCGGGAGACGGTCGACGAA
GCGCTCGATCATCTCCCCGCGGCGGCGGACGCATGGTTTCGGTGACGGCGCGACC
CCGTTCGCGAGGACGCAGCGTGAAGACGCCGCCGGTCATCTCCCGGTAATGGGG
CGGGTCCCCGTTGGGCAGCGATAGGGCGCTGACGATGCATCTTATCAATTGCGG
TGTAGGGGACGTGAACGCGTCGAGATCGACAGGATCGGAGAATCTTTCGAGGAA
AGCGTCTAGCCAATCGCAGTCGCAAGGTAAGCTCAAACACGTAGCAGCCCTGTG
GACGCTGTTAGAATTGCGGTTGCTGATGATGTAATTGAAGTAGGCGTTTTTAAGG
CGGCGGATGGTGGCGAGGAGGACCAGGTCCTTGGGTCCCGCTTGCTGGATGCGG
AGCCGCTCGGCCATGCCCCAGGCCTGGCCCTGACACCGGCTCAGGTTCTTGTAGT
AGTCATGCATGAGCCTCTCGATGTCATTATTGGCGGAGGCGGAGTCTTCCATGCG
GGTGACCCCGACGCCCTGAGCGGCTGCACGAGCGCCAGGTCGGCGACGACGCG
TTCGGCGAGGATGGCCTGTTGCACGCGGGTGAGGGTGTCCTGGAAGTCGTCCAT
GTCGACGAAGCGGTGGTAGGCCCCGGTGTTGATGGTGTAGGTGCAGTTGGCCAT
GAGCGACCAGTTAACGGTCTGCAGGCCGGGCTGCACGACCTCGGAGTACCTGAG
CCGCGAGAAGGCGCGCGAGTCGAAGACGTAGTCGTTGCAGGTGCGCACGAGGT
ATTGGTAGCCGACTAGGAAGTGCGGCGGCGGCTGGCGGTAGAGCGGCCAGCGCT
GGGTGGCCGGCGCGCCCGGGCCAGGTCCTCTAGCATGAGGCGGTGGTAGCCGT
AGAGGTAGCGGGACATCCAGGTGATGCCGGCGGCGGTGGTGGAGGCGCGCGGG
AACTCGCGGACGCGGTTCCAGATGTTGCGCAGCGGCAGGAAATAGTCCATGGTC
GGCACGGTCTGGCCGGTGAGACGCGCGCAGTCATTGACGCTCTAGAGGCAAAAA
CGAAAGCGGTTGAGCGGGCTCTTCCTCCGTAGCCTGGCGGAACGCAAACGGGTT
AGGCCGCGTGTGTACCCCGGTTCGAGTCCCCTCGAATCAGGCTGGAGCCGCGAC
TAACGTGGTATTGGCACTCCCGTCTCGACCCGAGCCCGATAGCCGCCAGGATAC
GGCGGAGAGCCCTTTTTGCCGGCCGAGGGGTGTCGCTAGACTTGAAAGCGGCCG
AAAACCCTGCCGGGTAGTGGCTCGCGCCCGTAGTCTGGAGAAGCATCGCCAGGG
TTGAGTCGCGGCAGAACCCGGTTCGCGGACGGCCGCGGCGAGCGGGACTTGGTC
ACCCCGCCGATTTAAAGACCCACAGCCAGCCGACTTCTCCAGTTACGGGAGCGA
GCCCCCTTTTTTCTTTTTGCCAGATGCATCCCGTCCTGCGCCAAATGCGTCCCACC
CCCCCGGCGACCACCGCGACCGCGGCCGTAGCAGGCGCCGGCGCTAGCCAGCCA
CAGACAGAGATGGACTTGGAAGAGGGCGAAGGGCTGGCGAGACTGGGGGCGCC
GTCCCCGGAGCGACACCCCCGCGTGCAGCTGCAGAAGGACGTGCGCCCGGCGTA
CGTGCCTGCGCAGAACCTGTTCAGGGACCGCAGCGGGGAGGAGCCCGAGGAGA
TGCGCGACTGCCGATTTCGGGCGGGCAGGGAGCTGCGCGAGGGCCTGGACCGCC
AGCCGCGTGCTGCGCGACGAGGATTTCGAGCCGAACGAGCAGACGGGGATCAGC
CCCGCGCGCGCACGTGGCGGCGGCCAACCTGGTGACGGCCTACGAGCAGACG
GTGAAGCAGGAGCGCAACTTCCAAAAGAGTTTCAACAACCACGTGCGCACCCTG
ATCGCGCGCGAGGAGGTGGCCCTGGGCCTGATGCACCTGTGGGACCTGGCGGAG
GCCATCGTGCAGAACCCGGACAGCAAGCCTCTGACGCGCAGCTGTTCCTGGTG
GTGCAGCACAGCAGGGACAACGAGGCGTTCAGGGAGGCGCTGCTGAACATCGC
CGAGCCCGAGGGTCGCTGGCTGCTGGAGCTGATCAACATCTTGCAGAGCATCGT
AGTGCAGGAGCGCAGCCTGAGCCTGGCCGAGAAAGTGGCGGCGATCAACTACTC
GGTGCTGAGCCTGGGCAAGTTTTACGCGCGCAAGATTTACAAGACGCCGTACGT
GCCCATAGACAAGGAGGTGAAGATAGACAGCTTTTACATGCGCATGGCGCTCAA
GGTGCTGACGCTAAGCGACGACCTGGGCGTGTACCGCAACGACCGCATCCACAA
GGCCGTGAGCACGAGCCGGCGGCGCGAGCTGAGCGACCGCGAGCTGATGCTGA
GCCTGCGCCGGGCGCTGGTAGGGGCGCCGCCGGCGGCGAGGAGTCCTACTTCG
ACATGGGGGCGGACCTGCATTGGCAGCCGAGCCGGCGCGCCTTGGAGGCCGCCT
ACGGGTCCAGAGGACTTGGATGAGGAAGAGGAAGAGGAGGAGGATGCACCCGCT
GCGGGGTACTGACGCCTCCGTGATGTGTTTTTAGATGTCCCAGCAAGCCCCGGAC
CCCGCCATAAGGGCGGCGCTGCAAAGCCAGCCGTCCGGTCTAGCATCGGACGAC
TGGGAGGCCGCGATGCAACGCATCATGGCCCTGACGACCCGCAACCCCGAGTCC
TTTAGACAACAGCCGCAGGCCAACAGACTCTCGGCCATTCTGGAGGCGGTGGTC
```

TABLE 7-continued

Nucleic Acid Sequences of Vectors

SEQ ID NO Sequence

```
CCCTCTCGGACCAACCCCACGCACGAGAAGGTGCTGGCGATCGTGAACGCGCTG
GCGGAGAACAAGGCCATCCGTCCCGACGAGGCCGGGCTGGTGTACAACGCCCTG
CTGGAGCGCGTGGGCCGCTACAACAGCACGAACGTGCAGTCCAACCTGGACCGG
CTGGTGACGGACGTGCGCGAGGCCGTGGCGCAGCGCGAGCGGTTCAAGAACGA
GGGCCTAGGCTCGCTGGTGGCGCTGAACGCCTTCCTGGCGACGCAGCCGGCGAA
CGTGCCGCGCGGGCAGGACGATTACACCAACTTTATCAGCGCGCTGCGGCTGAT
GGTGACCGAGGTGCCCCAGAGCGAGGTGTATCAGTCGGGCCCGGACTACTTTTT
CCAGACGAGCCGGCAGGGCTTGCAGACGGTGAACCTGAGCCAGGCTTTCAAGAA
CCTGCGCGGGCTGTGGGGCGTGCAGGCGCCCGTGGGCGACCGGTCGACGGTGAG
CAGCTTGCTGACGCCCAACTCGCGGCTGCTGCTGCTGATCGCGCCCTTCACC
GACAGCGGCAGCGTGAACCGCAACTCGTACCTGGGTCACCTGCTGACGCTGTAC
CGCGAGGCCATAGGCCAGGCGCAGGTGGACGAGCAGACCTTCCAGGAGATCAC
TAGCGTAAGCCGCGCGCTGGGGCAGAACGACACCGACAGTCTGAGGGCCACCCT
GAACTTTTTGCTGACCAATAGACAGCAGAAGATCCCGGCACAGTACGCGCTGTC
GGCCGAGGAGGAAAGGATCCTGAGATATGTGCAGCAGAGCGTAGGGCTGTTCCT
GATGCAGGAGGGTGCCACCCCCAGCGCCGCGCTGGACATGACCGCGCGCAACAT
GGAACCTAGCATGTACGCCGCCAACCGGCCGTTTATCAATAAGCTGATGGACTA
CCTGCACCGCGCGGCGGCCATGAACACGGACTACTTTACAAACGCCATCCTGAA
CCCGCACTGGCTCCCGCCGCCTGGGTTCTACACGGGCGAGTACGACATGCCCGA
CCCCAACGACGGGTTCCTGTGGGACGACGTGGACAGCGCGGTGTTCTCGCCGAC
TTTTCAAAAGCGCCAGGAGGCGCCGCCGAGCGAGGGCGCGGTGGGGAGGAGCC
CTTTTCCTAGCTTAGGGAGTTTGCATAGCTTGCCGGGCTCGGTGAACAGCGGCAG
GGTGAGCCGGCCGCGCTTGCTGGGTGAGGACGAGTACCTGAACGACTCGCTGCT
GCAGCCGCCGCGGGCCAAGAACGCCATGGCCAATAACGGGATAGAGAGTCTGG
TGGACAAACTGAACCGCTGGAAGACCTACGCTCAGGACCATAGGGACGCGCCCG
CGCCGCGGCGACAGCGCCACGACCGGCAGCGGGGCCTGGTGTGGGACGACGAG
GACTCGGCCGACGATAGCAGCGTGTTGGACTTGGGCGGGAGCGGTGGGGCCAAC
CCGTTCGCGCATCTGCAGCCCAAACTGGGGCGACGGATGTTTTGAAATGCAAAA
TAAAACTCACCAAGGCCATAGCGTGCGTTCTCTTCCTTGTTAGAGATGAGGCGCG
CGGTGGTGTCTTCCTCTCCTCCTCCCTCGTACGAGAGCGTGATGGCGCAGGCGAC
CCTGGAGGTTCCGTTTGTGCCTCCGCGGTATATGGCTCCTACGGAGGGCAGAAA
CAGCATTCGTTACTCGGAGCTGGCTCCGCAGTACGACACCACTCGCGTGTACTTG
GTGGACAACAAGTCGGCGGACATCGCTTCCCTGAACTACCAAAACGACCACAGC
AACTTCCTGACCACGGTGGTGCAGAACAACGATTTCACCCCCGCCGAGGCCAGC
ACGCAGACGATAAATTTTGACGAGCGGTCGCGGTGGGGCGGTGATCTGAAGACC
ATTCTGCACACCAACATGCCCAATGTGAACGAGTACATGTTCACCAGCAAGTTT
AAGGCGCGGGTGATGGTGGCTAGGAAACATCCAGAGAATGTAGCTAAAGATGA
TTTGAGTCAGGATAAGCTTGAGTATGAGTGGTTTGAGTTTACCCTGCCCGAGGGC
AACTTTTCCGAGACCATGACCATAGACCTGATGAACAACGCCATCTTGGAAAAC
TACTTGCAAGTGGGGCGGCAAAATGGCGTGCTGGAGAGCGATATCGGAGTCAAG
TTTGACAGCAGGAATTTCAAGCTGGGCTGGGACCCGGTGACCAAGCTGGTGATG
CCGGGGGTCTACACCTACGAGGCCTTCCACCCGGACGTGGTGCTGCTGCCGGGC
TGCGGGGTGGACTTCACCGAGAGCCGCCTGAGCAACCTCCTGGGCATTCGCAAG
AAGCAACCTTTCCAAGAGGGCTTCAGGATCATGTATGAGGATTTAGAAGGGGGC
AACATCCCCGCACTCCTTGATGTGGCCAAGTACTTGGAAAGCAAGAAGAAGGTA
GAGGAAGCAATTAAGAAGGCCGCTGAAACCAATGGAACCCCCTAGAGGAGACAG
TGATGTTGCAAGAGAGGTGGAAAAGGCAGCTCAAACTCAGCTTGTCATTGAGCC
CATCAAGCAAGATGATAGCAAGAGAAGTTACAACCTCATCGAGGGAACCATGG
ACACGCTGTACCGCAGCTGGTACCTGTCCTATACCTACGGGGACCCCGAGAAGG
GGGTGCAGTCGTGGACGCTGCTCACCACCCCGGACGTCACCTGCGGCGCGGAGC
AAGTCTACTGGTCGCTGCCGGACCTCATGCAAGACCCCGTCACCTTCCGCTCTAC
CCAGCAAGTCAGCAACTACCCCGTGGTCGGCGCCGAGCTCATGCCCTTCCGCGC
CAAGAGCTTTTACAACGACCTCGCCGTCTACTCCCAGCTCATCCGCAGCTACACC
TCCCTCACCCACGTCTTCAACCGCTTCCCCGACAACCAGATCCTCTGCCGCCCGC
CCGCGCCCACCATCACCACCGTCAGTGAAAACGTGCCTGCTCTCACAGATCACG
GGACGCTACCGCTGCGCAGCAGTATCCGCGGAGTCCAGCGAGTGACCGTCACTG
ACGCCCGTCGCCGCACCTGTCCCTACGTCTACAAGGCCCTGGGCATAGTCGCGCC
GCGCGTGCTTTCCAGTCGCACCTTCTAAAAAATGTCTATTCTCATCTCGCCCAGC
AATAACACCGGCTGGGGTCTTACTAGGCCCAGCACCATGTACGGAGGAGCCAAG
AAGCGCTCCCAGCAGCACCCCGTCCGCGTCCGCGGCCACTTCCGCGCTCCCTGG
GGCGCATACAAGCGCGGCCGGACTTCCGCCGCCGCCGTGCGCACCACCGTCGAC
GATGTCATCGACTCGGTGGTCGCCGACGCGCGCAACTACACCCCCGCCCCTCC
ACCGTGGACGCGGTCATCGACAGCGTGGTGGCCGACGCGCGCGACTATGCCAGA
CGCAAGAGCCGGCGGCGACGGATCGCCAGGCGCCACCGGAGCACGCCCGCCAT
GCGCGCCGCCCGGGCTCTGCTGCGCCGCGCCAGACGCACGGGCCGCGGGCCAT
GATGCGAGCCGCGCGCCGCGCTGCCACTGCACCCACCCCCGCAGGCAGGACTCG
CAGACGAGCGGCCGCCGCCGCCGCCGGCCATTTCTAGCATGACCAGACCCAG
GCGCGGAAACGTGTACTGGGTGCGCGACTCCGTCACGGGCGCGCGCGTGCCCGT
GCGCACCCGTCCTCCTCGTCCCTGATCTAATGCTTGTGTCCTCCCCGCAAGCGA
CGATGTCAAAGCGCAAAATCAAGGAGGAGATGCTCCAGGTCGTCGCCCCGGAG
ATTTACGGACCCACCCCAGGCGGACCAGAAACCCCGCAAAATCAAGCGGGTTAAA
AAAAAGGATGAGGTGGACGAGGGGGCAGTAGAGTTTGTGCGCGAGTTCGCTCC
GCGGCGGCGCGTAAATTGGAAGGGGCGCAGGGTGCAGCGCGTGTTGCGGCCCG
GCACGGCGGTGGTGTTCACGCCCGGCGAGCGGTCCTCGGTCAGGAGCAAGCGTA
GCTATGACGAGGTGTACGGCGACGACGACATCCTGGACCAGGCGGCGGAGCGG
GCGGGCGAGTTCGCCTACGGGAAGCGGTCGCGCGAAGAGGAGCTGATCTCGCTG
```

TABLE 7-continued

Nucleic Acid Sequences of Vectors

SEQ ID NO Sequence

```
CCGCTGGACGAGAGCAACCCCACGCCGAGCCTGAAGCCCGTGACCCTGCAGCAG
GTGCTGCCCCAGGCGGTGCTGCTGCCGAGCCGCGGGGTCAAGCGCGAGGGCGAG
AGCATGTACCCGACCATGCAGATCATGGTGCCCAAGCGCCGGCGCGTGGAGGAC
GTGCTGGACACCGTGAAAATGGATGTGGAGCCCGAGGTCAAGGTGCGCCCCATC
AAGCAGGTGGCGCCGGGCCTGGGCGTGCAAACCGTGGACATTCAGATCCCCACC
GACATGGATGTCGACAAAAAACCCTCGACCAGCATCGAGGTGCAGACCGACCCC
TGGCTCCCAGCCTCCACCGCTACCGCCTCCACTTCTACCGCCGCCACGGCTACCG
AGCCTCCCAGAAGGCGAAGATGGGGCGCCGCCAGCCGGCTGATGCCCAACTACG
TGTTGCATCCTTCCATCATCCCGACGCCGGGCTACCGCGGCACCCGGTACTACGC
CAGCCGCCGGCGCCCAGCCGCCAAACGCCGCCGCCGCACCGCCACCCGCCGCCG
TCTGGCCCCCGCCCGCGTGCGCCGCGTGACCACGCGCCGGGGCCGCTCGCTCGTT
CTGCCCACCGTGCGCTACCACCCCAGCATCCTTTAATCCGTGTGCTGTGATACTG
TTGCAGAGAGATGGCTCTCACTTGCCGCCTGCGCATCCCCGTCCGAATTACCGA
GGAAGATCCCGCCGCAGGAGAGGCATGGCAGGCAGCGGCCTGAACCGCCGCCG
GCGGCGGGCCATGCGCAGGCGCCTGAGTGGTGGCTTTCTGCCCGCGCTCATCCC
CATAATCGCCGCGGCCATCGGCACGATCCCGGGCATAGCTTCCGTTGCGCTGCA
GGCGTCGCAGCGCCGTTGATGTGCGAATAAAGCCTCTTTAGACTCTGACACACCT
GGTCCTGTATATTTTTAGAATGGAAGACATCAATTTTGCGTCCCTGGCTCCGCGG
CACGGCACGCGCCGTTCATGGGCACCTGGAACGAGATCGGCACCAGCCAGCTG
AACGGGGGCGCCTTCAATTGGAGCAGTGTCTGGAGCGGGCTTAAAAATTTCGGC
TCGACGCTCCGGACCTATGGGAACAAGGCCTGGAATAGTAGCACGGGGCAGTTG
TTAAGGGAAAAACTCAAAGACCAGAACTTCCAGCAGAAGGTGGTGGACGGGCT
GGCCTCGGGCATTAACGGGGTGGTGGACATCGCGAACCAGGCCGTGCAGCGCGA
GATAAACAGCCGCCTGGACCCGCGGCCGCCCACGGTGGTGGAGATGGAAGATG
CAACTCTTCCGCCGCCCAAGGGCGAGAAGCGGCCGCGGCCCGACGCGGAGGAG
ACGATCCTGCAGGTGGACGAGCCGCCCTCGTACGAGGAGGCCGTTAAGGCCGGC
ATGCCCACCACGCGCATCATCGCGCCGCTGGCCACGGGTGTAATGAAACCCGCC
ACCCTTGACCTGCCTCCACCACCCACGCCCGCTCCACCGAAGGCAGCTCCGGTCG
TGCAGGCCCCCCGGTGGCGACCGCCGTGCGCCGCGTCCCCGCCCGCCGCCAGG
CCCAGAACTGGCAGAGCACGCTGCACAGTATCGTGGGCCTGGGAGTGAAAAGTC
TGAAGCGCCGCCGATGCTATTGAGAGAGGAAAGAGGACACTAAAGGGAGAGCT
TAACTTGTATGTGCCTTACCGCCAGAGAACGCGCGAAGATGGCCACCCCCTCGA
TGATGCCGCAGTGGGCGTACATGCACATCGCCGGGCAGGACGCCTCGGAGTACC
TGAGCCCCGGTCTGGTGCAGTTTGCCCGTGCCACCGACACGTACTTCAGCCTGGG
CAACAAGTTTAGGAACCCCACGGTGGCTCCCACCCACGATGTGACCACGGACCG
GTCCCAGCGTCTGACGCTGCGCTTCGTGCCCGTGGATCGCGAGGACACCACGTA
CTCGTACAAGGCGCGCTTCACTCTGGCCGTGGGCGACAACCGGGTGCTAGACAT
GGCCAGCACGTACTTTGACATCCGCGGCGTCCTGGACCGCGGTCCCAGCTTCAA
ACCCTATTCGGGCACGGCCTACAACAGCCTGGCTCCCAAGAGCGCTCCCAATCC
CAGCCAGTGGGATGCAAAGGAAAAGGAAGGAGTTGCCCAAACAGAAAAAAATG
TTTTAAAAACATTTGGTGTTGCCGCTACAGGTGGTTTTAATATTACAGATCAGGG
TCTGTTACTTGGAACTGAGGAAACAGCTGAAAACGTTAAAAAGGATATCTATGC
AGAGAAAACTTTCCAGCCTGAACCTCAAGTTGGTGAAGAAAACTGGCAGGAAA
GTGAAGCCTTTTATGGAGGAAGGGCTATTAAGAAAGACACCAAATGAAGCCAT
GCTATGGTTCATTTGCCAGACCCACTAATGAAAAGGAGGACAGGCTAAATTTA
AAACACTAGATGGGCAAGTTACAAAAGATCCAGATATTGACTTTGCTTACTTTG
ACGTCCCTGGCGGAAAAGCTCCAACAGGCAGTAGTCTGCCGGAAGAATACAAA
GCAGATATAATTTTGTACACAGAAAATGTTAATCTGGAAACACCAGATACTCAC
ATAGTGTATAAACCTGGCAAAGAAGATGACAATTCTGAAATTAACTTAACACAA
CAGTCCATGCCAAACAGACCCAACTACATTGGCTTCAGGGACAACTTTGTAGGT
CTCATGTACTACAACAGTACTGGCAACATGGGTGTGCTGGCTGGTCAGGCCTCTC
AGTTGAATGCTGTGGTGGACTTGCAAGACAGAAACACCGAGCTGTCTTACCAGC
TCTTGCTAGATTCTCTGGGTGACAGAACCAGATACTTTAGCATGTGGAACTCTGC
GGTTGACAGTTATGATCCCGATGTCAGGATCATTGAAAATCACGGTGTGGAAGA
TGAACTTCCAAACTACTGCTTCCCATTGAATGGCACTGGAACCAATTCCACTTAC
CAAGGTGTAAAGGTTCAAGATGGTCAAGATGGGGATAAAGAAACTGAGTGGGA
AAAAGACGATGCAATTTCTAGACAAAACCAAATCTGCAAGGGCAATGTCTACGC
CATGGAGATCAACCTCCAGGCCAACCTGTGGAAGAGTTTTCTGTACTCGAACGT
GGCCCTGTACCTGCCCGACTCCTACAAGTACACTCCGGCCAACGTCACGCTGCCC
ACCAACACCAACACCTACGAGTACATGAACGGCCGCGTGGTAGCCCCCTCACTG
GTGGACGCCTACATCAACATCGGCGCCCGCTGGTCGCTGGATCCCATGGACAAC
GTTAACCCCTTCAACCACCACCGCAACGCGGGCCTGCGCTACCGCTCCATGCTTC
TGGGCAACGGTCGCTACGTGCCCTTCCACATCCAAGTGCCCCAAAAGTTCTTTGC
CATCAAGAACCTGCTTCTGCTCCCCGGCTCCTACACCTACGAGTGGAACTTCCGC
AAGGACGTCAACATGATCCTGCAGAGTTCCCTCGGCAACGACCTGCGCGTCGAC
GGCGCCTCCGTCCGCTTCGACAGCGTCAACCTCTACGCCACCTTCTTCCCCATGG
CGCACAACACCGCCTCCACCCTGGAAGCCATGCTGCGCAACGACACCAACGACC
AGTCCTTCAACGACTACCTCTCGGCCGCCAACATGCTCTACCCCATCCCGGCCAA
GGCCACCAACGTGCCCATCTCCATCCCATCACGCAACTGGGCCGCCTTCCGCGGC
TGGAGTTTCACCAGGCTAAAGACCAAGGAAACTCCCTCCCTCGGCTCGGGTTTC
GACCCCTACTTTGTCTACTCGGGCTCCATCCCCTACCTCGACGGGACCTTCTACC
TCAACCACACCTTCAAGAAGGTCTCCATCATGTTCGACTCCTCGGTCAGCTGGCC
CGGCAACGACCGGCTGCTCACGCCGAACGAGTTCGAGATCAAGCGCAGCGTCGA
CGGGGAGGGCTACAACGTGGCCCAATGCAACATGACCAAGGACTGGTTCCTCGT
CCAGATGCTCTCCCACTACAACATCGGCTACCAGGGCTTCCACGTGCCCGAGGG
CTACAAGGACCGCATGTACTCCTTCTTCCGCAACTTCCAGCCCATGAGCAGGCAG
```

TABLE 7-continued

Nucleic Acid Sequences of Vectors

| SEQ ID NO | Sequence |
|---|---|
| | GTGGTCGATGAGATCAACTACAAGGACTACAAGGCCGTCACCCTGCCCTTCCAG
CACAACAACTCGGGCTTCACCGGCTACCTAGCACCCACCATGCGCCAGGGGCAG
CCCTACCCCGCCAACTTCCCCTACCCGCTCATTGGCTCTACCGCCGTGCCCTCCG
TCACCCAGAAAAGTTCCTCTGCGACAGGGTCATGTGGCGCATCCCCTTCTCCAG
CAACTTCATGTCCATGGGCGCCCTCACCGACCTGGGTCAGAACATGCTCTACGCC
AACTCGGCCCACGCGCTCGACATGACCTTCGAGGTGGACCCCATGGATGAGCCC
ACCCTCCTCTATCTTCTCTTCGAAGTTTTCGACGTGGTCAGAGTGCACCAGCCGC
ACCGCGGCGTCATCGAGGCCGTCTACCTGCGCACGCCCTTCTCCGCCGGCAACG
CCACCACCTAAGCATGAGCGGCTCCAGCGAACGAGAGCTCGCGGCCATCGTGCG
CGACCTGGGCTGCGGGCCCTACTTTTTGGGCACCCACGACAAGCGCTTCCCGGG
CTTCCTAGCCGGCGACAAGCTGGCCTGTGCCATTGTCAACACGGCCGGCCGCGA
GACCGGAGGCGTGCACTGGCTCGCCTTCGGCTGGAACCCGCGCTCGCGCACCTG
CTACATGTTCGACCCATTCGGGTTCTCGGACCGCCGGCTCAAGCAGATTTACAGC
TTCGAGTACGAGGCCATGCTGCGCCGCAGCGCCCTGGCCTCCTCACCCGACCGG
TGTCTCAGCCTCGAGCAGTCCACCCAGACCGTGCAGGGGCCCGACTCTGCCGCC
TGCGGACTTTTCTGTTGCATGTTCTTGCATGCCTTCGTGCACTGGCCCGACCGAC
CCATGGACGGGAACCCCACCATGAACTTGCTGACGGGGGTGCCCAACGGCATGC
TACAATCGCCACAGGTGCTGCCCACCCTCCGGCGCAACCAGGAGGAGCTCTACC
GCTTCCTCGCGCGCCACTCCCCTTACTTTCGATCCCACCGCGCCGCCATCGAACA
CGCCACCGCTTTTGACAAAATGAAACAACTGCGTGTATCTCAATAAACAGCACT
TTTATTTTACATGCACTGGAGTATATGCAAGTTATTTAAAAGTCGAAGGGGTTCT
CGCGCTCGTCGTTGTGCGCCGCGCTTGGGAGGGCCACGTTGCGGTACTGGAACTT
GGGCTGCCACTTGAACTCGGGGATCACCAGTTTGGGCACTGGGGTCTCGGGGAA
GGTCTCGCTCCACATGCGCCGACTCATCTGCAGGGCGCCCAGTATGTCCGGGGC
GGAGATCTTGAAATCGCAGTTGGGACCGGTGCTCTGCGCGCGCGAGTTGCGGTA
CACGGGGTTGCAGCACTGGAACACCATCAGACTGGGGTGCTTCACACTGGCCAG
CACGCTCTTGTCGCTGATCTGATCCTTGTCCAGGTCCTCGGCGTTGCTCAGGCCG
AACGGGGTCATCTTGCACAGCTGGCGGCCCAGGAAGGGCACGCTCTGAGGCTTG
TGGTTACACTCGCAGTGCACGGGCATCAGCATCATTCCCGCGCCGCGCTGCATAT
TCGGGTAGAGAGCCTTGACAAAGGCCGAGATCTGCTTGAAAGCTTGCTGGGCCT
TGGCCCCCTCGCTAAAGAACAGGCCACAGCTCTTCCCGCTGAACTGGTTATTCCC
GCACCCGGCATCCTGCACGCAGCAGCGCGCGTCATGGCTGGTCAGTTGCACCAC
GCTCCGGCCCCAGCGGTTCTGGGTCACCTTGGCCTTGCTGGGTTGCTCCTTCAAC
GCGCGCTGCCCGTTCTCGCTGGTCACATCCATCTCCACCACGTGGTCCTTGTGGA
TCATCACCGTCCCATGCAGACACTTGAGCTGGCCTTCCACCTCGGTGCAGCCGTG
GTCCCACAGGGCGCATCCGGTGCACTCCCAATTCTTGTGCGCGATTCCGCTGTGG
CTGAAGATGTAACCTTGCAACATGCGGCCCATGATGGTGCTAAATGCTTTCTGGG
TGGTGAAGGTCAGTTGCAGACCGCGGGCCTCCTCGTTCATCCAGGTCTGGCACAT
CTTTTGGAAGATCTCGGTCTGCTCGGGCATGAGCTTGTAGGCATCGCGCAGGCCG
CTGTCGACGCGGTAGCGTTCCATCAGCACGTTCATGGTATCCATGCCCTTCTCCC
ATGACGAGACCAGAGGCAGACTCAGGGGGTTGCGCACGTTCAGGACACCAGGG
GTCGCGGGCTCGACGATGCGTTTTCCGTCCTTGCCTTCCTTCAACAGAACCGGCG
GCTGGCTGAATCCCACTCCCACGATCACGGCGTCTTCCTGGGGCATCTCTTCGTC
GGGGTCTACCTTGGTCACATGCTTGGTCTTCCTGGCTTGCTTCTTTTTTGGAGGGC
TGTCCACGGGGACCACGTCCTCCTCGGAAGACCCGGAGCCCACCCGCTGATACT
TTCGGCGCTTGGTGGGCAGAGGAGGTGGCGGCGAGGGGCTCCTCTCCTGCTCCG
GCGGATAGCGCGCCGACCCGTGGCCCCGGGGCGGAGTGGCCTCTCGCTCCATGA
ACCGGCGCACGTCCTGACTGCCGCCGGCCATTGTTTCCTAGGGGAAGATGGAGG
AGCAGCCGCGTAAGCAGGAGCAGGAGGAGGACTTAACCACCCACGAGCAACCC
AAAATCGAGCAGGACCTGGGCTTCGAAGAGCCGGCTCGTCTAGAACCCCCACAG
GATGAACAGGAGCACGAGCAAGACGCAGGCCAGGAGGAGACCGACGCTGGGCT
CGAGCATGGCTACCTGGGAGGAGAGGAGGATGTGCTGCTGAAACACTTGCAGCG
CCAGTCCCTCATCCTCCGGGACGCCCTGGCCGACCGGAGCGAAACCCCCCTCAG
CGTCGAGGAGCTGTGTCGGGCCTACGAGCTCAACCTCTTTCTCGCCGCGCGTACCC
CCCAAACGCCAGCCCAACGGCACATGCGAGCCCAACCCGCGTCTCAACTTCTAT
CCCGTCTTTGCGGTCCCCGAGGCCCTCGCCACCTATCACATCTTTTTCAAGAACC
AAAAGATCCCCGTCTCCTGTCGCGCCAACCGCACCCGCGCCGACGCGCTCCTCTC
TCTGGGGCCCGGCGCGCGCATACCTGATATCGCTTCCCTGGAAGAGGTGCCCAA
GATCTTCGAAGGGCTCGGTCGGGACGAGACGCGCGCGGCGAACGCTCTGAAAG
AAACAGCAGAGGAAGAGGGTCACACTAGCGCCCTGGTAGAGTTGGAAGGCGAC
AACGCCAGGCTGGCCGTGCTCAAGCGCAGCGTTGAGCTCACCCACTTCGCCTAC
CCCGCCGTCAACCTCCCGCCCAAGGTTATGCGTCGCATCATGGATCAGCTCATCA
TGCCCCACATCGAGGCCCTCGATGAGACGCAAGAGCAGCGCCCGAGGACGCCC
GGCCCGTGGTCAGCGACGAGATGCTCGCTCGCTGGCTCGGGACCCGCGACCCCC
AGGCCCTGGAGCAGCGGCGCAAGCTCATGCTGGCCGTGGTCCTGGTCACCCTCG
AGCTCGAATGCATGCGTCGCTTCTTCAGCGACCCCGAGACCCTGCGCAAGGTCG
AGGAGACGCTGCACTACACTTTCAGGCACGGTTTCGTCAGGCAGGCCTGCAAGA
TCTCCAACGTGGAGCTGACCAACCTGGTCTCCTGCCTGGGGATCCTTCACGAGAA
CCGCCTGGGACAGACCGTGCTCCACTCTACCCTGAAGGGCGAGGCGCGTCGGGA
CTATGTCCGCGACTGCGTCTTTCTCTTTCTGCCACACATGGCAAGCAGCCATG
GGCGTGTGGCAGCAGTGTCTCGAGGACGAGAACCTGAAGGAGCTGGACAAGCTT
CTTGCTAGAAACCTTAAAAAGCTGTGGACGGGCTTCGACGAGCGCACCGTCGCC
TCGGACCTGGCCGAGATCGTCTTCCCCGAGCGCCTGAGGCAGACGCTGAAAGGC
GGGCTGCCCGACTTCATGAGCCAGAGCATGTTGCAAAACTACCGCACTTTCATTC
TCGAGCGATCTGGAATGCTGCCCGCCACCTGCAACGCTTTCCCCTCCGACTTTGT
CCCGCTGAGCTACCGCGAGTGTCCCCCGCCGCTGTGGAGCCACTGCTACCTCTTG TABLE 7-continued Nucleic Acid Sequences of Vectors

| SEQ ID NO | Sequence |
|---|---|
| | CAGCTGGCCAACTACATCTCCTACCACTCGGACGTGATCGAGGACGTGAGCGGC
GAGGGGCTTCTCGAGTGCCACTGCCGCTGCAACCTGTGCTCCCCGCACCGCTCAC
TAGTCTGCAACCCCCAGCTCCTTAGCGAGACCCAGGTCATCGGTACCTTCGAGCT
GCAAGGTCCGCAGGAGTCCACCGCTCCGCTGAAACTCACGCCGGGGTTGTGGAC
TTCCGCGTACCTGCGCAAATTTGTACCCGAGGACTACCACGCCCATGAGATAAA
GTTCTTCGAGGACCAATCGCGGCCGCAGCACGCGGATCTCACGGCCTGCGTCAT
CACCCAGGGCGCGATCCTCGCCCAATTGCACGCCATCCAAAAATCCCGCCAAGA
GTTTCTTCTGAAAAAGGGTAGAGGGGTCTACCTGGACCCCCAGACGGGCGAGGT
GCTCAACCCGGGTCTCCCCCAGCATGCCGAGGAAGAAGCAGGAGCCGCTAGTGG
AGGAGATGGAAGAAGAATGGGACAGCCAGGCAGAGGAGGACGAATGGGAGGA
GGAGACAGAGGAGGAAGAATTGGAAGAGGTGGAAGAGGAGCAGGCAACAGAG
CAGCCCGTCGCCGCACCATCCGCGCCGGCAGCCCCGGCGGTCACGGATACAACC
TCCGCAGCTCCGGCCAAGCCTCCTCGTAGATGGGATCGAGTGAAGGGTGACGGT
AAGCACGAGCGGCAGGGCTACCGATCATGGAGGGCCCACAAAGCCGCGATCAT
CGCCTGCTTGCAAGACTGCGGGGGAACATCGCTTTCGCCCGCCGCTACCTGCTC
TTCCACCGCGGGGTGAACATCCCCCGCAACGTGTTGCATTACTACCGTCACCTTC
ACAGCTAAGAAAAAGCAAGTAAGAGGGAGTCGCCGGAGGAGGAGGAGGCCTGAG
GATCGCGGCGAACGAGCCCTTGACCACCAGGGAGCTGAGGAACCGGATCTTCCC
CACTCTTTATGCCATTTTTCAGCAGAGTCGAGGTCAGCAGCAAGAGCTCAAAGT
AAAAAACCGGTCTCTGCGCTCGCTCACCCGCAGTTGCTTGTACCACAAAAACGA
AGATCAGCTGCAGCGCACTCTCGAAGACGCCGAGGCTCTGTTCCACAAGTACTG
CGCGCTCACTCTTAAAGACTAAGGCGCGCCCACCCGGAAAAAAGGCGGGAATTA
CCTCATCGCCACCATGAGCAAGGAGATTCCCACCCCTTACATGTGGAGCTATCA
GCCCCAGATGGGCCTGGCCGCGGGCGCCTCCCAGGACTACTCCACCCGCATGAA
CTGGCTCAGTGCCGGCCCCTCGATGATCTCACGGGTCAACGGGGTCCGCAGTCA
TCGAAACCAGATATTGTTGGAGCAGGCGGCGGTCACCTCCACGCCCAGGGCAAA
GCTCAACCCGCGTAATTGGCCCTCCACCCTGGTGTATCAGGAAATCCCCGGGCC
GACTACCGTACTACTTCCGCGTGACGCTCTGGCCGAAGTCCGCATGACTAACTCA
GGTGTCCAGCTGGCTGGCGGCGCTTCCCGGTGCCCGCTCCGCCCACAATCGGGT
ATAAAAACCCTGGTGATCCGAGGCAGAGGCACACAGCTCAACGACGAGTTGGTG
AGCTCTTCGATCGGTCTGCGACCGGACGGAGTGTTCCAACTAGCCGGAGCCGGG
AGATCGTCCTTCACTCCCAACCAGGCCTACCTGACCTTGCAGAGCAGCTCTTCGG
AGCCTCGCTCCGGAGGCATCGGAACCCTCCAGTTCGTGGAGGAGTTTGTGCCCTC
GGTCTACTTCAACCCCTTCTCGGGATCGCCAGGCCTCTACCCGGACGAGTTCATA
CCGAACTTCGACGCAGTGAGAGAAGCGGTGGACGGCTACGACTGAATGTCCCAT
GGTGACTCGGCTGAGCTCGCTCGGTTGAGGCATCTGGACCACTGCCGCCGCCTG
CGCTGCTTCGCCCGGGAGAGCTGCGGACTCATCTACTTTGAGTTTCCCGAGGAGC
ACCCCAACGGCCCTGCACACGGAGTGCGGATCACCGTAGAGGGCACCACCGAGT
CTCACCTGGTCAGGTTCTTCACCCAGCAACCCTTCCTGGTCGAGCGGGACCGGGG
CGCCACCACCTACACCGTCTACTGCATCTGTCCTACCCCGAAGTTGCATGAGAAT
TTTTGCTGTACTCTTTGTGGTGAGTTTAATAAAAGCTGAACTAAGAACCTACTTT
GGAATCCCTTGTCGTCATCCTCGAAACAAGACCGTCTTCTTTACCAACCAGACCA
AGGTCCGTCTGAACTGTACAACCAACAGGAAGTACCTTCTCTGGACTTTCCAAG
ACACCTCACTCGCTGTTGTCAATACCCGTGACAACGACGGTGTTTTAATCCCCAA
CAACCTCACCAGTGGACTTACTTTCTCTACCAACAAAACAAAGCTCATCCTTCAC
CACCCTTTTGTAGAGGGAACCTACCAGTGCCGACACGGACCCTTGTGTTCACAACT
TCCATTTGGTGAACCTTACCAGCAGCAGCACAGTTGCTCCTGAAACTAACCTTTC
TTCTGATACTAACAAACCTCGTGTCGGAGGTGAGCTTTGGGTTCCATCTCTAACA
GAGGGTGGGAATTCTATTGAAGTGGTTGGGTATTTGATTTTAGGGGTGGTCCTTG
GTGGGTGCATAGCAGTGCTGTATCAACTTCCTTGCTGGGTCGAAATCAGGGTATT
TATCTGCTGGGTCAGACATTGTGGGGAGGAACCATGAAGGGGCTCTTGCTGATT
ATCCTTTCCCTGGTGGGGGTGTACTGTCATGCCACGAACAGCCACGATGTAAC
ATCACCACAGGCAATGAGAGGAGTGTGATATGCACAGTAGTCATCAAATGCGAG
CATAAATGTCCTCTCAACATCACATTCAAAAACCGTACCATGGGGAATGCATGG
GTGGGCGACTGGGAACCAGGAGATGAGCAGAACTACACGGTCACTGTCCATGGT
AGCAATGGAAATCACACTTTCGGTTTCAAATTCATTTTTGAAGTCATGTGTGATA
TCACACTACATGTGGCTAGACTTCATGGCTTGTGGCCCCTACCAAGGAGAACAT
GGTGGGTTTTTCTTTGGCTTTTGTGATCATGGCCTGCTTTATGTCAGGTCTGCTGG
TAGGGGCTCTAGTGTGGTTTCTGAAGCGCAAGCCCAGGTATGGAAATGAGGAGA
AGGAAAAATTGCTATAAATCTTTTTCTCTTCGCAGAACCATGAATACTCTGACCA
GTGTCGTGCTGCTCTCTCTTCTTGTGGTTTTTAGTCAGGGAAAAATAGATAGTGA
AGATGTTATTGGTCATTGGGTAAAAATATAACACTAGTTGGACCGACAGAAAA
ACCTATTGAATGGCATGGACCAAGAGTTCAGCTTTGCGATGGTCAAAAATCTT
ACATACAGAATTTAATCACACCTGTAATGAACAGAATCTTACTTTGATATTCTTG
AACAACAGTTTTAATGGAAAATACTATGGTATAAGAAAGGATGGGTTTGGAATG
AAACAGTACAATCTTAAGGTTATTGCTCCAAAAGCTTCCACTCGTAAACCTCTTT
CCCCGCCTAAGCAAATTGATGTCAAAATGGGACAAAATGTAACTCTAGTTGGGC
CAGTAGATACTCCAGTTAATTGGCATGGACCAAAACATGAACTATGCAGAGGAA
ATCAGATAATACATCCAGAAGTTAATCATACATGCAATGAACAAAACCTCACAT
TGCTGTTTGTTAACTACACTTTCTGGGGAGCATATCTTGGCTTTGACAGATATGG
TACTGACAGAGTGCATTATGAGGTTACAATAATAGATGGATTTGAAAATGCAGG
GCAACAAAAATATGATGAGACAAGTCAGCACAAGCCTAGCAATAAAGATAGAC
CAAGTCCAAAAGTAAAAAATCCTCAGAAAACAAAAAACACACAAGACAAAC
ATGCAGAACAAAAAGGATATTGAGAAAGATTTTCCCAGAGGATCTAATCAAACT
CTTGTGGGACCTCCTGGTTCAAAAGTTGACTGGTATGAAGGTAAAATGGTGAC
CTTGTAAAACTCTGTGATGGAAAGTCTGGTTTAAAGGTTTCATGCAATGATCAAA |

TABLE 7-continued

Nucleic Acid Sequences of Vectors

SEQ ID NO Sequence

ACATCACTTTGATTAATGTGAATGAAACCTATGCTGGAACTTATTATGGTTCTAA
CAATGACGACCATAGACAGTATAGAGTCACTGTCTATACAATACCGCGTAATAA
AACTGTTAAAATTCAACCTCATACCACAAAAGGAACCACAGTGGGTGCCACAGT
TAATGAACAGTTTGCTCTGCAACAAGGTAATGATAAAACCAATCAAGATGATGA
ACAAATTCCATCAACTACTGTGGCAATCGTGGTGGGTGTGATTGCGGGCTTCATA
ACTATAATCATTGTCATTCTGTGCTACATCTGCTGCCGCAAGCGTCCCAGGTCAT
ACAATCATATGGTAGACCCACTACTCAGCTTCTCTTACTGAAACTCAGTCACTCT
CATTTCAGAACCATGAAGGCTTTCACAGCTTGCGTTCTGACTAGCTTAGTCACAC
TCATTGCAGCTGCAGGATATACTCAAATTAGCATACCTAGGGGTGGTAGCATTA
CATTAAATGGTACTTTTAGAAATACTACATGGACAAGATATCACACAAATGGTT
GGAAAAAAATTTGTGAATGGAATGTTACAGCTTATAAATGTCACAATAATGGAA
GCATTACTATTACTGCCACAAATATTACTTCTGGCAGATACAAAGCTGACAGTTA
CAAAAAAGAAATTAGAACTTCATTTTTTAGAAATAATAAGACTACATTCGAAGA
TTCTGGAAATTATGAACAGCAGAGATTGACTTTATTTAATCTAACAATAATTGAG
CCGCCAACTACGAAGGCACCCACTACCACTAAACCAACCACAGTTAGGACAACT
AGGGAAACAACCACACAGCCTACCACAGCCAGTACAACTGTTGAGACCACTACT
CACACTACACAGTTAGACACTACAGTACATAATAGTACTGTGATGATAAGGTTTT
TGTTGAGGGAGGAAAGTACTACTGAACAGACAGAGGCTACCTCAAGTGCCTTCA
GCAGCACTGCAAATTTAACTTCGCTTGCTTCAATAAATGAGACCCTCGTGCCGAT
GAAACAGGATCAACCTAATTACTCAGGTTTGGATATGCAAATTACTTTCTTAATT
GTCTGTGGGGTCTTTATTCTTGCGGTTCTTCTTTACTTTGTCTTTTGCAAAGCCAG
ACAAAAATCTCATAGAACAATCTACAGGCCAGTGATTGGGGAACCTCAGCCCCT
CCAAGTGGACGGAGGCTTAAGGAATCTTCTCTTCTCTTTTACAGTATGGTGATCA
GCCATGATTCCTAGGTTCTTCCTATTTAACATCCTCTTCTGTCTCTTCAACATCTG
TGCTGCCTTCGCGGCCGTCTCGCACGCCTCGCCCGACTGTCTCGGGCCCTTCCCA
ACCTACCTCCTCTTTGCCCTGCTAACCTGCACCTGCGTCTGCAGCATTGTCTGCCT
GGTCATCACCTTCCTGCAGCTCATCGACTGGTGCTGCGCGCGCTACAATTACCTA
CACCACAGTCCCGAATACAGGGACGAGAACGTAGCCAGAATCTTAAGGCTCATC
TGACCATGCAGACTCTGCTCATACTGCTATCCCTCCTATACCCTGCCCTTGCTGAT
GATTACTCTAAGTGCAAATTCGCGGACATATGGAATTTCTTAGACTGTTATCAGG
AGAAAATGGATATGCCTTCCTATTACTTGGTGATTGTGGGGATAGTCATGGTCTG
CTCCTGCACTTTCTTTGCCATCATGATCTACCCCTGTTTTGATCTTGGCTGGAACT
CTGTTGAGGCATTCACATACACACTAGAAAGCAGTTCACTAGCCTCCACACCAC
CACCCACACCGCCTCCCCGCAGAAATCAGTTTCCCATGATTCAGTACTTAGAAGA
GCCCCCTCCCCGGCCCCCTTCCACTGTTAGCTACTTTCACATAACCGGCGGCGAT
GACTGACAACCACCTGGACCTCGAGATGGACGGCCAGGCATCCGAGCAGCGCAT
CCTGCAACTGCGCGTCCGTCAGCAGCAGGAGCGGGCCGCCAAGGAGCTCCTCGA
TGCCATCAACATCCACCAGTGCAAGAAGGGCATCTTCTGCCTGGTCAAACAGGC
AAAGATCACCTACGAGCTCGTGTCCGGCGGCAAGCAGCATCGCCTCGCCTATGA
GCTGCCCCAGCAGAAGCAGAAGTTCACCTGCATGGTGGGCATCAACCCCATAGT
CATCACCCAGCAGTCGGGCGAGACCAACGGCTGCATCCACTGCTCCTGCGAAAG
CCCCGAGTGCATCTACTCCCTGCTCAAGACCCTTTGCGGACTACGCGACCTCCTC
CCCATGAACTGATGTTGATTAAAAGCCCAAAAACCAATCAGCCCCTTCCCCCATT
TCCCCATTCCCAATTACTCACAAGAATAAATCATTGGAACTAATCATTCAATAAA
GATCACTTACTTGAAATCTGAAAGTATGTCTCTGGTGTAGTTGTTCAGCAACACC
TCGGTACCCTCCTCCCAGCTCTGGTACTCCAGTCCCCGGCGGGCGGCAAACTTCC
TCCACACCTTGAAAGGGATGTCAAATTCCTGGTCCACAATTTTCATTGTCTTCCC
TCTCAGATGGCAAAGAGGCTCCGGGTGGAAGATGACTTCAACCCCGTCTACCCC
TATGGCTACGCGCGGAATCAGAATATCCCCTTCCTCACTCCCCCCTTTGTCTCCTC
CGATGGATTCAAAAACTTCCCCCCTGGGGTCCTGTCACTCAAATTGGCTGATCCA
ATAGCCATCACCAATGGGGATGTCTCACTCAAGGTGGGAGGTGGACTCACTGTG
GAAAAAGAGTCTGGAAAGCTAAGTGCTGACCCTAAGACTCCCTTGCAAGTTGCA
ACTGACAACAAATTGGAACTTGCTTATAATGCGCCATTTAAAGTTGAAAATGAC
AAGCTATCGCTTGATGTAGGCCATGGATTAAAAGTGATAGGTAATGAAATATCA
AGTTTGCCTGGATTAGTGAATAAGCTTGTTGTTTTAACTGGTAAGGGAATTGGCA
CTGAAGAGTTAAAAGAACAAAACAGCGATAAACTAATAGGAGTTGGAATTAGT
GTAAGAGCAAGAGGAGGTTTGACATTTGACAATGACGGCTACTTAGTAGCTTGG
AATCCAAAGTATGATACACGCACACTTTGGACAACTCCAGACACATCTCCTAATT
GCAAGATGGTCACAAAAAAGGACTCAAAACTTACACTGACACTTACAAAGTGCG
GAAGTCAAATTTTAGGAAATGTATCTTTACTTGCTGTCTCTGGAAAGTATCTAAA
CATGACAAAGGACGAAACAGGAGTTAAGATAATTTTACTATTTGACAAAAATGG
AGTTCTTATGGAGCAATCATCGCTTGATAAAGAATATTGGAACTATAGAAATGA
CAATAATGTCGTTGGAACTCCTTATGAAAATGCTGTTGGATTTATGCCAAACTTA
GTGGCATATCCTAAACCATCAAGTGCAGATGCAAAGAACTATTCAAGAAGCAAG
ATAATAAGTAATGTATACTTAAAGGGTCTTATATATCAACCAGTAATTATAATTG
CCAGTTTTAATCAGGAAACCACTAATGGTTGTGTCTATTCTATTTCATTTGATTTC
ACCTGTTCAAAGGATTACACTGGCCAACAATTTGATGTTACCTCATTCACTTTCT
CCTATATCGCCCAAGAATGAAAGACCAATAAACGTGTTTTTCATTTGAAAATTTT
CATGTATCTTTATTGATTTTTACACCAGCACGGGTAGTCAGTCTCCCACCACCAG
CCCATTTCACAGTGTAAACAATTCTCTCAGCACGGGTAGCCTTAAATAGGGGAA
TGTTCTGATTAGTGCGGGAACTGAACTTGGGGTCTATAATCCACACAGTTTCCTG
GCGAGCCAAACGGGGGTCGGTGATTGAGATGAAGCCGTCCTCTGAAAAGTCATC
CAAGCGGGCCTCGCAGTCCAAGGTCACAGTCTGGTGGAATGAGAAGAACGCAC
AGATTCATACTCGGAAAACAGGATGGGTCTGTGCCTCTCCATCAGCGCCCTCAA
CAGTCTTTGCCGCCGGGGCTCGGTGCGGCTGCTGCAGATGGGATCGGGATCGCA
AGTCTCTCTGACTATGATCCCCACAGCCTTCAGCATCAGTCTCCTGGTGCGTCGG

TABLE 7-continued

Nucleic Acid Sequences of Vectors

| SEQ ID NO | Sequence |
|---|---|
| | GCACAGCACCGCATCCTGATCTCGCTCATGTTCTCACAGTAAGTGCAGCACATAA<br>TCACCATATTATTCAACAGCCCATAATTCAGGGTGCTCCAGCCAAAGCTCATGTT<br>GGGGATGATGGAACCCACGTGACCATCATACCAGATGCGGCAGTATATCAGGTG<br>CCTGCCCCTCATGAACA |
| SEQ ID NO: 1432 | CATCATCAATAATATACCCCACAAAGTAAACAAAAGTTAATATGCAAATGAGCT<br>TTTGAATTTAGGGCGGGGCCGACGCTGATTGGACGAGAGAAGACGATGCAAATG<br>ACGTCACGACGCACGGCTAACGGTCGCCGCGGAGGCGTGGCCTAGCCCGGAAGC<br>AAGTCGCGGGGCTGATGACGTATAAAAAAGCGGACTTTAGACCCGGAAACGGC<br>CGATTTTCCCGCGGCCAAGCCCGGATATGAGGTAATTCTGGGCGGATGCAAGTG<br>AAATTAGGTCATTTTGGCGCGAAAACTGAATGAGGAAGTGAAAAGTGAAAAAT<br>ACCGGGCCCGCCCAGGGCGGAATATTTACCGAGGGCCGAGAGACTTTGACCGAT<br>TACGTGGGGGTTTCGATTACGGTGTTTTTTCGCGAATTTCCGCGTCCGTGTCAA<br>AGTCCGGTGTTTATGTCACAGATCAGCTGATCCACAGGGTATTTAAACCAGTCGA<br>GCCCGTCAAGAGGCCACTCTTGAGTGCCAGCGAGTAGAGATTTCTCTGAGCTCC<br>GCTCCCAGAGACCGAGAAAAATGAGACACCTGCGCCTTCTACCTTCAACTGTGC<br>CCGGGGACCTGGCTGTGATTATGCTGGAGGACTTTGTGAATACAGTTCTGGAGG<br>ACGAACTGCAACCAGAGCCATTTGAGCTGGGACCTACACTTCAGGACCTCTATG<br>ATCTGGAGGTAGATGCCCATGATGACGACCCTAACGAAGAGGCTGTGAATTTAA<br>TATTTCCAGAATCTATGATTCTTCAGGCTGACATAGCCAGTGAAGCCATAGTTAC<br>TCCTCTACATACTCCAACTCTGCCGCCTATACCTGAATTGGAAGAGGAGGATGA<br>GATAGACCTCCGGTGCTACGAGGAAGGTTTTCCTCCCAGCGATTCAGAGGACGA<br>ACAGGGTGAGCGAGAGATGGCTATTCTATCGGACTTTGCTTGTGTGATTGTGGA<br>GGAGCAAGATGTGATTGAAAAATCTACTGAGCCAGTACAAGGCTGTAGGAACTG<br>CCAGTACCACCGGGATAAGTCCGGAGATGTGAACGCCTCCTGCGCTTTGTGCTAT<br>ATGAAACAGACTTTCAGCTTTATTTACAGTAAGTGGAGTGAATGTGAGAGAGGC<br>TGAGTGCTTAACACATAACTGTAATGCTTGAACAGCTGTGCTAAGTGTGGTTTAT<br>TTTGTTACTAGGTCCGGTGTCAGAGGATGAGTCATCACCCTCAGAAGAAGACCG<br>CCCGTCTCCCCCTGAGCTGTCAGGCGAAACGCCCCTGCAAGTGTTCAGACCCACC<br>CCAGTCAGACCCAGTGGCGAGAGGCGAGCGGCTGTTGACAAAATTGAGGACTTG<br>TTGCAGGACATGGGTGGGGATGAACCTTTGGACCTGAGCTTGAAACGCCCCAGG<br>AACTAGGCGCAGCTGCGCTTAGTCATGTGTAAATAAAGTTGTACAATAAAGTA<br>TATGTGACGCATGCAAGGTGTGGTTTATGACTCATGGGCGGGGCTTAGTCCTATA<br>TAAGTGGCAACACTCGGGCACTTGGGACAGACCTTCAGGGAGTTCCTGATGGA<br>TGTGTGGACTATCCTTGCAGACTTTAGCAAGACACGCCGGCTTGTAGAGGATAG<br>TTCAGACGGGTGCTCCGGGTTCTGGAGACACTGGTTTGGAACTCCTCTATCTCGC<br>CTGGTGTACACAGTTAAGAAGGATTATAACGAGGAATTTGAAAATCTTTTTGCTG<br>ACTGCTCTGGCCTGCTAGATTCTCTGAATCTTGGCCACCAGTCCCTTTTCCAGGA<br>AAGGGTACTTCACAGCCTTGATTTTTCCAGCCCAGGGCGCACTACAGCCGGGGTT<br>GCTTTTGTGGTTTTTCTGGTTGACAAATGGAGCCAGGACACCCAACTGAGCAGG<br>GGATACATCCTGGACTTCGCAGCCATGCACCTGTGGAGGTCCTGGATCAGGCAG<br>CGGGGACAGAGAATCTTGAACTACTGGCTTCTACAGCCAGCAGCTCCAGGTCTT<br>CTTCGTCTACACAGACAAACATCCATGTTGGAGGAAGAAATGAGGCAGGCCATG<br>GACGAGAACCCGAGGAGCGGCCTGGACCCTCCGTCGGAAGAGGAGCTGGATTG<br>AATCAGGTATCCAGCCTGTACCCAGAGCTTAGCAAGGTGCTGACATCCATGGCC<br>AGGGGAGTGAAGAGGGAGAGGAGTGATGGGGGCAATACCGGGATGATGACCGA<br>GCTGACGGCCAGCTTGATGAATCGCAAGCGTCCAGAGCGCATTACCTGGCACGA<br>GCTACAGCAGGAGTGCAGGGATGAGATAGGCCTGATGCAGGATAAATATGGCCT<br>GGAGCAGATAAAAACCCACTGGTTGAACCCAGATGAGGATTGGGAGGAGGCCA<br>TTAAGAAGTATGCCAAGATAGCCCTGCGCCCAGATTGCAAGTACAGGATCACCA<br>AGACGGTGAATATTAGACATGCCTGCTACATCTCAGGGAACGGGGCAGAGGTGA<br>TGATCGATACCCTGGACAAGTCAGCTTTCAGGTGTTGCATGATGGGAATGAGAG<br>CCGGAGTGATGAATATGAATTCCATGATCTTCATGAACATGAAGTTCAATGGAG<br>AGAAGTTTAATGGGGTGCTGTTCATGGCCAACAGCCACATGACCGTACATGGCT<br>GCAGCTTCTTCGGTTTCAACAACATGTGTGCAGAGGTCTGGGGAGCTGCTAAGA<br>TCAGGGGCTGTAAGTTTTATGGCTGCTGGATGGGAGTGGTCGGAAGACCCAAGA<br>GCGAGATGTCTGTGAAGCAGTGTGTGTTTGAGAAGTGCTACCTGGGGGTGTCTA<br>CAGAGGGCAATGCTAGAGTGAGACATTGCTCTTCCCTGGAGACGGGCTGCTTCT<br>GCCTGGTGAAGGGCACAGCTTCGATCAAGCATAATGTGGTGAAAGGCTGCACGG<br>ATGAGCGCATGTACAACATGCTGACCTGCGACTCAGGGGTCTGTCATATCCTGA<br>AGAACATCCATGTGACCGCCCACTCCAGAAAGAAGTGGCCAGTGTTTGAGAATA<br>ACCTGCTAATCAAGTGCCATATGCACCTGGGAGCCAGAAGGGGCACCTTCCAGC<br>CGTACCAGTGCAACTTTAGCCAGACCAAGCTGCTGTTGGAGACGATGCCTTCTC<br>TAGGGTGAACCTGAACGGCATCTTTGACATGGATGTCTCGGTGTACAAGATCCT<br>GAGATACGATGAGACCAGGTCCAGGGTGCGCGCTTGCGAGTGCGGGGCAGAC<br>ACACCAGGATGCAGCCAGTGGCCCTGGATGTGACCGAGGAGCTGAGACCAGAC<br>CACCTGGTGATGGCCTGTACCGGGACCGAGTTCAGCTCCAGTGGGGAGGACACA<br>GATTAGAGGTAGGTTTGAGTAGTGGGCGTGGCTAATGTGAGTATAAAGGTGGGT<br>GTCTTACGAGGGTCTTTTTGCTTTTCTGCAGACATCATGAACGGGACCGGCGGGG<br>CCTTCGAAGGGGGCTTTTTAGCCCTTATTTGACAACCCGCCTGCCGGGATGGGC<br>CGGAGTTCGTCAGAATGTGATGGGATCTACGGTGGATGGGCGCCCAGTGCTTCC<br>AGCAAATTCCTCGACCATGACCTACGCGACCGTGGGGAGCTCGTCGCTCGACAG<br>CACCGCCGCAGCCGCGGCAGCCGCAGCCGCCATGACAGCGACGAGACTGGCCTC<br>GAGCTACATGCCCAGCAGCGGTAGCAGCCCATCTGTGCCCAGTTCCATCATCGC<br>CGAGGAGAAACTGCTGGCCCTGCTGGCCGAGCTGGAAGCCCTGAGCCGCCAGCT<br>GGCCGCCCTGACCCAGCAGGTGTCCGAGCTCCGCGAGCAACAGCAGCAGCAAA |

TABLE 7-continued

Nucleic Acid Sequences of Vectors

SEQ ID NO Sequence

ATAAATGATTCAATAAACACAGATTCTGATTCAAACAGCAAAGCATCTTTATTAT
TTATTTTTTCGCGCGCGGTAGGCCCTGGTCCACCTCTCCCGATCATTGAGAGTGC
GGTGGATTTTTTCCAGGACCCGGTAGAGGTGGGATTGGATGTTGAGGTACATGG
GCATGAGCCCGTCCCGGGGGTGGAGGTAGCACCACTGCATGGCCTCGTGCTCTG
GGGTCGTGTTGTAGATGATCCAGTCATAGCAGGGGCGCTGGGCGTGGTGCTGGA
TGATGTCCTTGAGGAGGAGACTGATGGCCACGGGGAGCCCCTTGGTGTAGGTGT
TGGCAAAGCGGTTGAGCTGGGAGGGATGCATGCGGGGGGAGATGATGTGCAGT
TTGGCCTGGATCTTGAGGTTGGCAATGTTGCCGCCCAGATCACGCCGTGGGTTCA
TGTTGTGCAGGACCACCAGAACGGTGTAGCCCGTGCACTTGGGGAACTTGTCAT
GCAACTTGGAAGGGAATGCGTGGAAGAATTTGGAGACGCCCTTGTGCCCGCCCA
GGTTTTCCATGCACTCATCCATGATGATGGCGATGGGCCCGTGGGCTGCGGCTTT
GGCAAAGACGTTTCTGGGGTCAGACACATCATAATTATGCTCCTGGGTGAGATC
ATCATAAGACATTTTAATGAATTTGGGGCGGAGGGTGCCAGATTGGGGGACGAT
GGTTCCCTCGGGCCCCGGGGCGAAGTTCCCCTCACAGATCTGCATCTCCCAGGCT
TTCATCTCGGAGGGGGGGATCATGTCCACCTGCGGGGCGATAAAAAAAACGGTT
TCCGGGGCGGGGGTGATGAGCTGCGAGGAGAGCAGGTTTCTCAACAGCTGGGAC
TTGCCGCACCCGGTCGGGCCGTAGATGACCCCGATGACGGGTTGCAGGTGGTAG
TTCAAGGACATGCAGCTGCCGTCGTCCCGGAGGAGGGGGGCCACCTCGTTGAGC
ATGTCTCTGACTTGGAGGTTTTCCCGGACGAGCTCGCCGAGGAGGCGGTCCCCG
CCCAGCGAGAGGAGCTCTTGCAGGGAAGCAAAGTTTTTCAGGGGCTTTAGTCCG
TCGGCCATGGGCATCTTGGCGAGGGTCTGCGAGAGGAGCTCCAGGCGGTCCCAG
AGCTCGGTGACGTGCTCTACGGCATCTCTATCCAGCAGACTTCCTCGTTTCGGGG
GTTGGGACGACTGCGACTGTAGGGCACGAGACGATGGGCGTCCAGCGCGGCCA
GCGTCATGTCCTTCCAGGGTCTCAGGGTCCGCGTGAGGGTGGTCTCCGTCACGGT
GAAGGGGTGGGCCCCTGGCTGGGCGCTTGCAAGGGTGCGCTTGAGACTCATCCT
GCTGGTGCTGAAACGGGCACGGTCTTCGCCCTGCGCGTCGGCGAGATAGCAGTT
GACCATGAGCTCGTAGTTGAGGGCCTCGGCGGCGTGGCCCTTGGCGCGGAGCTT
GCCCTTGGAAGAGCGCCCGCAGGCGGGACAGAGGAGGGATTGCAGGGCGTAGA
GCTTGGGTGCGAGAAAGACCGATTCGGGGGCGAAAGCATCCGCTCCGCAGTGGG
CGCAGACGGTCTCGCACTCGACGAGCCAGGTGAGCTCGGGGTGATCGGGGTCAA
AAACCAGTTTTCCCCCGTTCTTTTTGATGCGCTTCTTACCTCGCGTCTCCATGAGT
CTGTGTCCGCGCTCGGTGACAAACAGGCTGTCGGTGTCCCCGTAGACGGACTTG
ATTGGCCTGTCCTGCAGGGGCGTCCCGCGGTCCTCCTCGTAGAGAAACTCGGAC
CACTCTGAGACGAAGGCGCGTCCACGCCAAGACAAAGGAGGCTACGTGCGA
GGGGTAGCGGTCGTTGTCCACCAGGGGGTCCACCTTTTCCACCGTGTGCAGACA
CATGTCCCCTCCTCCGCATCCAAGAAGGTGATTGGCTTGTAGGTGTAGGCCACG
TGACCCGGGGTCCCCGACGGGGGGGTATAAAAGGGGGCGGGTCTGTGCTCGTCC
TCACTCTCTTCCGCGTCGCTGTCCACGAGCGCCAGCTGTTGGGGTAGGTATTCCC
TCTCGAGAGCGGGCATAACCTCGGCACTCAGGTTGTCAGTTTCTAGAAACGAGG
AGGATTTGATGTTGGCTTGCCCTGCCGCGATGCTTTTTAGGAGACTTTCATCCAT
CTGGTCAGAAAAGACTATTTTTTTATTGTCAAGCTTGGTGGCAAAGGAGCCATAG
AGGGCGTTGGAGAGAAGCTTAGCGATGGATCTCATGGTCTGATTTTTGTCACGGT
CGGCGCGCTCCTTTGCCGCGATGTTGAGCTGGACATACTCGCGCGCGACGCACTT
CCATTCGGGGAAGACGGTGGTGCGCTCGTCGGGCACGATCCTGACGCGCCAGCC
GCGGTTATGCAGGGTGACCAGGTCCACGCTGGTGGCCACCTCGCCGCGCAGGGG
CTCGTTGGTCCAGCAGAGTCTGCCGCCCTTGCGCGAGCAGAAAGGGGGCAGCAC
ATCAAGGAGATGCTCGTCAGGGGGATCCGCATCGATGGTGAAGATGCCCGGACA
GAGTTCCTTGTCAAAATAGTCTATTTTTGAGGATGCATCATCCAAGGCCATCTGC
CACTCGCGGGCGGCCAGCGCTCGCTCGTAGGGGTTGAGCGGCGGACCCCAGGGC
ATGGGATGCGTAAGGGCGGAGGCGTACATGCCGCAGATGTCATAGACATAGATG
GGCTCCGAGAGGATGCCGATGTAGGTGGGATAACAGCGCCCCCCGCGGATGCTG
GCGCGCACATAGTCATACAACTCGTGCGAGGGGCCAAAAAGGCGGGGCCGAG
ATTGGTGCGCTGGGGCTGCTCGGCACGGAAGACGATCTGGCGAAAGATGGCATG
CGAGTTGGAGGAGATGGTGGGCCGTTGGAAGATGTTAAAGTGGGCGTGGGGCA
GGCGGACCGAGTCGCGGATGAAGTGCGCGTAGGAGTCTTGCAGCTTGGCGACGA
GCTCGGCGGTGACGAGGACGTCCATGGCGCAGTAGTCGAGCGTTTCGCGGATGA
TGTCATAACCCGCCTCTCCTTTCTTCTCCCACAGCTCGCGGTTGAGGGCATACTC
CTCGTCATCCTTCCAGTACTCCCGGAGCGGGAATCCTCGATCGTCCGCACGGTAA
GAGCCCAGCATGTAGAAATGGTTCACGGCCTTGTAGGGACAGCAGCCCTTCTCC
ACGGGGAGGGCGTAAGCTTGAGCGGCCTTGCGGAGCGAGGTGTGTGTCAGGGC
GAAGGTGTCCCTGACCATGACTTTCAAGAACTGGTACTTGAAGTCCGAGTCGTC
GCAGCCGCCGTGCTCCCAGAGCTCGAAATCGGTGCGCTTTTTCGAGAGGGGGTT
AGGCAGAGCGAAAGTGACGTCATTGAAGAGAATCTTGCCTGCCCGCGGCATGAA
ATTGCGGGTGATGCGGAAAGGGCCAGGCACGGAGGCTCGGTTGTTGATGACCTG
GGCGGCGAGGACGATCTCGTCGAAGCCGTTGATGTTGTGCCCGACGATGTAGAG
TTCCATGAATCGCGGGCGGCCTTTGATGTGCGGCAGCTTTTTGAGCTCTTCGTAG
GTGAGGTCCTCGGGGCATTGCAGGCCGTGCTGCTCGAGCGCCCACTCTTGGAGA
TGGGGATTGGCGCGCATGAAGGAAGCCCAGAGCTCGGGGCCATGAGGGTCTG
GAGCTCGTCGCGAAAGAGGCGGAACTGCTGGCCCACGGCCATCTTTTCTGGGGT
GACGCAGTAGAAGGTGAGGGGTCCCGCTCCCAGCGATCCCAGCGTAAGCGCAC
GGCGAGATCGCGAGCGAGGGCGACCAGCTCGGGGTCCCCGGAGAATTTCATGAC
CAGCATGAAGGGGACGAGCTGCTTGCCGAAGGACCCCATCCAGGTGTAGGTTTC
TACATCGTAGGTGACAAAGAGCCGCTCCGTGCGAGGATGAGAGCCGATGGGGA
AGAACTGGATTTCCTGCCACCAGTTGGACGAGTGGCTGTTGATGTGATGAAAGT
AGAAATCCCGCCGGCGAACCGAGCACTCGTGCTGATGCTTGTAAAAGCGTCCGC
AGTACTCGCAGCGCTGCACGGGCTGTACCTCATCCACGAGATACACAGCGCGTC

TABLE 7-continued

Nucleic Acid Sequences of Vectors

SEQ ID NO Sequence

CCTTGAGGAGGAACTTCAGGAGTGGCGGCCCTGGCTGGTGGTTTTCATGTTCGCC
TGCGTGGGACTCACCCTGGGGCTCCTCGAGGACGGAGAGGCTGACGAGCCCGCG
CGGGAGCCAGGTCCAGATCTCGGCGCGGCGGGGGCGCAGAGCGAAGACGAGGG
CGCGCAGTTGGGAGCTGTCCATGGTGTCGCGGAGATCCAGGTCCGGGGGCAGGG
TTCTGAGGTTGACCTCGTAGAGGCGGGTGAGGGCGTGCTTGAGATGCAGATGGT
ACTTGATTTCTACGGGTGAGTTGGTGCCGTGTCCACGCATTGCATGAGCCCGTA
GCTGCGCGGGGCCACGACCGTGCCGCGCTTTAGAAGCGGTGTCGCGGACGCGCT
CCCGGCGGCAGCGGCGGTTCCGGCCCCGCGGGCAGGGGCGGCAGAGGCACGTC
TGCGTGGCGCTCGGGCAGGTCCCGGTGCTGCGCCCTGAGAGCGCTGGCGTGCGC
GACGACGCGGCGGTTGACATCCTGGATCTGCCGCCTCTGCGTGAAGACCACGGG
CCCCGTGACTTTGAACCTGAAAGACAGTTCAACAGAATCAATCTCGGCGTCATT
GACGGCGGCCTGACGCAGGATCTCTTGCACGTCGCCCGAGTTGTCCTGGTAGGC
GATCTCGGACATGAACTGCTCGATCTCCTCCTCCTGGAGATCGCCTCGGCCCGCG
CGCTCGACGGTGGCGGCGAGGTCATTGGAGATGCGACCCATGAGCTGCGAGAAG
GCGCCCAGGCCGCTCTCGTTCCAGACGCGGCTGTAGACCACGTCCCCGTCGGCG
TCGCGCGCGCGCATGACCACCTGCGCGAGGTTGAGCTCCACGTGCCGCGTGAAG
ACGGCGTAGTTGCGCAGGCGCTGGAAGAGGTAGTTGAGGGTGGTGGCGATGTGC
TCGGTGACGAAGAAGTACATGATCCAGCGTCGCAGGGGCATCTCGCTGATGTCG
CCGATGGCCTCCAACCTTTCCATGGCCTCGTAGAAGTCCACGGCGAAGTTGAAA
AACTGGGCGTTGCGGGCCGAGACCGTGAGCTCGTCTTCCAGGAGCCTGATGAGC
TCGGCGATGGTGGCGCGCACCTCGCGCTCGAAATCCCCGGGAGCCTCCTCCTCTT
CCTCTTCTTCTTCCATGACGACCTCTTCTTCTATTTCTTCCTCTGGGGCGGTGGT
GGTGGCGGGGCCCGACGACGACGGCGACGCACCGGGAGACGGTCGACGAAGCG
CTCGATCATCTCCCCGCGGCGGCGACGCATGGTTTCGGTGACGGCGCGACCCCG
TTCGCGAGGACGCAGCGTGAAGACGCCGCCGGTCATCTCCCGGTAATGGGGCGG
GTCCCCGTTGGGCAGCGAGAGGGCGCTGACGATGCATCTTATCAATTGCGGTGT
AGGGGACGTGAGCGCGTCGAGATCGACCGGATCGGAGAATCTTTCGAGGAAAG
CGTCTAGCCAATCGCAGTCGCAAGGTAAGCTCAGACACGTAGCAGCCCTGTGGA
CGCTGTTAGAATTGCGGTTGCTGATGATGTAATTGAAGTAGGCGTTTTTGAGGCG
GCGGATGGTGGCGAGGAGGACCAGGTCCTTGGGTCCCGCTTGCTGGATGCGGAG
CCGCTCGGCCATGCCCCAGGCCTGGCCCTGACACCGGCTCAGGTTCTTGTAGTAG
TCATGCATGAGCCTCTCTATGTCATCACTGGCGGAGGCGGAGTCTTCCATGCGGG
TGACCCCGACGCCCCTGAGCGGCTGCACGAGCGCCAGGTCGGCGACGACGCGCT
CGGCGAGGATGGCCTGTTGCACGCGGGTGAGGGTGTCCTGGAAGTCGTCCATGT
CGACGAAGCGGTGGTAGGCCCCGGTGTTGATGGTGTAGGTGCAGTTGGCCATGA
GCGACCAGTTGACGGTCTGCAGGCCGGCTGCACGACCTCGGAGTACCTGAGCC
GCGAGAAGGCGCGCGAGTCGAAGACGTAGTCGTTGCAGGTGCGCACGAGGTAC
TGGTAGCCCACAAGGCAGTGCGGCGGCGGCTGGCGGTAGAGGGGCCAGCGCTG
GGTGGCCGGCGCGCCCGGGGCCAGGTCCTCGAGCATGAGGCGGTGGTAGCCGTA
GAGGTAGCGTGACATCCAGGTGATGCCGGCGGCGGTGGTGGAGGCGCGCGGGA
ACTCGCGGACGCGGTTCCAGATGTTGCGCAGCGGCAGGAAATAGTCCATGGTCG
GCACGGTCTGGCCGGTGAGACGCGCGCAGTCATTGACGCTCTAGAGGCAAAAC
GAAAGCGGTTGAGCGGGCTCTTCCTCCGTAGCCTGGCGGAACGCAAACGGGTTA
GGCCGCGCGTGTACCCCGGTTCGAGTCCCCTCGAATCAGGCTGGAGCCGCGACT
AACGTGGTATTGGCACTCCCGTCTCGACCCGAGCCCGATAGCCGCCAGGATACG
GCGGAGAGCCCTTTTTGCCGGCCGCGCGGGGTCGCTAGACTTGAAAGCGGCCGA
AAACCCCGCCGGGTAGTGGCTCGCGCCCGTAGTCTGGAGAAGCATTGCCAGGGT
TGAGTCGCGGCAGAACCCGGTTCGCGGACGGCCGCGGCGAGCGGGACTTGGTCT
CCCCGCCTATAAGACCCACAGCCAGCCGACTTCTCCAGTTACGGGAGCGAGCCC
CCTTTTTTCTTTTTGCCAGATGCATCCCGTCCTGCGCCAAATGCGTCCCACCCCCC
CGGCGACCACCGCGACCGCGGCCGTAGCAGGCGCCGGCGCTGTAAGCCAGCCAC
AGCAGACAGAAATGGACTTGGAAGAGGGCGAAGGGCTGGCGAGACTGGGGGCG
CCGTCCCCGGAGCGACACCCCCGCGTGCAGCTGCAGAAGGACGTGCGCCCGGCG
TACGTGCCCGCGCAGAACCTGTTCAGGGACCGCAGCGGGGAGGGAGCCCGAGGA
GATGCGCGACTGCCGGTTTCGGGCGGGCAGGGAGCTGCGCGAGGGTCTGGACCG
CCAGCGCGTGCTGCGCGACGAGGATTTCGAGCCGAACGAGCAGACGGGGATCA
GCCCCGCGCGCGCACGTGGCGGCGGCCAACCTGGTGACGGCCTACGAGCAGA
CGGTGAAGCAGGAGCGCAACTTCCAAAAGAGTTTCAACAACCACGTGCGCACCC
TGATCGCGCGCGAGGAGGTGGCCCTTGGCCTGATGCACCTGTGGGACCTGGCGG
AGGCCATCGTGCAGAACCCGGACAGCAAGCCTCTGACGGCGCAGCTGTTCCTGG
TGGTGCAGCACAGCAGGGACAACGAGGCGTTCAGGGAGGCGCTGCTGAACATC
GCCGAGCCCGAGGGTCGCTGGCTGCTGGAGCTGATTAACATCTTGCAGAGCATC
GTAGTGCAGGAGCGCAGCCTGAGCCTGGCCGAGAAGGTGGCGGCGATCAACTA
CTCGGTGTTGAGCCTGGGCAAGTTTTACGCGCGCAAGATTTACAAGACGCCGTA
CGTGCCCATAGACAAGGAGGTGAAGATAGACAGCTTTTACATGCGCATGGCGCT
CAAGGTGCTGACGCTGAGCGACGACCTGGGCGTGTACCGCAACGACCGCATCCA
CAAGGCCGTGAGCACGAGCCGGCGGCGCGAGCTGAGCGACCGCGAGCTGATGC
TGAGCCTGCGCCGGGCACTGGTAGGGGCGCCACCGGCGGTGAGGAGTCCTACT
TCGACATGGGGGCGGACCTGCATTGGCAGCCGAGCCGGCGCGCCTTGGAGGCCG
CCTACGGTCCAGAGGACTTGGATGAGGATGAGGAAGAGGAGGAGGATGCACCC
GTTGCGGGGTACTGACGCCTCCGTGATGTGTTTTTAGATGTCCCAGCAAGCCCG
GACCCCGCCATAAGGGCGGCGCTGCAAAGCCAGCCGTCCGGTCTAGCATCGGAC
GACTGGGAGGCCGCGATGCAACGCATCATGGCCCTGACGACCCGCAACCCCGAG
TCCTTTAGACAACAGCCGCAGGCCAACAGACTCTCGGCCATTCTGGAGGCGGTG
GTCCCCTCTCGGACCAACCCCACGCACGAGAAGGTGCTGGCGATCGTGAACGCG
CTGGCGGAGAACAAGGCCATCCGTCCCGACGAGGCCGGGCTGGTGTACAACGCC

TABLE 7-continued

Nucleic Acid Sequences of Vectors

SEQ ID NO Sequence

CTGCTGGAGCGCGTGGGCCGCTACAACAGCACGAACGTGCAGTCCAACCTGGAC
CGGCTGGTGACGGACGTGCGCGAGGCCGTGGCGCAGCGCGAGCGGTTCAAGAA
CGAGGGCCTGGGCTCGCTGGTGGCGCTGAACGCCTTCCTGGCGACGCAGCCGGC
GAACGTGCCGCGCGGGCAGGACGATTACACCAACTTTATCAGCGCGCTGCGGCT
GATGGTGACCGAGGTGCCCCAGAGCGAGGTGTACCAGTCGGGCCCGGACTACTT
TTTCCAGACGAGCCGGCAGGGCCTGCAGACGGTGAACCTGAGCCAGGCTTTCAA
GAATCTGCGCGGGCTGTGGGGCGTGCAGGCGCCCGTGGGCGACAGGTCGACGGT
GAGCAGTTTGCTGACGCCCAACTCGCGGCTGCTGCTGCTGATCGCGCCCTTC
ACCGACAGCGGCAGCGTGAACCGCAACTCGTACCTGGGCCACCTGCTGACGCTG
TATAGGGAGGCCATAGGCCAGGCGCAGGTGGACGAGCAGACCTTCCAGGAGAT
CACGAGCGTAAGCCGCGCGCTGGGCAGAACGACACCGACAGTCTGAGGGCCA
CCCTGAACTTTTTGCTGACCAATAGACAGCAGAAGATCCCGCCGCAGTACGCAC
TGTCGGCCGAGGAGGAAAGGATCTTGAGATATGTGCAGCAGAGCGTAGGGCTGT
TCCTGATGCAGGAGGGTGCCACCCCCAGCGCCGCGCTGGACATGACCGCGCGCA
ACATGGAACCTAGCATGTACGCCGCCAACCGGCCGTTCATCAATAAGCTGATGG
ACTACCTGCACCGCGCGGCGGCCATGAACTCGGACTACTTTACCAATGCCATTCT
GAACCCGCACTGGCTCCCGCCGCCGGGGTTCTACACGGGCGAGTACGACATGCC
CGACCCCAACGACGGGTTCCTGTGGGACGACGTGGACAGCGCGGTGTTCTCGCC
CGCCTTTCAAAAGCGACAGGAAGCGGTGCGCACGCCTAGCGAGGGCGCTGTGGG
ACGGAGCCCCTTTCCTAGCTTGGGGAGTTTGCATAGCCTGCCGGGCTCGGTGAAC
AGTGGCAGGGTGAGCCGACCGCGCTTGCTGGGCGAGGACGAGTACCTGAACGA
CTCGCTGCTGCAGCCGCCGCGGGCCAAGAACGCCATGGCCAATAACGGGATAGA
GAGTCTGGTGGACAAACTGAACCGCTGGAAGACCTACGCTCAGGACCATAGGGA
CGCGCCCGCGCCGCGGCGACAGCGCCACGACCGGCAGCGGGGCCTGGTGTGGG
ACGACGAGGACTCGGCCGACGATAGCAGCGTGTTGGACTTGGGCGGGAGCGGT
GGTGGGGCCAACCCGTTCGCGCATCTGCAGCCCAGACTGGGGCGACGGATGTTT
TAAATGCAAAATAAAACTCACCAAGGCCATAGCGTGCGTTCTCTTCCTTGTTAGA
GATGAGGCGCGCGGTGGTGTCTCCTCCTCCCTCGTACGAGAGCGTGATGGCGCA
GGCGACCCTGGAGGTTCCGTTTGTGCCTCCGCGGTATATGGCGCCTACGGAGGG
CAGAAACAGCATTCGTTACTCGGAGCTGGCTCCGCTGTACGACACCACTCGCGT
GTACTTGGTGGACAACAAGTCGGCGGACATCGCTTCCCTGAACTACCAAAACGA
CCACAGCAACTTCCTGACCACGGTGGTGCAGAACAACGATTTCACCCCCGCCGA
GGCCAGCACGCAGACGATAAATTTTGACGAGCGGTCCCGGTGGGCGGTGATCT
GAAGACCATTCTGCACACCAACATGCCCAATGTGAACGAGTACATGTTCACCAG
CAAGTTTAAGGCGCGGGTGATGGTGGCTAGAAAAAAGGCGGAAGGGGCTGATG
CAAATGATAGAAGCAAGGATATCTTAGAGTATCAGTGGTTTGAGTTTACCCTGC
CCGAGGGCAACTTTTCCGAGACCATGACCATAGACCTGATGAACAACGCCATCT
TGGAAAACTACTTGCAAGTGGGGCGGCAAAATGGCGTGCTGGAGAGTGATATCG
GAGTCAAGTTTGACAGCAGAAATTTCAAGCTGGGCTGGGACCCGGTGACCAAGC
TGGTGATGCCAGGGGTCTACACCTACGAGGCCTTCCACCCGGACGTGGTGCTGC
TGCCGGGCTGCGGGGTGGACTTCACCGAGAGCCGCCTGAGCAACCTTCTGGGCA
TTCGCAAGAAGCAACCTTTCCAAGAGGGCTTCAGAATCATGTATGAGGATCTAG
AAGGGGGCAACATACCCGCTCTTCTGGATACCAAAAAATATCTGGATAGCAAGA
AAGAAATTGAAGAAGCTGCTAAAAATGCAGCCACTGCAAATGATGCGCCCAGG
GGAGATACTTTTGTCAATGAAGCTCAAGAGAAGGCAGCTCAGAAGCAGCTAGTG
ATCGAGCCCATTGAAAAGGATGACAGCAACAGAAGTTATAATCTCATACCTGGA
ACCATGGACACCCTGTACCGAAGCTGGTACCTGTCCTATACCTACGGGGACCCC
GAGAAGGGGGTGCAGTCGTGGACACTGCTCACCACCCCGGACGTCACCTGCGGC
GCGGAGCAAGTCTACTGGTCGCTGCCGGACCTCATGCAAGACCCGGTCACCTTC
CGCTCTACCCAGCAAGTCAGCAACTACCCCGTGGTCGGCGCCGAGCTCATGCCC
TTCCGCGCCAAGAGCTTTTACAACGACCTCGCCGTCTACTCCCAGCTCATCCGCA
GCTACACCTCCCTCACCCACGTCTTCAACCGCTTCCCCGACAACCAGATCCTCTG
CCGCCCGCCCGCGCCCACCATCACCACCGTCAGTGAAAACGTGCCTGCTCTCAC
AGATCACGGGACGCTACCGCTGCGCAGCAGTATCCGCGGAGTCCAGCGAGTGAC
CGTCACTGACGCCCGTCGCCGCACCTGTCCCTACGTCTACAAGGCCCTGGGCATA
GTCGCGCCGCGCGTGCTCTCCAGTCGCACCTTCTAAAAAATGTCTATTCTCATCT
CGCCCAGCAATAACACCGGCTGGGGTCTTACTAGGCCCAGCACCATGTACGGAG
GAGCCAAGAAGCGCTCCCAGCAGCACCCCGTCCGCGTCCGCGGCCACTTCCGCG
CTCCCTGGGGCGCTTACAAGCGCGGGCGGACTTCCACCGCCACGCCGTGCGCA
CCACCGTCGACGACGTCATCGACTCGGTGGTCGCCGACGCGCGCAACTACACCC
CCGCCCCCTCCACCGTGGACGCGGTCATCGACAGCGTGGTAGCCGACGCGCGCG
ACTATGCCAGACGCAAGAGCCGGCGGCGACGGATCGCCAGGCGCCACCGGAGC
ACGCCCGCCATGCGCGCCGCCGGGCTCTGCTGCGCCGCCAGACGCACGGGC
CGCCGGGCCATGATGCGAGCCGCGCGCCGCGCCGCCGCACCCACCCCCGCA
GGCAGGACTCGCAGACGAGCGGCCGCCGCCGCCGCGGCCATCTCTAGCATG
ACCAGACCCAGACGCGGAAACGTGTACTGGGTGCGCGACTCCGTCACGGGCGTG
CGCGTGCCCGTGCGCACCCGTCCTCCTCGTCCCTGATCTAATGCTTGTGTCCTCCC
CCGCAAGCGACGATGTCAAAGCGCAAAATCAAGGAGGAGATGCTCCAGGTCGT
CGCCCCGGAGATTTACGGACCACCCCAGGCGGACCAGAAACCCCGCAAAATCAA
GCGGGTTAAAAAAAAGGATGAGGTGGACGAGGGGGCAGTAGAGTTTGTGCGCG
AGTTCGCTCCGCGGCGGCGCGTAAATTGGAAGGGGCCAGGGTGCAGCGCGTGT
TGCGGCCCGGCACGGCGGTGGTGTTCACGCCCGGCGAGCGGTCCTCGGTCAGGA
TGAAACGTAGTTATGACGAGGTGTACGGCGACGACGACATCCTGGACCAGGCGG
CGGAGCGGGCGGGCGAGTTCGCCTACGGGAAGCGGTCTCGCGAAGAGGAGCTG
ATCTCGCTGCCGCTGGACGAGAGCAACCCCACGCCGAGCCTGAAGCCCGTGACC
CTGCAGCAGGTGCTGCCCCAGGCGGTGCTGCTGCCGAGCCGCGGGGTCAAGCGC

TABLE 7-continued

Nucleic Acid Sequences of Vectors

SEQ ID NO Sequence

GAGGGCGAAAACATGTACCCGACCATGCAGATCATGGTGCCCAAGCGCCGGCGC
GTGGAGGACGTGCTGGACACCGTGAAAATGGATGTGGAGCCCGAGGTCAAGGT
GCGCCCCATCAAGCAGGTGGCGCCGGGCCTGGGCGTGCAGACCGTGGACATTCA
GATCCCCACCGACATGGATGTCGACAAAAAACCCTCGACCAGCATCGAGGTGCA
GACCGACCCCTGGCTTCCAGCCTCCACCGCTACCGTCTCCACTTCTACCGCCGCC
ACGGCTACCGAGCCTCCCAGGAGGCGAAGATGGGGCGCCGCCAGCCGGCTGAT
GCCAAACTACGTGTTGCATCCTTCCATTATCCCGACGCCGGGCTACCGCGGCACC
CGGTATTACACCAGCCGCAGGCGCCCAGCCACCAAGCGCCGCCGCCGCACCACC
CGCCGCCGTCTGGCCCCAGCCCGCGTGCGCCGCGTAACCACGCGCCGGGGCCGC
TCGCTCGTTCTGCCCACCGTGCGCTACCACCCCAGCATCCTTTAATCCGTGTGCT
GTGATACTGTTGCAGAGAGATGGCTCTCACTTGCCGCCTGCGCATCCCCGTCCCG
AATTACCGAGGAAGATCCCGCCGCAGGAGAGGCATGGCAGGCAGCGGCCTGAA
CCGCCGCCGGCGGCGGGCCATGCGCAGGCGCCTGAGTGGCGGCTTTCTGCCCGC
GCTCATCCCCATAATCGCCGCGGCCATCGGCACGATCCCGGGCATAGCTTCCGTT
GCGCTGCAGGCGTCGCAGCGCCGTTGATGTGCGAATAAAGCCTCTTTAGACTCT
GACACACCTGGTCCTGTATATTTTTAGAATGGAAGACATCAATTTTGCGTCCCTG
GCTCCGCGGCACGGCACGCGGCCGTTCATGGGCACCTGGAACGAGATCGGCACC
AGCCAGCTGAACGGGGGCGCCTTCAATTGGAGCAGTGTCTGGAGCGGGCTTAAA
AATTTCGGCTCGACGCTCCGGACCTATGGGAACAAGGCCTGGAATAGTAGCACG
GGGCAGTTGTTGAGGGAAAAGCTCAAAGACCAGAACTTCCAGCAGAAGGTGGT
GGACGGCCTGGCCTCGGGCATTAACGGGGTGGTGGACATCGCGAACCAGGCCGT
GCAGCGCGAGATAAACAGCCGTCTGGACCCGCGCCCGCCCGCCGCCACGGTGGT
GGGAGATGGAAGATGCAAGCGCGCATCCTCCGCCCAAGGGCGAGAAGCGGCCGC
GGCCCGACGCGGAGGAGACGACCCTGCAGGTGGACGAGCCGCCTCGTACGAG
GAGGCCGTCAAGGCCGGCATGCCCACCACGCGCATCATCGCGCCGCTGGCCACG
GGTGTAATGAAACCCGCCACCCTAGACCTGCCTCCACCACCTACGCCCGCTCCAC
CGAAGGCAGCTCCGGTCGTGCAGCCCCCTCCGGTGGCGACCGCCGTGCGCCGCG
TCCCCGCCCGCCGCCAGGCCCAGAACTGGCAGAGCACGCTGCACAGTATCGTGG
GCCTGGGAGTGAAAAGTCTGAAGCGCCGCCGATGCTTTTGAGAGAGAAAGGAC
ACTAAAGGGAGAGCTTAACTTGTATGTGCCCTTACCGCCAGAGAACGCGCGAAGA
TGGCCACCCCCTCGATGATGCCGCAGTGGGCGTACATGCACATCGCCGGGCAGG
ACGCCTCGGAGTACCTGAGCCCGGGTCTGGTGCAGTTTGCCCGCGCCACCGACA
CGTACTTCAGCCTGGGCAACAAGTTTAGAAACCCCACGGTGGCTCCCACCCACG
ATGTGACCACGGACCGGTCCCAGCGTCTGACGCTGCGCTTCGTGCCCGTGGATC
GCGAGGACACCACGTACTCGTACAAGGCGCGCTTCACTCTGGCCGTGGGCGACA
ACCGGGTGCTAGACATGGCCAGCACGTACTTTGACATCCGCGGCGTCCTGGACC
GCGGTCCCAGCTTCAAACCCTACTCGGGCACGGCTTACAACAGCCTGGCACCCA
AGGGCGCCCCCAATCCCAGTCAGTGGACTACCAAAGAAAAGCAGACCGGAGTA
AATGCAGGAGACAAAGAAGTTACAAAGACATTTGGACTTGCCGCCATGGGAGG
CAGTAATATTTCTAAGGACGGTTTGCAGATTGGAACTGACACAACAGCAGATGC
TGTAAAACCAATATATGCAGACAAAACTTACCAGCCAGAACCTCAAGTGGGAGA
AGAAAACTGGCAGGATAATGATGAATATTATGGCGGCAGGGCTCTTAAAAAAG
ATACTAAAATGAAGCCATGCTATGGTTCCTTTGCTAAACCCACAAACAAGGAAG
GTGGCCAGGCTAAATTGAAAGAAACACCCAATGGTGCTGATCCTCAATATGATG
TGGACATGGCCTTCTTCGACTCAACCACTATAAACATTCCAGATGTAGTGTTATA
CACTGAAAATGTAGATTTGGAAACTCCAGATACACATGTGGTGTACAAACCAGG
CAAAGAGGATGAGAGTTCTGAAGCTAACTTAACTCAGCAGTCCATGCCAAACAG
ACCAAACTACATTGGCTTCAGAGACAACTTTGTGGGGCTTATGTATTACAACAGC
ACTGGCAACATGGGTGTGCTGGCTGGTCAGGCTTCCCAATTGAATGCTGTGGTCG
ACTTGCAAGACAGAAACACAGAGCTGTCTTACCAGCTTTTGCTAGATTCTCTGGG
TGACAGAACCAGATACTTTAGCATGTGGAACTCTGCGGTGGACAGTTATGATCC
CGATGTTAGGATCATTGAGAACCACGGTGTTGAAGATGAACTTCCTAACTATTGC
TTCCCCTTGGACGGTGTTCAAACTAATTCAGCCTACCAAGGTGTTAAACTAAAGG
CTAATCAAGCAGGAGGTGGAGCTAATGGAGACTGGGAAAAGGATGATACCATTT
CAGCCCATAATCAAATTGGAAAGGGCAACATCTTTGCCATGGAGATCAACCTCC
AGGCCAACCTGTGGAAGAGTTTTCTGTACTCGAACGTGGCGCTGTACCTGCCCG
ACTCCTTCAAGTACACTCCGGCCAACGTCACTCTGCCCACCAACACCAACACCTA
CGAGTACATGAACGGCCGCGTGGTGGCCCCCTCGCTGGTGGACGCTTACATCAA
CATCGGCGCCCGCTGGTCGCTGGACCCCATGGACAACGTCAACCCCTTCAACCA
CCACCGCAATGCGGGCCTGCGCTACCGCTCCATGCTGCTGGGCAACGGCCGCTA
CGTGCCCTTCCACATCCAAGTGCCCCAAAAGTTCTTTGCCATCAAGAACCTGCTC
CTGCTTCCGGGCTCCTACACCTACGAGTGGAACTTCCGCAAGGATGTCAACATG
ATCCTGCAGAGTTCCCTCGGCAACGACCTGCGCGTCGACGGCGCCTCCGTCCGCT
TCGACAGCGTCAACCTCTACGCCACCTTCTTCCCCATGGCGCACAACACCGCCTC
CACTCTGGAAGCCATGCTGCGCAACGACACCAACGACCAGTCCTTCAACGACTA
CCTCTCGGCCGCCAACATGCTCTACCCCATCCCGGCCAAGGCCACCAACGTGCCC
ATCTCCATCCCCTCGCGCAACTGGGCCGCCTTCCGCGGCTGGAGTTTCACCCGGC
TCAAGACCAAGGAAACTCCTTCCCTCGGCTCGGGTTTCGACCCCTACTTTGTCTA
CTCGGGCTCCATCCCATACCTCGACGGGACCTTCTACCTCAACCACACCTTCAAG
AAGGTCTCCATCATGTTCGACTCCTCGGTCAGCTGGCCCGGCAACGACCGGCTGC
TCACGCCGAACGAGTTCGAGATCAAGCGCAGCGTCGACGGGGAGGGCTACAAC
GTGGCCCAATGCAACATGACCAAGGACTGGTTCCTCGTCCAGATGCTCTCCCACT
ACAACATCGGCTACCAGGGCTTCCACGTGCCCGAGGGCTACAAGGACCGCATGT
ACTCCTTCTTCCGCAACTTCCAGCCCATGAGCAGGCAGGTGGTCGATGAGATCA
ACTACAAGGACTACAAGGCCGTCACCCTGCCCTTCCAGCACAACAACTCGGGCT
TCACCGGCTACCTCGCACCCACCATGCGTCAGGGGCAGCCCTACCCCGCCAACTT

TABLE 7-continued

Nucleic Acid Sequences of Vectors

SEQ ID NO Sequence

```
CCCCTACCCGCTCATCGGCCAGACGGCCGTGCCCTCCGTCACCCAGAAAAGTT
CCTCTGCGACAGGGTCATGTGGCGCATCCCCTTCTCCAGCAACTTCATGTCCATG
GGCGCCCTCACCGACCTGGGTCAGAACATGCTCTATGCCAACTCGGCCCACGCG
CTCGACATGACCTTCGAGGTGGACCCCATGGATGAGCCCACCCTCCTCTATCTTC
TCTTCGAAGTTTTCGACGTGGTCAGAGTGCACCAGCCGCACCGCGGCGTCATCG
AGGCCGTCTACCTGCGCACACCCTTCTCCGCCGGCAACGCCACCACATAAGCAT
GAGCGGCTCCAGCGAACGAGAGCTCGCGGCCATCGTGCGCGACCTGGGCTGCGG
GCCCTACTTTTTGGGCACCCACGACAAGCGCTTCCCGGGCTTCCTCGCCGGCGAC
AAGCTGGCCTGCGCCATCGTCAACACGGCCGGCCGCGAGACCGGAGGCGTGCAC
TGGCTCGCCCTTCGGCTGGAACCCGCGCTCGCGCACCTGCTACATGTTCGACCCCT
TTGGGTTCTCGGACCGCCGGCTCAAGCAGATTTACAGCTTCGAGTACGAGGCCA
TGCTGCGCCGCAGCGCGCTTGCCTCCTCGCCCGACCGCTGTCTCAGCCTCGAACA
GTCCACCCAGACCGTGCAGGGGCCCGACTCCGCCGCCTGCGGACTTTTCTGTTGC
ATGTTCTTGCATGCTTTCGTGCACTGGCCCGACCGACCCATGGACGAAACCCCA
CCATGAACTTGCTGACGGGGGTGCCCAACGGCATGCTACAATCGCCACAGGTGC
TGCCCACCCTCCGGCGCAACCAGGAGGAGCTCTACCGCTTCCTCGCGCGCCATTC
CCCTTACTTTCGCTCCCACCGCGCCGCCATCGAACACGCCACCGCTTTTGACAAA
ATGAAACAACTGCGTGTATCTCAATAAACAGCACTTTTATTTTACATGCACTGGA
GTATATGCAAGTTATTTAAAAGTCGAAGGGGTTCTCGCGCTCGTCGTTGTGCGCC
GCGCTGGGGAGGGCCACGTTGCGGTACTGGTACTTGGGCTGCCACTTGAACTCG
GGGATCACCAGCTTGGGTACGGGAATCTCGGGGAAGGTCTCGCTCCACATGCGC
CGGCTCATCTGCAGGGCGCCCAGCATGTCAGGCGCGGAGATCTTGAAATCGCAG
TTGGGGCCGGTGCTCTGCGCGCGCGAGTTGCGGTACACGGGATTGCAGCACTGG
AACACCATCAGACTGGGGTAGTTGACGCTGGCCAGCACGCTCTTGTCGCTGATCT
GATCCTTGTCCAGGTCCTCGGCGTTGCTCAGGCCGAACGGGGTCATCTTGCACAG
CTGGCGGCCCAGGAAGGGCACGCTGTGAGGCTTGTGATTACACTCGCAGTGCAC
GGGCATCAGCATCATCCCCGCGCCGCGCTGCATATTCGGGTAGAGGGCCTTGAC
GAAGGCCGTGATCTGCTTGAAAGCTTGCTGGGCCTTGGCTCCCTCGCTGAAGAA
CAGCCCGCAGCTTTTCCCGCTGAACTGGTTATTCCCACACCCGGCATCATGCACA
CAGCAGCGCGCGTCATGGCTGGTCAGTTGCACCACGCTTCGGCCCCAGCGGTTCT
GGGTCACCTTGGCCTTGCTGGGCTGTTCCTTCAACGCGCGCTGCCCGTTCTCGCT
GGTCACATCCATCTCCACCACGTGGTCCTTGTGGATCATCACTGTCCCGTGCAGA
CACTTCAGCTGGCCTTCCACCTCGGTGCAGCCGTGGTCCCACAGGGCGCTGCCGG
TGCACTCCCAGTTCTTATGCGCGATACCGCTGTGGCTGAAGATGTAACCTTGCAA
CAGGCGGCCCATGATGGTGCTAAAGGTTTTCTGGGTGGTGAAGGTCAGTTGCAT
CCCGCGGGCCTCCTCGTTCATCCAGGTCTGGCACATCTTCTGGAAGATCTCGGTC
TGCTCGGGCATGAGCTTGTAAGCATCGCGCAGACCGCTGTCGACGCGGTAACGT
TCCATTAGCACGTTCATGGCATCCATGCCCTTCTCCCAGGACGAGACTAGAGGCA
GACTCAGGGGGTTGCGCACGTTCAGGACACCGGGGGTCGCGGGCTCGACGATGC
GTTTTCCGTCCTTGCCTTCCTTCAACAGAACCGGCGGCTGGCTGAATCCCACTCC
CACGATCACGGCATCTTCCTGGGGCATCTCTTCGTCGGGGTCTACCTTGGTCACA
TGCTTGGTCTTTCTGGCTTGCTTCTTTTTTGGAGGGCTGTCCACGGGGACCACGTC
CTCCTCGGAAGACCCGGAGCCCACCCGCTGATACTTTCGGCGCTTGGTGGGCAG
AGGAGGTGGCGGCGAGGGGCTCCTCTCCTGCTCCGGCGGATAGCGCGCTGAACC
GTGGCCCCGGGGCGGAGTGGCCTCTCGCTCCATGAACCGGCGCACGTCCTGACT
GCCGCCGGCCATTGTTTCCTAGGGGAAGATGGAGGAGCAGCCGCGTAAGCAGGA
GCAGGAGGAGGACTTAACCACCCACGAGCAACCCAAAATCGAGCAGGACCTGG
GCTTCGAAGAGCCGGCTCGTCTAGAACCCCCACAGGATGAACAGGAGCACGAGC
AAGACGCAGGCCAGGAGGAAACCGACGCTGGGCTCGAGCATGGCTACCTGGGA
GGAGAGGAGGATGTGCTGCTGAAACACCTGCAGCGCCAGTCCCTCATCCTCCGG
GACGCCCTGGCCGACCGGAGCGAAACCCCCCTCAGCGTCGAGGAGCTGTGTCGG
GCCTACGAGCTCAACCTCTTCTCGCCGCGCGTGCCCCCCAAACGCCAGCCCAAC
GGCACCTGCGAGCCCAACCCGCGTCTCAACTTCTATCCCGTCTTTGCGGTCCCCG
AGGCCCTCGCCACCTATCACATCTTTTTCAAGAACCAAAAGATCCCCGTCTCCTG
CCGCGCCAACCGCACCCGCGCCGACGCGCTCCTCGCTCTGGGGCCCGGCGCGCG
CATACCTGATATCGCTTCCCTGGAAGAGGTGCCCAAGATCTTCGAAGGGCTCGG
TCTGGACGAGACGCGCGCGGCGAACGCTCTGAAAGAAACAGCAGAGGAAGAGG
GTCACACTAGCGCCCTGGTAGAGTTGGAAGGCGACAACGCCAGGCTGGCCGTGC
TCAAGCGCAGCGTCGAGCTCACCCACTTCGCCTACCCCGCCGTCAACCTCCCGCC
CAAGGTCATGCGTCGCATCATGGATCAGCTCATCATGCCCCACATCGAGGCCCTC
GATGAAAGTCAGGAGCAGCGCCCCGAGGACGCCCGGCCCGTGGTCAGCGACGA
GATGCTCGCGCGCTGGCTCGGGACCCGCGACCCCCAGGCTTTGGAACAGCGGCG
CAAGCTCATGCTGGCCGTGGTCCTGGTCACCCTCGAGCTCGAATGCATGCGCCGC
TTCTTCACCGACCCCGAGACCCTGCGCAAAGTCGAGGAGACCCTGCACTACACT
TTCAGACACGGCTTCGTCAGGCAGGCCTGCAAGATCTCCAACGTGGAGCTGACC
AACCTGGTCTCCTGCCTGGGGATCCTTCACGAGAACCGCCTGGGGCAGACCGTG
CTCCACTCTACCCTGAAGGGCGAGGCGCGTCGGGACTATGTCCGCGACTGCGTC
TTTCTCTTTCTCTGCCACACATGGCAAGCAGCCATGGGCGTGTGGCAGCAGTGTC
TCGAGGACGAGAACCTGAAGGAGCTGGACAAGCTTCTTGCTAGAAACCTTAAAA
AGCTGTGGACGGGCTTCGACGAGCGCACCGTCGCCTCGGACCTGGCCGAGATCG
TCTTCCCCGAGCGCCTGAGGCAGACGCTGAAAGGCGGGCTGCCCGACTTCATGA
GCCAGAGCATGTTGCAAAACTACCGCACTTTCATTCTCGAGCGATCTGGGATGCT
GCCCGCCACCTGCAACGCTTTCCCCTCCGACTTTGTCCCGCTGAGCTACCGCGAG
TGTCCCCCGCCGCTGTGGAGCCACTGCTACCTCTTGCAGCTGGCCAACTACATCG
CCTATCACTCGGATGTGATCGAGGACGTGAGCGGCGAGGGGCTGCTCGAGTGCC
ACTGCCGCTGCAACCTGTGCTCCCCGCACCGCTCCCTGGTCTGCAACCCCCAGCT
```

TABLE 7-continued

Nucleic Acid Sequences of Vectors

SEQ ID NO Sequence

```
CCTTAGCGAAACCCAGGTCATCGGTACCTTCGAGCTGCAAGGTCCGCAGGAGTC
CACCGCTCCGCTGAAACTCACGCCGGGGTTGTGGACTTCCGCGTACCTGCGCAA
ATTTGTACCCGAGGACTACCACGCCCATGAGATAAAGTTCTTCGAGGACCAATC
GCGTCCGCAGCACGCGGATCTCACGGCCTGCGTCATCACCCAGGGCGCGATCCT
CGCCCAATTGCACGCCATCCAAAAATCCCGCCAAGAGTTTCTTCTGAAAAAGGG
TAGAGGGGTCTACCTGGACCCCCAGACGGGCGAGGTGCTCAACCCGGGTCTCCC
CCAGCATGCCGAGGAAGAAGCAGGAGCCGCTAGTGGAGGAGATGGAAGAAGAA
TGGGACAGCCAGGCAGAGGAGGACGAATGGGAGGAGGAGACAGAGGAGGAAG
AATTGGAAGAGGTGGAAGAGGAGCAGGCAACAGAGCAGCCCGTCGCCGCACCA
TCCGCGCCGGCAGCCCCTCCGGTCACGGATACAACCTCCGCAGCTCCGGCCAAG
CCTCCTCGTAGATGGGATCGAGTGAAGGGTGACGGTAAGCACGAGCGGCAGGG
CTACCGATCATGGAGGGCCCACAAAGCCGCGATCATCGCCTGCTTGCAAGACTG
CGGGGGGAACATCGCTTTCGCCCGCCGCTACCTGCTCTTTCACCGCGGGGTGAAC
ATCCCCCGCAACGTGTTGCATTACTACCGTCACCTTCACAGCTAAGAAAAAGCA
AGTAAGAGGAGTCGCCGGAGGAGGAGGAGGCCTGAGGATCGCGGCGAACGAGC
CCTCGACCACCAGGGAGCTGAGGAACCGGATCTTCCCCACTCTTTATGCCATTTT
TCAGCAGAGTCGAGGTCAGCAGCAAGAGCTCAAAGTAAAAAATCGGTCTCTGCG
CTCGCTCACCCGCAGTTGCTTGTACCACAAAAACGAAGATCAGCTGCAGCGCAC
TCTCGAAGACGCCGAGGCTCTGTTCCACAAGTACTGCGCGCTCACTCTTAAAGAC
TAAGGCGCGCCCACCCGGAAAAAAGGCGGGAATTACCTCATCGCCACCATGAGC
AAGGAGATTCCCACCCCTTACATGTGGAGCTATCAGCCCCAGATGGGCCTGGCC
GCGGGCGCCTCCCAGGACTACTCCACCCGCATGAACTGGCTCAGTGCCGGCCCC
TCGATGATCTCACGGGTCAACGGGGTCCGCAGTCATCGAAACCAGATATTGTTG
GAGCAGGCGGCGGTCACCTCCACGCCCAGGGCAAAGCTCAACCCGCGTAATTGG
CCCTCCACCCTGGTGTATCAGGAAATCCCCGGGCCGACTACCGTACTACTTCCGC
GTGACGCACTGGCCGAAGTCCGCATGACTAACTCAGGTGTCCAGCTGGCCGGCG
GCGCTTCCCGGTGCCCGCTCCGCCCACAATCGGGTATAAAAACCCTGGTGATCC
GAGGCAGAGGCACACAGCTCAACGACGAGTTGGTGAGCTCTTCGATCGGTCTGC
GACCGGACGGAGTGTTCCAACTAGCCGGAGCCGGGAGATCGTCCTTCACTCCCA
ACCAGGCCTACCTGACCTTGCAGAGCAGCTCTTCGGAGCCTCGCTCGGAGGCA
TCGGAACCCTCCAGTTCGTGGAGGAGTTTGTGCCCTCGGTCTACTTCAACCCCTT
CTCGGGATCGCCAGGCCTCTACCCGGACGAGTTCATACCGAACTTCGACGCAGT
GAGAGAAGCGGTGGACGGCTACGACTGAATGTCCCATGGTGACTCGGCTGAGCT
CGCTCGGTTGAGGCATCTGGACCACTGCCGCCGCCTGCGCTGCTTCGCCCGGGA
GAGCTGCGGACTCATCTACTTTGAGTTTCCCGAGGAGCACCCCAACGGCCCTGC
ACACGGAGTGCGGATCACCGTAGAGGGCACCACCGAGTCTCACCTGGTCAGGTT
CTTCACCCAGCAACCCTTCCTGGTCGAGCGGGACCGGGGCGCCACCACCTACAC
CGTCTACTGCATCTGTCCAACCCCGAAGTTGCATGAGAATTTTTGTTGTACTCTTT
GTGGTGAGTTTAATAAAAGCTGAACTAAGAACCTACTTTGGAATCCCTTGTCGTC
ATCCTCGAAACAAGACCGTCTTCTTTACCAACCAGACCAAGGTTCGTCTGAACTG
TACAACCAACAGGAAGTACCTTCTCTGGACTTTCCAAAACACCTCACTCGCTGTT
GTCAATACCCGTGACGACGACGGTGTTTTAATCCCCAACAACCTCACTAGTGGA
CTTACTTACAGTACCAGAAAAACTAAGCTCGTCCTCCACAAACCTTTTGTAGAGG
GAACCTACCAGTGCCGACACGGACCTTGTGTTCACACATTCCACTTGGTGAACCT
TACCAGCAGCAGCACAGTTGCTCCTGAAACAACTAACCTTTCTTCTGATACTAAC
AAACCTCGTGTCGGAGGTGAGCTTTGGGTTCCATCTCTAACAGAGGGTGGGAGT
TCTATTGAAGTGGTTGGGTATTTGATTTTAGGGGTGGTACTGGGTGGGTGCATAG
CAGTGCTGTATCAACTTCCTTGCTGGGTCGAAATCAGGGTATTTATCTGCTGGGT
CAGACATTGTGGGGAGGAACCATGAAGGGGCTCTTGCTGATTATCCTTTCCCTGG
TGGGGGGTGTACTGTCATGCCACGAACAGCCACGATGTAACATCACCACAGGCA
ATGAGAGAAGCGAATGCTCTGTAGTCATCAAATGTGAGCACAAATGTTCTCTCA
ACATTACATTCAAGAATAAGACTATGGGAAATGTCTGGGTGGGATTCTGGCAAC
CAGGAGATGAGCAGAACTACACGGTCACTGTCCATGGTAGCGATGGAAATCACA
GTTTCGGTTTCAAATTCATTTTTGAAGTCATGTGTGATATCACACTGCATGTGGCT
AGACTTCATGGCTTGTGGCCCCCTACCAAGGAGAACATGGTTGGGTTTTCTTTGG
CTTTTGTGATCATGGCCTGCTTTATGTCAGGTCTGCTGGTAGGGGCTCTAGTGTG
GTTCCTGAAACGCAAGCCCAGGTACGGAAATGAGGAGAAGGAAAAATTGCTAT
AAATTCTTTTTCTCTTCGCAGAACCATGAATACTTTGACCAGTGTCGTGCTGCTCT
CTCTTCTTGTGGTTTTTAGTCAGGGAAAAATAGATAGTGAAGATATTATTGGTCA
TTGGGGTAAAAATATAACACTAGTTGGACCGACAGAAAAACCTATTGAATGGCA
TGGACCAAGAGTTCAGCTTTGCGATGGTCCAAAAATCTTACATCCAGAATTTAAT
CACACCTGTAATGAACAGAATCTCACTCTGATATTCTTGAACAACACTTTTAATG
GGAGGTACTATGGTATTATTGATTAATGTGAATGAAACCTATGCTGGAACTTATT
ATGGTTCTAACAATGACGACCATAGACAGTATAGAGTCACTGTCTATACAATAC
CGCGTAATAAAACTGTTAAAATTCAACCTCATACCACAAAAGGAACCACAGGGG
GTGCCACAGTTAATGAACAGTTTGCTCTGCAACAAGGTAATGATAAAACCAATC
AAGATGATGAACAAATTCCATCAACTACTGTGGCAATCGTGGTGGGTGTGATTG
CGGGCTTCATAACTATAATCATTGTCATTCTGTGCTACATCTGCTGCCGCAAGCG
TCCCAGGTCATACAATCATATGGTAGACCCACTACTCAGCTTCTCTTACTGAAAC
TCAGTCACTCTCATTTCAGAACCATGAAGGCTTTCACAGCTTGCGTTCTGATTAG
CATAGTCACACTTAGTTCAGCTGGTTATATTCAAGTTAATGTGACTAGAGGTGGG
AACATTACATTGAATGGACCACTACAAAATACTACATGGCTAAGATACCATCTA
AATGGTTGGCAACATATCTGTACATGGTCTGGTCCGTCATATAAGTGCCATACTA
ATAATGGAAGCATTACAATTTTGCTATTAACATCACTTCTGGAACTTATAAAGC
TGAAGGATATAAAAAGAGGTTAGGACTTTCTCATCTACAAATCAAAAACATAC
AATTGAAGATTCTGGTGATTATGAAGAACATAAAATACTTTTATATAATTTAACA
```

TABLE 7-continued

Nucleic Acid Sequences of Vectors

| SEQ ID NO | Sequence |
|---|---|
| | ATAATTGAACTGCCGACCACTAAAGCACCCACGACAGTTAGGACAACTAGGGAA |
| | ACAACCACACAGCCTACTACAAAGCCAACTACCAGTCCAACAACACAGCCTACT |
| | ACAGTTAGTACAACTATGGAGGACACTACTCACACTACAGTACAGAATAGTACT |
| | GTGTTAGTTAGGTTTTTGTTGAGGGAGGAAAGTACTACTGAACAAACAGAGGCT |
| | ACCTCAAGTGCCTTCAGCAGCACTGCAAATTTAACTTCGCTTGCTTCAATAAATG |
| | AGACCCTCGTGCCGATGAAACAGGATCAACCTAATTACTCAGGTTTGGATATGC |
| | AAATTACTTTCTTAATTGTCTGTGGGGTCTTTATTCTTGTGGTTCTTCTTTACTTTG |
| | TCTTTTGCAAAGCCAGACAAAAAGCTCATAGAACAATCTACAGGCCAGTGATCG |
| | GGGAACCCCAGCCACTCCAAGTGGATGGAGGCTTAAGGAATCTTCTTTTCTCTTT |
| | TACAGTATGGTGATCAGCCATGATTCCTAGGTTTTTCCTATTTAACATCCTTTTCT |
| | GTCTCTTCAACATCTGCGCTGCATTTGCGGCCGTCTCGCACGCCTCGCCCGACTG |
| | TCTCGGGCCCTTCCCAACCTACCTCCTCTTTGCCCTGCTCACCTGCACCTGCGTCT |
| | GCAGCATTGTCTGCCTGGTCGTCACCTTCCTGCAGCTCATCGACTGGTGCTGCGC |
| | GCGCTACAATTATCTCCACCACAGTCCCGAATACAGGGACGAGAACGTAGCCAG |
| | AATCTTAAGGCTCATATGACCATGCAGACTCTGCTCATACTGCTATCCCTCCTAT |
| | CCCCTGCCCTTGCTGCTGATGATTACTCTAAGTGCAAATTTGTGGAACTATGGAA |
| | TTTCTTAGACTGCTATGATGCTAAAATTGATATGCCTTCCTATTACTTGGTAATTG |
| | TGGGAATAGTCATGGTCTGCTCCTGCACTTTCTTTGCCATCATGATCTACCCCTGT |
| | TTTGATCTCGGCTGGAACTCTGTTGAGGCATTCACATACACACTAGAAAACAGTT |
| | CACTAGCCTCCACGCCACCACCCACACCGCCTCCCCGCAGAAATCAGTTCCCCCT |
| | GATTCAGTACTTAGAAGAGCCCCCTCCCCGGCCCCCTTCCACTGTTAGCTACTTT |
| | CACATAACCGGCGGCGATGACTGACCACCACCTGGACCTTGAGATGGACGGCCA |
| | GGCCTCCGAGCAGCGCATCCTGCAACTGCGCGTCCGTCAGCAGCAGGAGCGGGC |
| | CGCCAAGGAGCTACTCGATGCCATCAATATCCACCAGTGCAAGAAGGGCATCTT |
| | CTGCCTGGTCAAACAGGCAAAGATCACCTACGAGCTCGTGTCCGGCGGCAAGCA |
| | GCATCGCCTCGCCTATGAGCTGCCCCAGCAGAAGCAGAAGTTCACCTGCATGGT |
| | GGGCGTCAACCCCATAGTCATCACCCAGCAGTCGGGCGAGACCAGCGGCTGCAT |
| | CCACTGCTCCTGCGAAAGCCCCGAGTGCATCTACTCCCTCCTCAAGACCCTTTGC |
| | GGACTTCGCGACCTCCTCCCCATGAACTGATTGATTAAAGCCCAAAAACCAATC |
| | AAACCCCATTCCCCAATACCCCAAATAAACAATCATTGGAAATAATCATTCAAT |
| | AAAGATCACTTACTTGAAATCTGAAAGTATGTCTCTGGTGTAGTTGTTCAGCAGC |
| | ACCTCGGTCCCTCCTCCCAGCTCTGGTACTCCAGTCCCCGGCGGGCGGCAAACT |
| | TCCTCCACACCTTGAAAGGGATGTCAAATTCCTGGTCCACAATTTTCATTGTCTT |
| | CCCTCTCAGATGTCAAAGAGGCTCCGGGTGGAAGATGACTTCAACCCCGTCTAC |
| | CCCTATGGCTACGCGCGGAATCAGAATATCCCCTTCCTCACTCCTCCCTTTGTCTC |
| | CTCCGATGGATTCCAAAACTTCCCCCCAGGGGTCCTGTCACTCAAACTGGCTGAC |
| | CCAATCGCCATCGTCAACGGGAATGTCTCACTCAAGGTGGGAGGGGGCTCACC |
| | TTGCAAGAAGGAACTGGGGACCTAAAGGTGAACGCTAAGTCCCCATTGCAAGTT |
| | GCAACTAATAAACAGTTGGAGATTGCACTTGCTAAACCATTTGAGGAAAAGGAT |
| | GGCAAACTTGCTTTAAAAATTGGCCATGGATTAGCCGTTGTGGATGAAAATCAT |
| | ACTCACTTACAATCACTAATAGGTACACTTGTTATTTTAACTGGCAAGGGAATTG |
| | GTACAGGTAGTGCTGAAAGTGGAGGAACTATAGATGTAAGACTCGGAAGTGGA |
| | GGTGGTTTGTCATTTGATAAAGACGGAAACCTAGTTGCTTGGAACAAAGACAAT |
| | GATAGGCGAACTCTTTGGACCACACCAGATCCTTCTCCAAATTGCAACATTGACC |
| | AAGAAAAGGACTCTAAACTAACATTGGTTCTTACAAAATGTGGAAGTCAGATAC |
| | TGGCTAATATGTCTTTGCTTGTAGTCAAAGGAAAATTTTGCATTATAAATAATAA |
| | GGTTAATGCAACTGATGATTACAAAAAGTTTAGTATCAAGCTGCTATTTGATGCC |
| | AAGGGACGTTTATTGGAAGGATCTAGTTTAGATAAAGCTTATTGGAACTATAGA |
| | AGCGTTAATAACAACATAGGTACAGCTTATGAAGAAGCTGTTGGTTTTATGCCA |
| | AACACAACAGCATACCCAAAACTGCCTAATCCTCCAACTTCATCTACCACTCCTA |
| | TAGAAAAAAGCCGGTCAAAAAACAAATACGTTAGTAATCTCTACCTTGGTGGAC |
| | AAGCTGGAAACCCAGTGGCTACAACTATTAGTTTTAATGAAGAAATTGATGATA |
| | CATGTGCTTATTCTATCAGATTTGATTTTGCTTGGAATAAGACATATGAAAATGT |
| | GCAGTTTGATTCCTCTTTTTTAACTTTCTCATATATTGCTCAAGAATGAAAGACCA |
| | ATAAACGTTTTTCATTTGAAATTTTCATGTATCTTTATTGATTTTTACACCAGCAC |
| | GGGTAGTCAGCCTCCCACCACCAGCCCATTTCACAGTGTAAACAATTCTCTCAGC |
| | ACGGGTGGCCTTAAATAGGGGAATATTATTATTGGAACGGGAACTAGATTTAGT |
| | GTCTATAATCCACACAGTTTCCTGGCGAGCCAAACGGGGGTCGGTGATTGAGAT |
| | GAAGCCGTCCTCTGAGAAGTCATCCAAGCGGGCCTCACAGTCCAAGGTCACAGT |
| | CTGGTGAACGAGAAGAACGCACAGATTCATACTCGGAAAACAGGATGGGTCT |
| | GTGCCTCTCCATCAGCGCCCTCAACAATCTTTGCCGCCGGGGCTCGGTGCGGCTG |
| | CTGCAGATGGGATCGGGATCGCAAGTCTCTCTGACTATGATCCCCACAGCCTTCA |
| | GCATCAGTCTCCTGGTGCGACGGGCACAGCACCGCATCCTGATCTCTGCCATGTT |
| | CTCACAGTAAGTGCAGCACATAATCACCATGTTATTCAGCAGCCCATAATTCAG |
| | GGTGCTCCAGCCAAAACTCATGTTGGGGATGATGGAACCCACGTGACCATCGTA |
| | CCAGATGCGGCAGTATATCAGGTGCCTGCCCCTCATGAACACACTGCCCATATA |
| | CATGATCTCTTTGGGCATGTCTCTGTTCACAATCTGACGGTACCATGGGAAGCGC |
| | TGGTTGAACATGCACCCGTAAATGACTCTCCTGAACCACACGGCCAGCAGGGTG |
| | CCTCCCGCCCGACACTGCAGGGAGCCGGGGATGAACAGTGGCAATGCAGGATC |
| | CAGCGCTCGTACCCGCTCACCATCTGAGCTCTCACCAAGTCCAGGGTAGCAGGG |
| | CACAGGCACACTGACATACATCTTTTTAAAATTTTTATTTCCTCTGGGTCAGGA |
| | TCATATCCCAGGGGACTGGAAACTCTTGGAGCAGGGTAAAGCCAGCAGCACATG |
| | GTAATCCACGGACAGAACTTACATTATGATAATCTGCATGATCACAATCGGGCA |
| | ACAGGGGATGTTGTTCAGTCAGTGAAGCCCTGGTCTCCTCATCAGATCGTGGTAA |
| | ACGGGCCCTGCGATATGGATGATGGCGCAGCAAGCTGGATTGAATCTCGGTTTG |
| | CATTGTAGTGGATTCTCTTGCGTACCTTGTCGTACTTCTGCCAGCAGAAATGGGC |

TABLE 7-continued

Nucleic Acid Sequences of Vectors

| SEQ ID NO | Sequence |
|---|---|
| | CCTTGAACAGCAGATACCCCTCCTGCGGCCGTCCTTTCGCTGCTGCCGCTCAGTC<br>ATCCAACTGAAGTACATCCATTCTC |
| SEQ ID<br>NO: 1433 | CATCATCAATAATATACCCCACAAAGTAAACAAAAGTTAATATGCAAATGAGCT<br>TTTGAATTTGGGGCGTGGCCGACGCTGATTGGCTGTTGCGACGACGGTTACTGAC<br>GTCATGACGCACGGCGTCAACGGTCGCCGCGGAGGCGTGGCCTAGCCCGGAAGC<br>AAGTCGCGGAGCTGATGACGTATAAAAAAGCGGACTTTAGACCCGGAAACGGC<br>CGATTTTCCCGCGACCACGCCCGGATATGAGGTAATTCTGGGCGGATGCAAGTG<br>AAATTAGGTCATTTTGGCGCGAAAACTGAATGAGGAAGTGAAAAGTGAAAAAT<br>ACCGGTCCCGCCCAGGGCGGAATATTTACCGAGGGCCGAGAGACTTTGACCGAT<br>TACGTGGGGGTTTCGATTGCGGTGTTTTTTTCGCGAATTTCCGCGTCCGTGTCAA<br>AGTCCGGTGTTTATGTCACAGATCAGCTGATCCACAGGGTATTTAAACCAGTCGA<br>GCCCGTCAAGAGGCCACTCTTGAGTGCCAGCGAGTAGAGATTTCTCTGAGCTCC<br>GCTCCCAGAGTCTGAGAAAAATGAGACACCTGCGCCTCCTGCCTGGAACTGTGC<br>CTATGGACATGGCTGTGCTTTTACTGGATGACTTTGTGAATACAGTATTGGAGGA<br>CGAACTGCATCCAAGTCCGTTCGAGCTGGGACCCACACTTCAGGACCTTTATGAT<br>CTGGAGGTAGATGCCCATGATGACGACCCGAACGAAGAGGCTGTGAATTTAATA<br>TTTCCAGAATCTATGATTCTTCAGGCTGACATAGCCAACGAATCTATACCTACTC<br>CACTTCATACACCGACTCTACCACCCATACCTGAATTGGAAGAGGAGGACGAAC<br>TAGACCTCCGGTGTTATGAGGAAGGTTTTCCTCCCAGCGATTCAGAGGACGAAC<br>GGGGTGAGCAGAGTATGGCTATAATCTCAGACTATGCTTGTGTGGTTGTGGAAG<br>AGCATTTTGTGTTGGACAATCCTGAGGTGCCAGGGCAAGGCTGTAGATCCTGCC<br>AATATCACCGGGATCAGACCGGAGACCCAAATGTTTCCTGCGCTCTGTGTTACAT<br>GAAAATGAGCTTCAGCTTTATTTACAGTAAGTGGAGTGAATGTGAGAGAGGCTG<br>AGTGCTTAACACATAACTGTAATGCTTGAACAGCTGTGCTAAGTGTGGTTTATTT<br>TTGTTACTAGGTCCGGTGTCAGAGGATGAGTCATCACCCTCAGAAGAAGACCAC<br>CCGTCTCCCCTGAGCTGTCAGGCGAAACGCCCCTGCAAGTGCACAGACCCACC<br>CCAGTCAGACCCAGTGGCGAGAGGCGAGCGGCTGTTGACAAAATTGAGGACTTG<br>TTGCAGGACATGGGTGGGGATGAACCTTTGGACCTGAGCTTGAAACGCCCCAGG<br>AACTAGGCGCAGCTGCGCTTAGTCATGTGTAAATAAAGTTGTACAATAAAAGTA<br>TATGTGACGCATGCAAGGTGTGGTTTATGACTCATGGGCGGGCTTAGTCCTATA<br>TAAGTGGCAACACCTGGGCACTCGGGCACAGACCTTCAGGGAGTTCCTGATGGA<br>TGTGTGGACTATCCTTGCAGACTTTAGCAAGACACGCCGGCTTGTAGAGGATAG<br>TTCAGACGGGTGCTCCGGGTTCTGGAGACACTGGTTTGGAACTTCCTCTATCTCGC<br>CTGGTGTACACAGTTAAGAAGGATTATAACGAGGAATTTGAAATCTTTTTGCTG<br>ACTGCTCTGGCCTGCTAGATTCTCTGAATCTTGGCCACCAGTCCCTTTTCCAGGA<br>AAGGGTACTCCACAGCCTTGATTTTTCCAGCCCAGGGCGCACTACAGCCGGGGT<br>TGCTTTTGTGGTTTTTCTGGTTGACAAATGGAGCCAGGACACCCAACTGAGCAGG<br>GGCTACATCCTGGACTTCGCAGCCATGCACCTGTGGAGGTCCTGGATCAGGCAG<br>CGGGGACAGAGAATCTTGAACTACTGCTTCTACAGCCAGCAGCTCCGGGTCTT<br>CTTCGTCTACACAGACAAACATCCATGTTGGAGGAAGAAATGAGGCAGGCCATG<br>GACGAGAACCCGAGGAGCGGCCTGGACCCTCCGTCGGAAGAGGAGCTGGATTG<br>AATCAGGTATCCAGCCTGTACCCAGAGCTTAGCAAGGTGCTGACATCCATGGCC<br>AGGGGAGTGAAGAGGGAGAGGAGCGATGGGGGCAATACCGGGATGATGACCGA<br>GCTGACGGCCAGCCTGATGAATCGCAAGCGTCCAGAGCGCATTACCTGGCACGA<br>GCTACAGATGGAGTGCAGGGATGAGGTGGGCCTGATGCAGGATAAATATGGCCT<br>GGAGCAGATAAAAACCCATTGGTTGAACCCAGATGAGGATTGGGAGGAGGCCA<br>TTAAGAAATATGCCAAGATAGCCCTGCGTCCAGATTGCAAGTACAGGGTGACCA<br>AGACGGTGAATATCAGACATGCCTGCTACATCTCGGGGAACGGGGCAGAGGTGG<br>TCATCGATACCCTGGACAAGGCCGCCTTCAGGTGTTGCATGATGGGAATGAGAG<br>CAGGAGTGATGAATATGAATTCCATGATCTTCATGAACATGAAGTTCAATGGAG<br>AGAAGTTTAATGGGGTGCTGTTCATGGCCAACAGCCACATGACCCTGCATGGCT<br>GCAATTTCTTCGGCTTCAACAATATGTGCGCAGAGGTCTGGGGCGCCGCTAAGA<br>TCAGGGGATGTAAGTTTTATGGCTGCTGGATGGGCGTGGTCGGAAGACCCAAGA<br>GCGAGATGTCTGTGAAGCAGTGTGTGTTTGAGAAATGCTACCTGGCAGTCTCTAC<br>CGAGGGCAATGCTAGAGTGAGACACTGCTCTTCCCTGGAGACGGGCTGCTTCTG<br>CCTGGTGAAGGGCACAGCCTCTCTGAAGCATAATATGGTGAAGGGCTGCACGGA<br>TGAGCGCATGTACAACATGCTGACCTGCGACTCGGGGGTCTGCCATATCCTGAA<br>GAACATCCATGTGACCTCCCACCCCAGAAAGAAGTGGCCAGTGTTTGAGAATAA<br>CCTGCTGATCAAGTGCCATATGCACCTGGGCGCCAGAAGGGGCACCTTCCAGCC<br>GTACCAGTGCAACTTTAGCCAGACCAAGCTGCTGTTGGAGAACGATGCCTTCTCC<br>AGGGTGAACCTGAACGGCATCTTTGACATGGATGTCTCGGTGTACAAGATCCTG<br>AGATACGATGAGACCAAGTCCAGGGTGCGCGCTTGCGAGTGCGGGGGCAGACA<br>CACCAGGATGCAGCCAGTGGCCCTGGATGTGACCGAGGAGCTGAGACCCGACCA<br>CCTGGTGATGGCCTGTACCGGGACCGAGTTTAGCTCCAGTGGGAGGACACAGA<br>TTAGAGGTAGGTTTTTGAGTAGTGGGCGTGGCTAATGTGAGTATAAAGGCGGGT<br>GTCTTACGAGGGTCTTTTTGCTTTCTGCAGACATCATGAACGGGACCGGCGGGG<br>CCTTCGAAGGGGGCTTTTTAGCCCTTATTTGACAACCCGCCTGCCGGGATGGGC<br>CGGAGTTCGTCAGAATGTGATGGGATCTACGGTGGATGGGCGCCCAGTGCTTCC<br>AGCAAATTCCTCGACCATGACCTACGCGACCGTGGGGAGCTCGTCGCTCGACAG<br>CACCGCCGCAGCCGCGGCAGCAGCAGCCGCCATGACAGCGACGGACGAGCTGCCTC<br>GAGCTACATGCCCAGCAGCAGCAGTAGCCCCTCTGTGCCCAGTTCCATCATCGCC<br>GAGGAGAAACTGCTGGCCCTGCTGCCGAGCTGGAAGCCCTGAGCCGCCAGCTG<br>GCCGCCCTGACCCAGCAGGTGTCCGAGCTCCGCGAGCAGCAGCAGCAAAATAAA<br>TGATTCAATAAACACAGATTCTGATTCAAACAGCAAAGCATCTTTATTATTTATT<br>TTTTCGCGCGCGGTAGGCCCTGGTCCACCTCTCCCGATCATTGAGAGTGCGGTGG |

TABLE 7-continued

Nucleic Acid Sequences of Vectors

SEQ ID NO Sequence

ATTTTTTCCAGGACCCGGTAGAGGTGGGATTGGATGTTGAGGTACATGGGCATG
AGCCCGTCCCGGGGGTGGAGGTAGCACCACTGCATGGCTTCGTGCTCTGGGGTC
GTGTTGTAGATGATCCAGTCATAGCAGGGGCGCTGGGCGTGGTGCTGGATGATG
TCTTTGAGGAGGAGACTGATGGCCACGGGGAGCCCCTTGGTGTAGGTGTTGGCG
AAGCGGTTGAGCTGGGAGGGATGCATGCGGGGGGAGATGATGTGCAGTTTGGCC
TGGATCTTGAGGTTGGCGATGTTGCCGCCCAGATCCCGCCGGGGGTTCATGTTGT
GCAGGACCACCAGGACGGTGTAGCCCGTGCACTTGGGGAACTTGTCATGCAACT
TGGAAGGGAATGCGTGGAAGAATTTGGAGACGCCCTTGTGCCCGCCCAGGTTTT
CCATGCACTCATCCATGATGATGGCGATGGGCCCGTGGGCTGCGGCTTTGGCAA
AGACGTTTCTGGGGTCAGAGACATCATAATTATGCTCCTGGGTGAGATCATCATA
AGACATTTTAATGAATTTGGGGCGGAGGGTGCCAGATTGGGGGACGATGGTTCC
CTCGGGCCCCGGGGCGAAGTTTCCCTCACAGATCTGCATCTCCCAGGCTTTCATC
TCGGAGGGGGGATCATGTCCACCTGCGGGGCAATGAAAAAAACGGTTTCCGGG
GCGGGGGTGATGAGCTGCGAGGAGAGCAGGTTTCTCAACAGCTGGGACTTGCCG
CACCCGGTCGGACCGTAGATGACCCCGATGACGGGTTGCAGGTGGTAGTTCAAG
GACATGCAGCTGCCGTCGTCCCGGAGGAGGGGGCCACCTCGTTGAGCATGTCT
CTGACTTGGAGGTTTTCCCGGACGAGCTCGCCAAGGAGGCGGTCCCCGCCCAGC
GAGAGCAGCTCTTGCAGGGAAGCAAAGTTTTTCAGGGGCTTGAGCCCGTCGGCC
ATGGGCATCTTGGCGAGGGTCTGCGAGAGGAGCTCCAGGCGGTCCCAGAGCTCG
GTGACGTGCTCTACGGCATCTCGATCCAGCAGACTTCCTCGTTTCGGGGTTGGG
ACGACTGCGACTGTAGGGCACGAGACGATGGGCGTCAGCGCGGCCAGCGTCAT
GTCCTTCCAGGGTCTCAGGGTCCGCGTGAGGGTGGTCTCCGTCACGGTGAAGGG
GTGGGCCCCGGGCTGGGCGCTTGCAAGGGTGCGCTTGAGACTCATCCTGCTGGT
GCTGAAACGGGCACGGTCTTCGCCCTGCGCGTCGGCGAGATAGCAGTTGACCAT
GAGCTGGTAGTTGAGGGCCTCGGCGGCGTGGCCCTTGGCTCGGAGCTTGCCCTT
GGAAGAGCGCCCGCAGGAGGGACAGAGGAGGGACTGCAGGGCGTAGAGCTTTG
GCGCAAGAAAGACGGACTCGGGGGCGAAAGCGTCCGCTCCGCAGTGGGCGCAG
ACGGTCTCGCACTCGACGAGCCAGGTGAGCTCGGGCTGCTCGGGGTCAAAAACC
AGTTTTCCCCCGTTCTTTTTGATGCGCTTCTTACCTCGCGTCTCCATGAGTCTGTG
TCCGCGCTCGGTGACAAACAAGCTGTCGGTGTCCCCGTAGACGGACTTGATTGG
CCTGTCCTGCAGGGGCGTCCCGCGGTCCTCCTCGTAGAGAAACTCGGACCACTCT
GAGACAAAGGCGCGCGTCCACGCCAAGACAAAGGAGGCCACGTGCGAGGGGTA
GCGGTCGTTGTCCACCAGGGGGTCCACCTTTTCCACCGTGTGCAAGCACATGTCC
CCCTCCTCCGCATCCAAGAAGGTGATTGGCTTGTAGGTGTAGGCCACGTGACCG
GGGGTCCCCGACGGGGGGGTATAAAAGGGGCGGGTCTGTGCTCGTCCTCACTC
TCTTCCGCGTCGCTGTCCACGAGCGCCAGCTGTTGGGGTAGGTATTCCCTCTCGA
GAGCGGGCATGACCTCGGCACTCAGGTTGTCAGTTTCTAGAAACGAGGAGGATT
TGATGTTGGCTTGCCCTGCCCGCGATGCTTTTTAGGGAGACTTTCATCCATCTGGTC
AGAAAAGACTATTTTTTTATTGTCAAGCTTGGTGGCGAAGGAGCCATAGAGGGC
GTTTGAGAGAAGCTTGGCGATGGATCTCATGGTCTGATTTTTGTCACGGTCGGCG
CGCTCCTTGGCCGCGATGTTAAGCTGGACATACTCGCGCGCGACACACTTCCATT
CGGGAAAGACGGTGGTGCGCTCGTCGGGCACGATCCTAACGCGCCAGCCACGGT
TATGCAGGGTGACCAGGTCCACGCTGGTGGCCACCTCGCCGCGCAGGGGCTCGT
TGGTCCAGCAGAGTCGCCCGCCCTTGCGCGAGCAGAACGGGGCAGCACATCAA
GCAGATGCTCGTCAGGGGGTCCGCATCGATGGTGAAGATGCCTGGACAGAGTT
CCTTGTCAAAATAATCGATTTTTGAGGATGCATCATCCAAGGCCATCTGCCACTT
GCGGGCGGCCAGTGCTCGCTCGTAGGGGTTGAGGGGCGGACCCCAGGGCATGG
GATGAGTGAGGGCGGAGGCGTACATGCCGCAGATGTCGTAGACATAGATGGGCT
CCGAGAGGATGCCGATGTAGGTGGGATAACAGCGCCCCCCGCGGATGCTGGCGC
GCACATAGTCATACAACTCGTGCGAGGGGGCCAAGAAGGCGGGGCCGAGATTG
GTGCGCTGGGGCTGCTCGGCGCGGAAGACGATCTGGCGAAAGATGGCGTGCGA
GTTGGAGGAGATGGTGGGCCGTTGGAAGATATTTAAAGTGGGCGTGCGGCAAGC
GGACCGAGTCGCGGATGAAGTGCGCGTAGGAGTCTTGCAGCTTGGCGACGAGCT
CGGCGGTGACGAGGACGTCCATGGCGCAGTAGTCCAGCGTTTCGCGGATGATGT
CATAACCCGCCTCTCCTTTCTTCTCCCACAGCTCGCGGTTGAGGGCGTACTCCTC
GTCATCCTTCCAGTACTCCCGGAGCGGGAATCCTCGATCGTCCGCACGGTAAGA
GCCCAGCATGTAGAAATGGTTCACGGCCTTGTAGGGACAGCAACCCTTCTCCAC
GGGGAGGGCGTAAGCTTGTGCGGCCTTGCGGAGCGAGGTGTGCGTCAGGGCGA
AGGTGTCCCTGACCATGACTTTCAAGAACTGGTACTTGAAATCCGAGTCGTCGCA
GCCGCCGTGCTCCCAGAGCTCGAAATCGGTGCGCTTCTTAGAGAGGGGGTTAGG
CAGAGCGAAAGTGACGTCATTGAAGAGAATCTTGCCTGCTCGCGGCATGAAATT
GCGGGTGATGCGGAAAGGGCCCGGGACGGAGGCTCGGTTGTTGATGACCTGGGC
GGCGAGGACGATCTCGTCGAAGCCGTTGATGTTGTGCCCGACGATGTAAAGTTC
CATGAATCGCGGGCGGCCTTTGATGTGCGGCAGCTTTTTGAGTTCCTCGTAGGTG
AGGTCCTCGGGGCATTGCAGGCCGTGTTGCTCGAGCGCCCACTCCTGGAGATGT
GGGTTGGCTTGCATGAAGGAAGCCCAGAGCTCGCGGGCCATGAGGGTCTGGAGC
TCGTCGCGAAAGAGACGGAACTGCTGGCCCACGGCCATCTTTTCTGGGGTGACG
CAGTAGAAGGTGAGGGGGTCCCGCTCCCAGCGATCCCAGCGTAAGCGCACGGCG
AGATCGCGAGCGAGGGCGACCAGCTCGGGGTCCCCTGAGAATTTCATGACCAGC
ATGAAGGGGACGAGCTGCTTGCCAAAGGACCCCATCCAGGTGTAGGTTTCTACA
TCGTAGGTGACAAAGAGCCGCTCCGTGCGAGGATGAGAGCCGATTGGGAAGAA
CTGGATTTCCTGCCACCAGTTGGACGAGTGGCTGTTGATGTGATGAAAGTAGAA
ATCCCGCCGGCGAACCGAGCACTCGTGCTGATGCTTGTAAAAGCGTCCGCAGTA
CTCGCAGCGCTGCACGGGCTGTACCTCATCCACGAGATACACAGCGCGTCCCTT
GAGGAGGAACTTCAGGAGTGGCGGCCCTGGCTGGTGGTTTTCATGTTCGCCTGC
GTGGGACTCACCCTGGGGCTCCTCGAGGACGGAGAGGCTGACGAGCCCGCGCGG

TABLE 7-continued

Nucleic Acid Sequences of Vectors

SEQ ID NO Sequence

```
CAGCCAGGTCCAGATCTCGGCGCGGCGGGGGCGGAGAGCGAAGACGAGGGCGC
GCAGTTGGGAGCTGTCCATGGTGTCGCGGAGATCCAGGTCCGGGGGCAGGGTTC
TGAGGTTGACCTCGTAGAGGCGGGTGAGGGCGTGCTTGAGATGCAGATGGTACT
TGATTTCTACGGGTGAGTTGGTGGCCGTGTCCACGCATTGCATGAGCCCGTAGCT
GCGCGGGGCCACGACCGTGCCGCGGTGCGCTTTTAGAAGCGGTGTCGCGGACGC
GCTCCCGGCGGCAGCGGCGGTTCCGGCCCCGCGGGCAGGGGCGGCAGAGGCAC
GTCGGCGTGGCGCTCGGGCAGGTCCCGGTGCTGCGCCCTGAGAGCGCTGGCGTG
CGCGACGACGCGGCGGTTGACATCCTGGATCTGCCGCCTCTGCGTGAAGACCAC
GGGCCCCGTGACTTTGAACCTGAAAGACAGTTCAACAGAATCAATCTCGGCGTC
ATTGACGGCAGCCTGACGCAGGATCTCTTGCACGTCGCCCGAGTTGTCCTGGTAG
GCGATCTCGGACATGAACTGCTCGATCTCCTCCTCCTGGAGATCGCCGCGGCCCG
CGCGCTCGACGGTGGCGGCGAGGTCATTCGAGATGCGACCCATGAGCTGCGAGA
AGGCGCCCAGGCCGCTCTCGTTCCAGACGCGGCTGTAGACCACGTCCCCGTCGG
CGTCGCGCGCGCGCATGACCACCTGCGCGAGGTTGAGCTCCACGTGCCGCGTGA
AGACGGCGTAGTTGCGCAGGCGCTGGAAGAGGTAGTTGAGGGTGGTGGCGATGT
GCTCGGTGACGAAGAAGTACATGATCCAGCGGCGCAGTGGCATCTCGCTGATGT
CGCCGATGGCCTCCAGCCTTTCCATGGCCTCGTAGAAATCCACGGCGAAGTTGA
AAAACTGGGCGTTGCGGGCCGACACCGTGAGCTCGTCTTCCAGGAGCCGGATGA
CCTCGGCGATGGTGGCGCGCACCTCGCGCTCGAAATCCCCGGGGGCCTCCTCCTC
TTCCTCTTCTTCCATGACGACCTCTTCTTCTATTTCTTCCTCTGGGGCGGTGGTG
GTGGCGGGGCCGACGACGACGGCGGCGCACCGGGAGACGGTCGACGAAGCGC
TCGATCATCTCCCCGCGGCGGCGACGCATGGTTTCGGTGACGGCGCGACCCCGTT
CGCGAGGACGCAGCGTGAAGACGCCGCCGGTCATCTCCCGGTAATGTGGCGGGT
CCCCGTTGGGCAGCGAGAGGGCGCTGACGATGCATCTTATCAATTGCGGTGTAG
GGGACGTGAGCGCGTCGAGATCGACCGGATCGGAGAATCTTTCGAGGAAAGCGT
CTAGCCAATCGCAGTCGCAAGGTAAGCTCAAACACGTAGCAGCCCTGTGGACGC
TGTTAGAATTGCGGTTGCTGATGATGTAATTAAAGTAGGCGTTTTTGAGGCGGCG
GATGGTGGCGAGGAGGACCAGGTCCTTGGGTCCCGCTTGCTGGATGCGGAGCCG
CTCGGCCATGCCCCAGGCCTGGCCCTGACACCGGCTCAGGTTCTTGTAGTAGTCA
TGCATGAGCCTTTCAATGTCATCACTGGCGGAGGCGGAGTCTTCCATGCGGGTG
ACCCCGACGCCCTGAGCGGCTGCACGAGCGCCAGGTCGGCGACGACGCGCTCG
GCGAGGATGGCCTGTTGCACGCGGGTGAGGGTGTCCTGGAAGTCGTCCATGTCG
ACGAAGCGGTGGTAGGCCCCGGTGTTGATGGTGTAGGTGCAGTTGGCCATGAGC
GACCAGTTGACGGTCTGCAGGCCGGGCTGCACGACCTCGGAGTACCTGAGCCGC
GAGAAGGCGCGCGAGTCGAAGACGTAGTCGTTGCAGGTGCGCACGAGGTACTG
GTATCCGACTAGGAAGTGCGGTGGCGGCTGGCGGTAGAGCGGCCAGCGCTGGGT
GGCCGGCGCGCCCGGGGCCAGGTCCTCGAGCATGAGGCGGTGGTAGCCGTAGA
GGTAGCGGGACATCCAGGTGATGCCGGCGGCGGTGGTGGAGGCGCGCGGGAAC
TCGCGGACGCGGTTCCAGATGTTGCGCAGCGGCAGGAAATAGTCCATGGTCGGC
ACGGTCTGGCCGGTGAGACGCGCGCAGTCATTGACGCTCTAGAGGCAAAAACGA
AAGCGGTTGAGCGGGCTCTTCCTCCGTAGCCTGGCGGAACGCAAACGGGTTAGG
CCGCGTGTGTACCCCGGTTCGAGTCCCCTCGAATCAGGCTGGAGCCGCGACTAA
CGTGGTATTGGCACTCCCGTCTCGACCCGAGCCCGATAGCCGCCAGGATACGGC
GGGAGAGCCCTTTTTGCCGGCCGAGTGGGGTCGCTAGACTTGAAAGCGGCCGAAA
ACCCCGCCGGGTAGTGGCTCGCGCCCGTAGTCTGGAGAAGCATCGCCAGGGTTG
AGTCGCGGCAGAACCCGGTTCGAGGACGGCCGCGGCGAGCGGGACTTGGTCACC
CCGCCGATTTAAAGACCCACAGCCAGCCGACTTCTCCAGTTACGGGAGCGAGCC
CCCTTTTTTTCTTTTTGCCAGATGCATCCCGTCCTGCGCCAAATGCGTCCCACCCC
CCCGGCGACCACCGCGACCGCGGCCGTAGCAGGCGCCGGCGCTAGCCAGCCACA
GCCACAGACAGAGATGGACTTGGAAGAGGGCGAAGGGCTGGCGAGACTGGGGG
CGCCGTCCCCGGAGCGACATCCCCGCGTGCAGCTGCAGAAGGACGTGCGCCCGG
CGTACGTGCCTGCGCAGAACCTGTTCAGGGACCGCAGCGGGGAGGAGCCCGAG
GAGATGCGCGACTGCCGGTTTCGGCGGGCAGGGAGCTGTGCGAGGGCCTGGAC
CGCCAGCGCGTGCTGCGCGATGAGGATTTCGAGCCGAACGAGCAGACGGGGATC
AGCCCCGCGCGCGCACGTGGCGGCGGCCAACCTGGTGACGGCCTACGAGCAG
ACGGTGAAGCAGGAGCGCAACTTCCAAAAGAGTTTCAACAACACGTGCGCACC
CTAATCGCGCGCGAGGAGGTGGCCCTGGGCCTGATGCACCTGTGGGACCTGGCG
GAGGCCATCGTGCAGAACCCGGACAGCAAGCCTCTGACGGCGCAGCTGTTCCTG
GTGGTGCAGCACAGCAGGGACAACGAGGCGTTCAGGGAGGCGCTGCTGAACAT
CGCCGAGCCCGAGGGTCGCTGGCTGCTGGAGCTGATTAACATCTTGCAGAGCAT
CGTAGTGCAGGAGCGCAGCTTGAGCCTCGCCGAGAAGGTGGCGGCGATCAACTA
CTCGGTGCTGAGCCTGGGCAAGTTTTACGCGCGCAAGATTTACAAGACGCCGTA
CGTGCCCATAGACAAGGAGGTGAAGATAGACAGCTTTTACATGCGCATGGCGCT
CAAGGTGCTGACGCTGAGCGACGACCTGGGCGTGTACCGCAACGACCGCATCCA
CAAGGCCGTGAGCACGAGCCGGCGGCGCGAGCTGAGCGACCGCGAGCTGATGT
TGAGCCTGCGCCGGGCGCTGGTAGGGGCGCCGCCGGCGGCGATGAGTCCTACT
TCGACATGGGGGCGGACCTGCATTGGCAGCCGAGCCGGCGCGCCTTGGAGGCCG
CCTACGGTCCCGAGGACTTGGATGAGGAAGAGGAAGAGGAGGAGGATGCACCC
GTTGCGGGGTACTGACGCCTCCGTGATGTGTTTTTAGATGTCCCAGCAAGCCCCG
GACCCCGCCATAAGGGCGGCGCTGCAAAGCCAGCCGTCCGGTCTAGCATCGGAC
GACTGGGAGGCCGCGATGCAACGCATCATGGCCCTGACGACCCGCAACCCCGAG
TCCTTTAGACAACAGCCGCAGGCCAACAGACTCTCGGCCATTCTGGAGGCGGTG
GTCCCATCTCGGACCAACCCCACGCACGAGAAGGTGCTGGCGATCGTGAACGCG
CTGGCGGAGAACAAGGCCATCCGTCCCGACGAGGCCGGGCTGGTGTACAACGCC
CTGCTGGAACGCGTGGGCCGCTACAACAGCACGAACGTGCAGTCCAACCTGGAC
CGGCTGGTGACGGACGTGCGCGAGGCCGTGGCGCAGCGCGAGCGGTTCAAGAA
```

TABLE 7-continued

Nucleic Acid Sequences of Vectors

SEQ ID NO Sequence

```
CGAGGGCCTGGGCTCGCTGGTGGCGCTGAACGCCTTCCTGGCGACGCAGCCGGC
GAACGTGCCGCGCGGGCAGGACGATTACACCAACTTTATCAGCGCGCTGCGGCT
GATGGTGACCGAGGTGCCCCAGAGCGAGGTGTACCAGTCGGGCCCGGACTACTT
TTTCCAGACGAGCCGGCAGGGCTTGCAGACGGTGAACCTGAGTCAGGCTTTCAA
GAACCTGCGCGGGCTGTGGGGCGTGCAGGCGCCCGTGGGCGACCGGTCGACGGT
GAGCAGCTTGCTGACGCCCAACTCGCGGCTGCTGCTGCTGCTGATCGCGCCCTTC
ACCGACAGCGGCAGCGTGAACCGCAACTCGTACCTGGGCCACCTGCTGACGCTG
TACCGCGAGGCCATAGGCCAGGCGCAGGTGGACGAGCAGACCTTCCAGGAGAT
CACGAGCGTGAGCCGCGCGCTGGGCCAGAACGACACCGACAGTCTGAGGGCCA
CCCTGAACTTTTTGCTGACCAATAGACAGCAGAAGATCCCGGCGCAGTACGCAC
TGTCGGCCGAGGAGGAGCGCATCCTGAGATATGTGCAGCAGAGCGTAGGGCTGT
TCCTGATGCAGGAGGGCGCCACCCCCAGCGCCGCACTGGACATGACCGCGCGCA
ACATGGAACCTAGCATGTACGCCGCCAACCGGCCGTTCATCAATAAGCTGATGG
ACTACCTGCACCGCGCGGCTGCCATGAACACGGACTATTTCACCAACGCCATTCT
GAACCCGCACTGGCTCCCGCCGCCGGGGTTCTACACGGGCGAGTACGATATGCC
CGACCCCAACGATGGGTTCCTGTGGGACGACGTGGACAGCGCGGTGTTCTCGCC
GACCTTGCAAAAGCGCCAGGAGGCGGTGCGCACGCCCGCGAGCGAGGGCGCGG
TGGGGAGGAGCCCCTTTCCTAGCTTAGGGAGTTTGCATAGCTTGCCGGGCTCGGT
GAACAGCGGCAGGGTGAGCCGACCGCGCTTGCTGGGCGAGGACGAGTACCTGA
ACGACTCGCTGCTGCAGCCGCCGCGGGTCAAGAACGCCATGGCCAATAACGGGA
TAGAGAGTCTGGTGGACAAACTGAACCGCTGGAAGACCTACGCTCAGGACCATA
GGGACGCGCCCGCGCCGCGGCGGCAGCGCCACGACCGGCAGCGGGGCCTGGTG
TGGGACGACGAGGACTCGGCCGACGATAGCAGCGTGTTGGACTTGGGCGGGAG
CGGTGGGGCCAACCCGTTCGCGCATCTGCAGCCCAAACTGGGGCGGCGGATGTT
TTGAATGCAAAATAAAACTCACCAAGGCCATAGCGTGCGTTCTCTTCCTTGTTAG
AGATGAGGCGCGCGGTGGTGTCTTCCTCTCCTCCTCCCTCGTACGAGAGCGTGAT
GGCGCAGGCGACCCTGGAGGTTCCGTTTGTGCCTCCGCGGTATATGGCTCCTACG
GAGGGCAGAAACAGCATTCGTTACTCGGAGCTGGCTCCGCAGTACGACACCACT
CGCGTGTACTTGGTGGACAACAAGTCGGCGGACATCGCTTCCCTGAACTACCAA
AACGACCACAGCAACTTCCTGACCACGGTGGTGCAGAACAACGATTTCACCCCC
GCCGAGGCCAGCACGCAGACGATAAATTTTGACGAGCGGTCGCGGTGGGGCGGT
GATCTGAAGACCATTCTGCACACCAACATGCCCAATGTGAACGAGTACATGTTC
ACCAGCAAGTTTAAGGCGCGGGTGATGGTGGCTAGGAAGCATCCCAAAGATGTA
GATGCCAGTGATTTAAGCAAGGATATCTTAGAGTATGATTGGTTTGAGTTTACCC
TGCCCGAGGGCAACTTTTCCGAGACCATGACCATAGACCTGATGAACAACGCCA
TCTTGGAAAACTACTTGCAAGTGGGGCGACAAAATGGCGTGCTGGAGAGCGATA
TCGGAGTCAAGTTTGACAGCAGGAATTTCAAGCTGGGCTGGGACCCGGTGACCA
AGCTGGTGATGCCTGGGGTCTACACCTACGAGGCCTTCCACCCGGACGTGGTGC
TGCTACCGGGCTGCGGGGTGGACTTCACCGAAAGCCGCCTGAGCAACCTTCTGG
GCATTCGCAAGAAGCAACCTTTCCAAGAGGGATTCAGAATCATGTATGAGGATC
TAGAAGGTGGCAACATCCCCGCCCTCCTTGATGTGCCCAAGTACTTGGAAAGCA
AGAAGAAAGTTGAAGACGAAACTAAAAATGCAGCTGCGGCTACAGCCGATACA
ACCACTAGGGGTGATACATTTGCAACTCCAGCACAAGAGACAGCAGCTGATAAG
AAGGTAGAAGTCTTGCCCATTGAAAAGGATGAGAGCGGTAGAAGTTACAACCTG
ATCCATGGGACACACGACACGCTGTACCGCAGTTGGTACCTGTCCTATACCTACG
GGGACCCCGAGAAGGGGGTGCAGTCGTGGACGCTGCTCACCACCCCGGACGTCA
CCTGCGGCGCGGAGCAAGTCTACTGGTCGCTGCCGGACCTCATGCAAGACCCCG
TCACCTTCCGCTCCACCCAGCAAGTCAGCAACTACCCCGTGGTCGGCGCTGAGCT
CATGCCCTTCCGCGCCAAGAGCTTTTACAACGACCTCGCCGTCTACTCCCAGCTC
ATCCGCAGCTACACCTCCCTCACCCACGTCTTCAACCGCTTCCCTGACAACCAGA
TCCTCTGCCGCCCGCCCGCGCCCACCATCACCACCGTCAGTGAAAACGTGCCTGC
TCTCACAGATCACGGGACGCTACCGCTGCGCAGCAGTATCCGCGGAGTCCAGCG
AGTGACCGTCACTGACGCCCGTCGCCGCACCTGTCCCTACGTCTACAAGGCCCTG
GGCATAGTCGCGCCGCGCGTGCTTTCCAGTCGCACCTTCTAAAAAATGTCTATTC
TCATCTCGCCCAGCAATAACACCGGCTGGGGTCTTACTAGGCCCAGCACCATGT
ACGGAGGAGCCAAGAAGCGCTCCCAGCAGCACCCCGTCCGCGTCCGCGGCCACT
TCCGCGCTCCCTGGGGCGCATACAAGCGCGGGCGGACTGCCACCGCCGCCGCCG
TGCGCACCACCGTTGACGACGTCATCGACTCGGTGGTCGCCGACGCGCGCAACT
ACACCCCCGCCCCCTCCACCGTGGACGCGGTCATCGACAGCGTGGTGGCCGACG
CGCGCGACTATGCCAGACGCAAGAGCCGGCGGCGACGGATCGCCAGGCGCCAC
CGGAGCACGCCCGCCATGCGCGCCGCCCCGAGCTCTGCTGCGCCGCGCCAGACGC
ACGGGCCGCCGGGCCATGATGCGAGCCGCGCGCCGCGCTGCCACTGCACCCACC
CCCGCAGGCAGGACTCGCAGACGAGCGGCCGCCGCCGCCGCGGCCATCTCT
AGCATGACTAGACCCAGGCGCGGAAACGTGTACTGGGTGCGCGACTCCGTCACG
GGCGTGCGCGTGCCCGTACGCACCCGTCCTCCTCGTCCCTGATCTAATGCTTGTG
TCCTCCCCCGCAAGCGACGATGTCAAAGCGCAAATCAAGGAGGAGATGCTCCA
GGTCGTCGCCCCGGAGATTTACGGACCACCCCAGGCGGACCAGAAACCCCGCAA
AATCAAGCGGGTTAAAAAAAGGATGAGGTGGACGAGGGGGCAGTAGAGTTTG
TGCGCGAGTTCGCTCCGCGGCGACGCGTAAATTGGAAGGGGCGCAGGGTGCAGC
GCGTGTTGCGGCCCGGCACGGCGGTGGTGTTCACGCCCGGCGAGCGGTCCTCGG
TCAGGAGCAAGCGTAGCTATGACGAGGTGTACGGCGACGACGACATCCTGGACC
AGGCGGCGGAGCGGGCGGGCGAGTTCGCCTACGGGAAGCGGTCGCGCGAAGAG
GAGCTGATCTCGCTGCCGCTGGACGAAAGCAACCCCACGCCGAGCCTGAAGCCC
GTGACCCTGCAGCAGGTGCTGCCCCAGGCGGTGCTGCTGCCGAGCCGCGGGGTC
AAGCGCGAGGGCGAGAGCATGTACCCGACCATGCAGATCATGGTGCCCAAGCG
CCGGCGCGTGGAGGACGTGCTGGACACCCGTGAAAATGGATGTGGAGCCCGAGG
```

TABLE 7-continued

Nucleic Acid Sequences of Vectors

SEQ ID NO Sequence

TCAAGGTGCGCCCCATCAAGCAGGTGGCGCCGGGCCTGGGCGTGCAAACCGTGG
ACATTCAGATCCCCACCGACATGGATGTCGACAAAAAACCCTCGACCAGCATCG
AGGTGCAGACCGACCCCTGGCTCCCAGCCTCCACCGCTACCGCCTCCACTTCTAC
CGTCGCCACGGCCACCGAGCCTCCCAGGAGGCGAAGATGGGGTGCCGCCAGCCG
GCTGATGCCCAACTACGTGTTGCATCCTTCCATCATCCCGACGCCGGGCTACCGC
GGCACCCGGTATTACGCCAGCCGCAGGCGCCCAGCCAGCAAACGCCGCCGCCGC
ACCGCCACCCGCCGCCGTCTAGCCCCCGCCCGCGTGCGCCGCGTAACCACGCGC
CGGGGCCGCTCGCTCGTTCTGCCCACCGTGCGCTACCACCCCAGCATCCTTTAAT
CCGTGTGCTGTGATACTGTTGCAGAGAGATGGCTCTCACTTGCCGCCTGCGCATC
CCCGTCCCGAATTACCGAGGAAGATCCCGCCGCAGGAGAGGCATGGCAGGCAG
CGGCCTGAACCGCCGCCGGCGGCGGGCCATGCGCAGGCGCCTGAGTGGCGGCTT
TCTGCCCGCGCTCATCCCCATAATCGCCGCGGCCATTGGCACGATCCCGGGCATA
GCTTCCGTTGCGCTGCAGGCGTCGCAGCGCCGTTGATGTGCGAATAAAGCCTCTT
TAGACTCTGACACACCTGGTCCTGTATATTTTTAGAATGGAAGACATCAATTTTG
CGTCCCTGGCTCCGCGGCACGGCACGCGGCCGTTCATGGGCACCTGGAACGAGA
TCGGCACCAGCCAGCTGAACGGGGGCGCCTTCAATTGGAGCAGTGTCTGGAGCG
GGCTTAAAAATTTCGGCTCGACGCTCCGGACCTATGGGAACAAGGCCTGGAATA
GTAGCACGGGGCAGTTGTTAAGAGAAAAGCTCAAAGACCAGAACTTCCAGCAG
AAGGTGGTGGACGGGCTGGCCTCGGGCATTAACGGGGTGGTGGACATCGCGAAC
CAGGCCGTGCAGCGCGAGATAAACAGCCGCCTGGACCCGCGCCCGCCCGCCGCC
ACGGTGGTGGAGATGGAAGATGCAAGCGCGCATCCTCCTCCCAGGGGCGAGAA
GCGACCGCGGCCCGACGCGGAGGAGACGATCCTGCAGGTGGACGAGCCGCCCT
CGTACGAGGAGGCCGTCAAGGCCGGCATGCCCACCACGCGCATCATCGCGCCGC
TGGCCACGGGTGTAATGAAACCCGCCACCCTTGACCTGCCTCCACCACCCGCGC
CCGCTCCACCAAAGGCAGCTCCGGTTGTGCAGGCCCCCCCGGTGGCGACCGCCG
TGCGCCGCGTCCCCGCCCGCCGCCAGGCCCAGAACTGGCAGAGCACGCTGCACA
GTATCGTGGGCCTGGGAGTGAAAAGTCTGAAGCGCCGCCGATGCTATTGAGAGA
GAGGAAAGAGGACACTAAAGGGAGAGCTTAACTTGTATGTGCCTTACCGCCAGA
GAACGCGCGAAGATGGCCACCCCCTCGATGATGCCGCCAGTGGGCGTACATGCAC
ATCGCCGGGCAGGACGCCTCGGAGTACCTGAGCCCGGGTCTGGTGCAGTTTGCC
CGCGCCACCGACACGTACTTCAGCCTGGGCAACAAGTTTAGGAACCCCACGGTG
GCCCCGACCCACGATGTGACCACGGACCGGTCCCAGCGTCTGACGCTGCGCTTC
GTGCCCGTGGATCGCGAGGACACCACGTACTCGTACAAGGCGCGCTTCACTCTG
GCCGTGGGCGACAACCGGGTGCTAGACATGGCCAGCACTTACTTTGACATCCGC
GGCGTCCTGGACCGCGGTCCCAGTTTCAAACCCTATTCGGGCACGGCTTACAAC
AGCCTGGCCCCAAAAGGTGCCCCCAACTCCAGTCAGTGGGAGCAGAAAAAAACT
ACTGGTGGAGGCAATGACATGGAAACGCATACTTATGGCGTTGCAGCCATGGGT
GGAGAAGACATTACAGAAAAGGGCCTTCAAATTGGCATTGATGAAACTAAAGA
AGAAAATAACAAGATATTTGCAGACAAAACATTCCAACCAGAACCTCAAGTGGG
AGAAGAAACTGGCAGGAAACATTTGTTTTTTATGGCGGTAGAGCTCTTAAGAA
GGACACCAAAATGAAACCATGCTATGGCTCATTTGCCAGACCTACTAATGAAAA
GGGAGGTCAGGCTAAATTTGTACTTGACCAGGAAGGAAAGCCAACTAAAAATCA
TGATATCACAATGGCTTTCTTTGATACTCCTGGTGGACAATTGAATGGAAAAGAT
GAGCTTAAGGCAGACATTGTCATGTACACTGAAAATGTCAACCTGGAAACACCT
GACACGCATGTTGTTTACAAACCTGGAACTTCAGATGACAGTTCAGAAATCAAT
TTGGTTCAACAGTCCATGCCAAATAGACCCAACTACATTGGCTTCAGGGACAAC
TTTGTAGGGCTCATGTATTACAACAGCACTGGTAACATGGGTGTGCTGGCAGGTC
AGGCATCTCAGTTGAATGCTGTGGTGGATTTGCAAGACAGAAACACAGAGCTAT
CTTACCAGCTCTTGCTAGATTCTCTGGGTGACAGAACCAGATACTTTAGCATGTG
GAACTCTGCGGTGGACAGCTATGATCCAGATGTTAGGATCATTGAGAATCACGG
TGTGGAAGATGAACTTCCAAACTATTGCTTCCCATTGGATGGCGCTGGAACTAAT
GCAGTTTACCAAGGTGTAAAAATTACAGATGGAAATGATGGTGATGTCAATGAT
GACTGGGAAAAAGCACCGCAGTATCTGAACGTAATCAGATATGCAAGGGCAA
CATCTATGCCATGGAGATCAACCTCCAGGCCAACCTGTGGAAGAGTTTTCTGTAC
TCGAATGTGGCCCTGTACCTTCCCGACTCATACAAGTACACGCCGGCCAACGTCA
AGCTGCCCACCAACACCAACACCTACGAGTACATGAACGGCCGCGTGGTAGCTC
CCTCACTGGTGGACGCCTACGTCAACATCGGCGCCCGGTGGTCGCTGGACCCCA
TGGACAACGTCAACCCCTTCAACCACCACCGCAACGCTGGCCTGCGCTACCGCT
CCATGCTTCTGGGCAACGGCCGCTACGTGCCCTTCCACATCCAAGTGCCCCAAAA
GTTCTTTGCCATCAAGAACCTGCTCCTGCTCCCGGGCTCCTACACCTACGAGTGG
AACTTCCGCAAGGACGTCAACATGATCCTGCAGAGTTCCCTGGAAACGATCTG
CGCGTCGACGGCGCCTCCGTCCGCTTCGACAGCGTCAACCTCTACGCCACCTTCT
TCCCCATGGCGCACAACACCGCCTCCACCCTGGAAGCCATGCTGCGCAACGACA
CCAACGACCAGTCCTTCAACGACTACCTCTCGGCCGCCAACATGCTCTACCCCAT
CCCGGCCAAGGCCACCAACGTGCCCATCTCCATCCCCTCGCGCAACTGGGCCGC
CTTTCGCGGCTGGAGTTTCACTCGCCTGAAACCAAGGAAACTCCCTCGCTCGGC
TCGGGTTTCGACCCCTACTTTGTCTACTCGGGCTCCATTCCCTACCTCGACGGGA
CCTTCTACCTCAACCACACCTTCAAGAAGGTCTCCATCATGTTCGACTCCTCGGT
CAGCTGGCCCGGCAACGACCGGCTGCTCACGCCGAACGAGTTCGAAATCAAGCG
CAGCGTCGACGGGAGGGCTACAACGTGGCCCAATGCAACATGACCAAGGACT
GGTTCCTCGTCCAGATGCTCTCCCACTACAACATCGGCTACCAGGGCTTCCACGT
GCCCGAGGGCTACAAGGACCGCATGTATTCCTTCTTCCGCAACTTCCAGCCCATG
AGCAGGCAGGTGGTCGATGAGATCAACTACAAGGACTACAAGGCCGTCACCCTG
CCATTCCAGCACAACAACTCGGGTTTCGTCGGCTACCTCGCACCCACCATGCGCC
AGGGGCAGCCCTACCCCGCCAACTTCCCCTACCCGCTCATCGGCCAGACAGCCG
TGCCCTCCGTCACCCAGAAAAAGTTCCTCTGCGACAGGGTCATGTGGCGCATCCC

TABLE 7-continued

Nucleic Acid Sequences of Vectors

SEQ ID NO Sequence

CTTCTCCAGCAACTTCATGTCCATGGGCGCCCTCACCGACCTGGGTCAGAACATG
CTCTACGCCAACTCGGCCCACGCGCTCGACATGACCTTCGAGGTGGACCCCATG
GATGAGCCCACCCTCCTCTATCTTCTCTTCGAAGTTTTCGACGTGGTCAGAGTGC
ACCAGCCGCACCGCGGCGTCATCGAGGCCGTCTACCTGCGCACGCCCTTCTCCGC
CGGAAACGCCACCACATAAGCATGAGCGGCTCCAGCGAAAGAGAGCTCGCGGC
CATCGTGCGCGACCTGGGCTGCGGGCCCTACTTTTTGGGCACCCACGACAAGCG
CTTCCCGGGCTTCCTCGCCGGCGACAAGCTGGCCTGCGCCATCGTCAACACGGCC
GGCCGCGAGACAGGAGGCGTGCACTGGCTCGCCTTCGGCTGGAACCCGCGCTCG
CGCACCTGCTACATGTTCGACCCCTTTGGGTTCTCGGACCGCCGGCTCAAGCAGA
TTTACAGCTTCGAGTACGAGGCTATGTTGCGCCGAAGCGCGCTCGCCTCCTCGCC
CGACCGCTGTCTCAGCCTCGAGCAGTCCACCCAGACCGTGCAGGGGCCCGACTC
CGCCGCCTGCGGACTTTTCTGTTGCATGTTCTTGCATGCCTTCGTGCACTGGCCCG
ACCGACCCATGGACGGGAACCCCACCATGAACTTGCTGACGGGGGTGCCCAACG
GCATGCTACAATCGCCACAGGTGCTGCCCACCCTCAGGCGCAACCAGGAGGAGC
TCTACCGCTTCCTTGCGCGCCACTCCCCTTACTTTCGCTCCCACCGCGCCGCCATC
GAACACGCCACCGCTTTTGACAAAATGAAACAACTGCGTGTATCTCAATAAACA
GCACTTTTATTTTACATGCACTGGAGTATATGCAAGTTATTTAAAAGTCAAAGGG
GTTCTCGCGCTCGTCGTTGTGCGCCGCGCTGGGGAGGGCCACGTTGCGGAACTG
ATACTTGGGCTGCCACTTGAACTCTGGAATCACCAGTTTGGGCACTGGGGTCTCG
GGGAAGGTCTCGCTCCACATGCGCCGGCTCATTTGCAGGGCGCCCAGCATGTCA
GGCGCGGAGATCTTGAAATCGCAGTTGGGGCCGGTGCTCTGCGCGCGAGTTG
CGGTACACGGGGTTGCAGCACTGGAACACCATCAGACTGGGGTACTTCACACTG
GCCAGCACGCTCTTGTCGCTGATCTGATCCTTGTCCAGATCCTCGGCGTTGCTCA
GGCCGAACGGGGTCATCTTGCACAGCTGGCGGCCCAGGAAGGGCACGCTCTGAG
GCTTGTGGTTACACTCGCAGTGCACGGGCATCAGCATCATCCCCGCGCCGCGCTG
CATATTCGGGTAGAGGGCCTTGACAAAGGCCTCGATCTGCTTGAAAGCTTGCTG
GGCCTTGCCCCCCTCGCTGAAGAACAGGCCGCAGCTCTTCCCGCTGAACTGGTTA
TTCCCGCACCCGGCATCCTGCACGCAGCAGCGCGCGTCATGGCTGGTCAGTTGC
ACCACGCTCCGGCCCAGCGGTTCTGGGTCACCTTTGCCTTGCTGGGTTGCTCCT
TCAACGCGCGCTGTCCGTTCTCACTGGTCACATCCATCTCCACCACGTGGTCCTT
GTGGATCATCACCGTCCCATGCAGACACTTGAGCTGGCCTTCCACCTCGGTGCAG
CCGTGATCCCACAGGGCACTGCCGGTGCACTCCCAATTCTTGTGTGCGATCCCGC
TGTGGCTAAAGATGTAACCTTGCAACAGGCGACCCATGATGGTGCTAAAGGTTT
TCTGGGTGGTGAAGGTCAGTTGCATCCCGCGGGCCTCCTCGTTCATCCAGGTCTG
GCACATCTTCTGGAAGATCTCGGTCTGCTCGGGCATGAGCTTGTAAGCATCGCGC
AGGCCGCTGTCGACGCGGTAGCGTTCCATCAGCACGTTCATGGTATCCATGCCCT
TCTCCCAGGACGAGACCAGAGGCAGACTCAGGGGGTTGCGCACGTTCAGGACAC
CGGGGGTCGCGGGCTCGACGATGCGTTTTCCGTCCTTGCCTTCCTTCAGCAGAAC
CGGCGGCTGGCTGAATCCCACTCCCACGATCACGGCTTCTTCCTGGGGCATCTCT
TCGTCGGGGTCTACCTTGGTCACATGCTTGGTCTTTCTGGCTTGCTTCTTTTTTGG
AGGGCTGTCCACGGGGACCACGTCCTCCTCGGAAGACCCGGAGCCCACCCGCTG
ATACTTTCGGCGCTTGGTGGGCAGAGGAGGTGGCGGCGAGGGGCTCCTCTCCTG
CTCCGGCGGATAGCGCGCTGAACCGTGGCCCCGGGGCGGAGTGGCCTCTCGCTC
CATGAACCGGCGCACGTCCTGACTGCCGCCGGCCATTGTTTCCTAGGGGAAGAT
GGAGGAGCAGCCGCGTAAGCAGGAGCAGGAGGAGGACTTAACCACCCACGAGC
AACCCAAAATCGAGCAGGACCTGGGCTTTGAAGAGCCGGCTCGTCTAGAACCCC
CACAGGATGAACAGGAGCACGAGCAAGACGCAGGCCAGGAGGAGACCGACGCT
GGGCTCGAGCATGGCTACCTGGGAGGAGAGGAAGATGTGCTGCTGAAACACTTG
CAGCGCCAATCCATCATCCTCCGGGACGCCCTGGCCGACCGGAGCGAAACCCCC
CTCAGCGTCGAGGAGCTGTGTCGGGCCTACGAGCTCAACCTTTTCTCGCCGCGCG
TGCCCCCCAAACGCCAGCCCAACGGCACCTGCGAGCCCAACCCGCGCCTCAACT
TCTATCCCGTCTTTGCGGTCCCAGAGGCCCTCGCCACCTATCACATCTTTTTCAAG
AACCAAAAGATCCCCGTCTCCTGCCGCGCCAACCGCACCCGCGCCGACGCGCTC
CTCGCTCTGGGCGCCGGCGCGCGCATACCTGATATCGCTTCCCTGGAAGAGGTG
CCCAAGATCTTCGAAGGGCTCGGTCGGGACGAGACGCGCGCGGCGAACGCTCTG
AAAGAAACAGCAGAGGAAGAGGGTCACACTAGCGCCCTGGTAGAGTTGGAAGG
CGACAACGCCAGGCTGGCCGTGCTCAAGCGCAGCGTCGAACTCACCCACTTCGC
CTACCCCGCCGTCAACCTCCCGCCCAAGGTCATGCGTCGCATCATGGATCAGCTC
ATCATGCCCCACATCGAGGCCCTCGATGAAAGTCAGGAGCAGCGCCCCGAGGAC
GCCCGGCCCGTGGTCAGCGACGAGCAGCTAGCGCGCTGGCTCGGGACCCGCGAC
CCCCAGGCTTTGGAACAGCGGCGCAAGCTGATGCTGGCCGTGGTCCTGGTCACC
CTCGAGCTCGAATGCATGCGCCGCTTCTTCAGCGACCCCGAGACCCTGCGCAAG
GTCGAGGAGACCCTGCACTATACTTTAGGCACGGCTTCGTCAGGCAGGCCTGC
AAGATCTCCAACGTGGAGCTGACCAACCTGGTCTCCTGCCTGGGGATCCTGCAC
GAGAACCGCCTGGGGCAGACCGTGCTCCACTCTACCCTGAAGGGCGAGGCGCGT
CGGGACTATGTCCGCGACTGCGTCTTTCTCTTTCTGCCACACATGGCAAGCAG
CCATGGGCGTGTGGCAGCAGTGTCTCGAGGACGAGAACCTGAAGGAGCTGGAC
AAGCTTCTTGCTAGAAACCTTAAAAAGCTGTGGACGGGCTTCGACGAGCGCACC
GTCGCCTCGGACCTGGCCGAGATCGTCTTCCCCGAGCGCCTGAGGCAGACGCTG
AAAGGCGGACTGCCCGACTTCATGAGCCAGAGCATGATACAAAACTACCGCACT
TTCATTCTCGAACGATCTGGGATGCTGCCCGCCACCTGCAACGCTTTCCCCTCCG
ACTTTGTCCCGCTGAGCTACCGCGAGTGTCCCCCGCCGCTGTGGAGCCACTGCTA
CCTCTTGCAGCTGGCCAACTACATCGCCTACCACTCGGACGTGATCGAGGACGT
GAGCGGCGAGGGGCTTCTCGAGTGCCACTGCCGCTGCAACCTGTGCTCCCCGCA
CCGCTCCCTGGTCTGCAACCCCCAGCTCCTAAGCGAGACCCAGGTCATCGGTACC
TTCGAGCTGCAAGGTCCGCAGGAGTCCACCGCTCCGCTGAAACTCACGCCGGGG

TABLE 7-continued

Nucleic Acid Sequences of Vectors

SEQ ID NO Sequence

TTGTGGACTTCCGCGTACCTGCGCAAATTTGTACCCGAGGACTACCACGCCCATG
AGATAAAGTTCTTCGAGGACCAATCGCGGCCGCAGCACGCGGATCTCACGGCCT
GCGTCATCACCCAGGGCGCAATCCTCGCCCAATTGCACGCCATCCAAAATCCC
GCCAAGAGTTTCTTCTGAAAAAGGGTAGAGGGGTCTACCTGGACCCCCAGACGG
GCGAGGTGCTCAACCCGGGTCTCCCCCAGCATGCCGAGGAAGAAGCAGGAGCC
GCTAGTGGAGGAGATGAAGAAGAATGGGACAGCCAGGCAGAGGAGGACGAAT
GGGAGGAGGAGACAGAGGAGGAAGAATTGGAAGAGGTGGAAGAGGAGCAGGC
AACAGAGCAGCCCGTCGCCGCACCATCCGCGCCGGCAGCCCCGGCGGTCACGGA
TACAACCTCCGCAGCTCCGGCCAAGCCTCCTCGTAGATGGGATCGAGTGAAGGG
TGACGGTAAGCACGAGCGGCAGGGCTACCGATCATGGAGGGCCCACAAAGCCG
CGATCATCGCCTGCTTGCAAGACTGCGGGGGGAACATCGCTTTCGCCCGCCGCT
ACCTGCTCTTCCACCGCGGGGTGAACATCCCCCGCAACGTGTTGCATTACTACCG
TCACCTTCACAGCTAAGAAAAAGCAAGTAAGAGGAGTCGCCGGAGGAGGAGGA
GGCCTGAGGATCGCGGCGAACGAGCCCTTGACCACCAGGGAGCTGAGGAACCG
GATCTTCCCCACTCTTTATGCCATTTTTCAGCAGAGTCGAGGTCAGCAGCAAGAG
CTCAAAGTAAAAAACCGGTCTCTGCGCTCGCTCACCCGCAGTTGCTTGTACCACA
AAAACGAAGATCAGCTGCAGCGCACTCTCGAAGACGCCGAGGCTCTGTTCCACA
AGTACTGCGCGCTCACTCTTAAAGACTAAGGCGCGCCCACCCGGAAAAAAGGCG
GGAATTACCTCATCGCCAGCACCATGAGCAAAGAGATTCCCACACCTTACATGT
GGAGCTATCAGCCCCAAATGGGCCTGGCCGCGGGCGCCTCCCAGGACTACTCCA
CCCGCATGAACTGGCTCAGTGCCGGCCCCTCGATGATCTCACGGGTCAACGGGG
TCCGCAGTCATCGAAACCAGATATTGTTGGAGCAGGCGGCGGTCACCTCCACGC
CCAGGGCAAAGCTCAACCCGCGTAATTGGCCCTCCACCCTGGTGTATCAGGAAA
TCCCCGGGCCGACTACCGTACTACTTCCGCGTGACGCACTGGCCGAAGTCCGCAT
GACTAACTCAGGTGTCCAGCTGGCCGGCGGCGCTTCCCGGTGCCCGCTCCGCCC
ACAATCGGGTATAAAAACCCTGGTGATCCGAGGCAGAGGCACACAGCTCAACG
ACGAGTTGGTGAGCTCTTCGATCGGTCTGCGACCGGACGGAGTGTTCCAACTAG
CCGGAGCCGGGAGATCCTCCTTCACTCCCAACCAGGCCTACCTGACCTTGCAGA
GCAGCTCTTCGGAGCCTCGCTCCGGAGGCATCGGAACCCTCCAGTTCGTGGAGG
AGTTTGTGCCCTCGGTCTACTTCAACCCCTTCTCGGGATCGCCAGGCCTCTACCC
GGACGAGTTCATACCGAACTTCGACGCAGTGAGAGAAGCGGTGGACGGCTACG
ACTGAATGTCCCATGGTGACTCGGCTGAGCTCGCTCGGTTGAGGCATCTGGACC
ACTGCCGCCGCCTGCGCTGCTTCGCCCGGGAGAGCTGCGGACTCATCTACTTTGA
GTTTCCCGAGGAGCACCCCAACGGCCCTGCACACGGAGTGCGGATCACCGTAGA
GGGCACCACCGAGTCTCACCTGGTCAGGTTCTTCACCCAGCAACCCTTCCTGGTC
GAGCGGGACCGGGGCGCCACCACCTACACCGTCTACTGCATCTGTCCAACCCCG
AAGTTGCATGAGAATTTTTGTTGTACTCTTTGTGGTGAGTTTAATAAAAGCTGAA
CTAAGAACCTACTTTGGAATCCCTTGTCGTCATCCTCGAAACAAGACCGTCTTCT
TTACCAACCAGACCAAGGTTCGTCTGAACTGTACAACCAACAGGAAGTACCTTC
TCTGGACTTTCCAAAACACCTCACTCGCTGTTGTCAATACCCGTGACGACGACGG
TGTTTTAATCCCCAACAACCTCACTAGTGGACTTACTTACAGTACCAGAAAAACT
AAGCTCGTCCTCCACAAACCTTTTGTAGAGGGAACCTACCAGTGCCGACACGGA
CCTTGTGTTCACACATTCCACTTGGTGAACCTTACCAGCAGCAGCACAGTTGCTC
CTGAAACAACTAACCTTTCTTCTGATACTAACAAACCTCGTGTCGGAGGTGAGCT
TTGGGTTCCATCTCTAACAGAGGGTGGGAGTTCTATTGAAGTGGTTGGGTATTTG
ATTTTAGGGGTGGTACTGGGTGGGTGCATAGCAGTGCTGTATCAACTTCCTTGCT
GGGTCGAAATCAGGGTATTTATCTGCTGGGTCAGACATTGTGGGGAGGAACCAT
GAAGGGGCTCTTGCTGATTATCCTTTCCCTGGTGGGGGTGTACTGTCATGCCAC
GAACAGCCACGATGTAACATCACCACAGGCAATGAGAGAAGCGAATGCTCTGTA
GTCATCAAATGTGAGCACAAATGTTCTCTCAACATTACATTCAAGAATAAGACT
ATGGGAAATGTCTGGGTGGGATTCTGGCAACCAGGAGATGAGCAGAACTACACG
GTCACTGTCCATGGTAGCGATGGAAATCACAGTTTCGGTTTCAAATTCATTTTTG
AAGTCATGTGTGATATCACACTGCATGTGGCTAGACTTCATGGCTTGTGGCCCCC
TACCAAGGAGAACATGGTTGGGTTTTCTTTGGCTTTTGTGATCATGGCCTGCTTT
ATGTCAGGTCTGCTGGTAGGGGCTCTAGTGTGGTTCCTGAAGCGCAAGCCCAGG
TACGGAAATGAGGAGAAGGAAAAATTGCTATAAATCTTTTTCTTTTCGCAGAAC
CATGAAAACTTTGACAAGTGTCGTGCTGCTCTCTCTTTTAGTTATTAATGTGGATT
CGGCAGATCCTATTATAGTTAGTGTAGATTGGGGAAAAAATCTAACATTAGAGG
GGCCTAAAGAAACACCAGTTGAATGGTGGGGTGGGAGAAACATTCAACAACTGT
GCATAGGGAATCAAACCAAACATAAAGAGCTAAGACACACATGTAATATGCAG
AACATAACTTTGCTGTCTGTAAATACTAGTTTTAATGGAGACTATTTTGGCTTTA
AAAATGATAATAGCGGTATGAAACACTATAAAGTTACAGTTATCCCTCCTAAAC
CAACCACTCGGAAACCTTTACCTCCACCACACTATGTCAACGCAACTATGGGTCA
AAACTTAACATTAGTGGGTCCAGCAAACATTCCAGTTACTTGGCTCAGTGAATTT
GGCACCTTGTGTGAGGGTAAAAAAATTTTGCATGAAGAACTTAATCACACCTGT
AACGAACAGAACCTCACGTTGCTGTTTGTTAATATGACACACAACGGGCCATAT
TTTGGTTTTGGCAAAGACAATGTTGACAGAGAGCAGTATGAGGTCTCCATTATTA
GTTTATTCAAAGTAGGAGCGGGGCAAAAAAAAATAGACAAAGGACAAAGGACA
GAAGAGAAACAAAATTCAACTCAGGTGATTTGGGTAGAAAACAATCTAGACCT
AAGAAAAAAGACATTGTTGATGAGGTTCAAGTTAAATCAGGCAATAATCAAACT
CTTATTGGACCACCTGGAAAAAATGTTGATTGGATTAAGCTTTCCAGCGGAAAC
GATGCTGTTGTAACGTTGTGTAAAGGTGACACTTGGATAAAACACACATGCAAT
GGGCCAAATGTAACTTTGATTAATGTCACAAAACCATACGAAGGAAGCTATTAT
GGCTCCAGCGATGATGGTTCAAGTCATTACAAAGTTACTGTGTATGATTTATATA
AATCAAATAAATCCAAGTCTAAGGTCAAACCTTCACTACAAAGGGCACTACAG
TAAATGCAACAAATGCCAATGGCCTCAAAAATGCTTTGCAACAGGAAATTGGTG

TABLE 7-continued

Nucleic Acid Sequences of Vectors

SEQ ID NO Sequence

```
AATCAGAAAATGATCAAGAATCAAAAATTCCATCAGCTACTGTGGCAATCGTGG
TGGGTGTGATTGCGGGCTTTGTAACTCTGATCATTGTCTTCATATGCTACATCTGC
TGCCGCAAGCGTCCCAGGACTTACAATCATATGGTAGACCCACTACTCAGCTTCT
CTTACTGAAACTCAGTCACTCTCATTTCAGAACCATGAAGGCTTTCACAGCTTGC
GTTCTGATTAGCATAGTCACACTTAGTGCAGCTGCTGGTAAATGCTATCATACAG
TTAATGTCACTAGGGGAGGGAATATTACACTTACAGGGGCAGGAATCAACACTA
CATGGACAGCTTATCATAACGATGGAAAGGGGCAAAATGGTTGGTTGCCCATCT
GTACATGGGGCGATCCCATCTATGTGTGCCATGGAAATAGCAGTACTATTTCAA
ATCTTACAGTTGTAGCTCACAAAAATTTAACTGACAGAACTATTAAGGCATATA
GCTATGAGAACAAAGATGATTATGAAACAGTAAATTCATGCTTTTATGTTGTAA
AAGTTGTTGAGCTTCCAACCACTAAAGCGCCCACACAGTCTACTACACATCCAA
CCACCACAGCCAGTACAACTACTGAGACCACTACTCAAACTACACAGCTAGACA
CTACAGTGCAGAATAGTACTGTGTTGGTTAGGTTTTTGTTGAGGGAGGAAAGTA
CTACTGAACAGACAGAGGCTACCTCAAGTGCCTTCAGCAGCACTGCAAATTTAA
CTTCGCTTGCTTCGGTAAATGAGACGATCGTGCCGCTGATGTATGGCCAACATTA
CCCAGGTTTGGATATACAAATTACTTTCCTGATTGTCTGTGGGGTCTTTATCCTCG
CTGTCCTTCTCTACTTTGTCTGCTGCAAGGCCAGAGAAAAATCTAGGCGGCCCAT
CTACAGGCCAGTAATCGGGGAACCTCAGCCACTCCAAGTGGATGGAGGCTTAAG
GAATCTTCTTTTCTCTTTTACAGTATGGTGATCAGCCATGATTCCTAGGTTCTTCC
TATTTAACATCCTCTTCTGTCTCTTCAACGTGTGCGCTGCCTTCGCGGCCGTCTCG
CACGCCTCACCCGACTGTCTCGGGCCCTTCCCCACCTACCTCCTCTTTGCCCTGCT
CACCTGCACCTGCGTCTGCAGCATTGTCTGCCTGGTCATCACCTTCCTGCAGCTC
ATCGACTGGTGCTGCGCGCGCTACAATTACCTACACCACAGTCCCGAATACAGG
GACGAGAACGTAGCCAGAATCTTAAGGCTCATCTGACCATGCAGACTCTGCTCA
TACTGCTATCCCTCCTATCCCCTGTCTTCACAACTTCTGTTGATTACTCTAAATGC
AAAATTCGCTGACATATGGAATTTCTTAGATTGCTATCAGGAGAAAATTGATATGC
CCTCCTATTACTTGGTGATTGTGGGAATAGTCATGGTCTGCTCCTGCACTTTCTTT
GCCATCATGATCTACCCCTGTTTTGATCTCGGCTGGAACTCTGTTGAGGCATTCA
CATACACACTAGAAAGCAGTTCACTAGCCTCCACACCACCACCCACACCGCCTC
CCCGCAGAAATCAGTTCCCCATGATTCAGTACTTAGAAGAGCCCCTCCCCGGCC
CCCTTCCACTGTTAGCTACTTTCACATAACCGGCGGCGATGACTGACAACCACCT
GGACCTCGAGATGGACGGCCAGGCCTCCGAGCAGCGCGTCCTGCAACTGCGCGT
CCGTCAGCAGCAGGAGCGGGCCGCCAAGGAGCTCCTCGATGCCATCAACATCCA
CCAGTGCAAGAAGGGCATCTTCTGCCTGGTCAAACAGGCAAAGATCACCTACGA
GCTCGTGTCCGGCGGCAAGCAGCATCGCCTCGCCTATGAGCTGCCCCAGCAGAA
GCAGAAGTTCACCTGCATGGTGGGCGTCAACCCCATAGTCATCACCCAGCAGTC
GGGCGAGACCAGCGGCTGCATCCACTGCTCCTGCGAAAGCCCCGAGTGCATCTA
CTCCCTGCTCAAAACCCTTTGCGGACTCCGCGACCTCCTCCCCATGAACTGATGT
TGATTAAAAGCCCAAAAACCAATCAGCCCCTTCCCCCATTTCCCCATCCCCCAAT
TACTCATAAAAATAAATCATTGGAACTAATCATTCAATAAAGATCACTTACTTGA
AATCTGAAAGTATGTCTCTGGTGTAGTTGTTCAGCAGCACCTCGGTACCCTCCTC
CCAGCTCTGGTACTCCAATCCCCGGCGGGCGGCGAACTTCCTCCACACCTTGAAA
GGGATGTCAAATTCCTGGTCCACAATTTTCATTGTCTTCCCTCTTAGATGTCAAA
GAGGGCTCCGGGTGGAAGATGACTTCAACCCCGTCTACCCCTATGGCTACGCGCG
GAATCAGAATATCCCCTTCCTCACTCCCCCCTTTGTCTCTTCCGATGGATTCCAAA
ACTTCCCCCCTGGTGTCCTGTCACTCAAACTCGCTGACCCAATCACTATCAACAA
TGGGGATGTCTCGCTCAAGGTGGGAGGGGACTCACTGTTGAACAACAGTCTGG
AAATTTAACTATAGATGCCAAAGCACCTTTGCAAGTTGCAAATGGTAAATTAGA
CATTGCTTTGGCACCACCATTTGAAGTTAAAGATAATAAACTTTCTTTACTAGTT
GGAAATGGACTAAAGGTGATAGATAGATCAGTCTCTGACTTGCCAGGTCTTCTA
AACTACCTTGTAGTATTGACTGGCAAAGGCATCGGAAATGAAGAGATAAAAAAC
GCAGACGGAACAAACAAAGGAGTTGGATTGCGTGTGAGAATCGCAGAAGCAGG
TGGCTTAACATTTGATGATAAAGGTGAATTAGTGGCCTGGTATAAAAACAATGA
TAAGCGCACCCTTTGGACAACTCTGGATCCATCTCCAAATTGCAGAGTTGATGAA
GAAAAGGATTCAAAGTTTACTTTAGTTTTAACAAAGTGTGGAAGTCAGATTCTG
GCTAGTGTATCACTATTGATTGTAAAAGGTAAATTCCAAATTTTAGATCATAAGG
CCAACACTGGCCTTAGTAAAGCTTTTGCAATTAAGTTACTATTTGATGAAAATGG
AGTCCTTAAAGACTCATCAAACATTGACAAGAACTCTTGGAATTATAGAAGCGG
GAATTCTGTTCTGTCAGAGCCATATAAAAATGCAATTGGATTTATGCCAAATTTA
GCAGCGTATCCTAAATCTACAACTTCTGGTTCTAAGATTTATGCAAGAAATACTA
TTTTTGGAAATATTTACTTAGATTCACAAGCATATAATCCAGTGGTTATTAAAAT
TACTTTTAATCAAGAAGCAGATAGTGCTTATTCTATGACTTTTAACTATTCATGG
ACCAAGGATTATGAAAAGTCCCTTTTGATTCTACTTCTTTTAACATTTTGCTATAT
CGCCCAAGAATGAAAGACCAATAAACGTGTTTTTCATTTGAAAATTTTCATGTAT
CTTTATTGATTTTTACACCAGCACGGGTAGTCAATCTCCCACCACCAGCCCATTT
CACAGTGTACACGGTTCTCTCAGCACGAGTGGCCTTAAATAGGGAAATGTTCTG
ATTAGTGCGGGAACTGGACTTGGGATCTATAATCCACACAGTTTCCTGGCGAGC
CAAACGGGGGTCGGTGATTGAGATGAAGCCGTCCTCTGAAAAGTCATCCAAGCG
GGCCTCACAGTCCAAGGTCACAGTCTGGTGGAATGAGAAGAACGCACAGATTCA
TACTCGGAAAACAGGATGGGTCTGTGCCTCTCCATCAGCGCCCTCAACAGTCTCT
GCCGCCGGGGCTCGGTGCGGCTGCTGCAGATGGGATCGGGATCGCAAGTCTCTC
TGACTATGATCCCAACAGCCTTGAGCATCAGTCTCCTGGTGCGTCGGGCACAGC
ACCGCATCCTGATCTCTGCCATGTTCTCACAGTAAGTACAGCACATAATCACCAT
GTTATTCAGCAGCCCATAATTCAGGGTGCTCCAGCCAAAGCTCATGTTGGGGAT
GATGGAACCCACGTGACCATCGTACCAGATGCGGCAGTATATCAGGTGCCTGCC
CCTCATGAACACACTGCCC
```

TABLE 7-continued

Nucleic Acid Sequences of Vectors

SEQ ID NO | Sequence

SEQ ID NO: 1434
CATCATCAATAATATACCCCACAAAGTAAACAAAAGTTAATATGCAAATGAGCT
CTTGAATTTTAACGGTTTTGGGGCGGAGCCAATGCTGATTGGCCGAGAAGCGGT
GACGCAGTTGACGTCACGACGCACGGCCGACGCTCGCCGCGGAGGCGTGGCCTA
GCCCGGAAGCAAGTCGCGGGGCTGATGACGTATAAAAAAGCGGACTTTAGACCC
GGAAACGGCCGATTTTCCCGCGGCCACGCCCGGATATGAGGTAATTCTGGGTGG
ATGCAAGTGAAATTAGGCCATTTTGGCGCGAAAACTGAATGAGGAAGTGAAAA
GTGAAAAATACCGGGCCCGCCCAGGGCGGAATATTTACCGAGGGCCGAGAGAC
TTTGACCGATTACGTGGGGGTTTCGATTGCGGTGTTTTTTTCGCGAATTTCCGCGT
CCGTGTCAAAGTCCGGTGTTTATGTCACAGATCAGCTGATCCACAGGGTATTTAA
ACCAGTCGAGCCCGTCAAGAGGCCACTCTTGAGTGCCAGCGAGTAGAGATTTCT
CTGAGCTCCGCTCCCAGAGTCTGAGAAAAATGAGACACCTGCGCCTCCTGCCTTC
AACTGTGCCTATGGACATGGCTGTGCTTATGCTGGATGACTTTGTGAATACAGTA
TTGGAGGATGAACTGCATCCAACTCCGTTCGAGCTGGGACCCACACTTCAGGAC
CTCTATGATCTGGAGGTAGATGCCCAGGAGGACGACCCGAACGAAGAGGCTGTG
AATTTAATATTTCCAGAATCTATGATTCTTCAGGCTGACATAGCCAGTGAAGCCA
TAGTTACTCCTCTACATACTCCAACTCTGCCTCCCATACCTGAATTGGAGGAGGA
TGAAGAAATAGACCTCCGGTGCTACGAGGAAGGTTTTCCTCCCAGCGATTCAGA
GGACGAACAGGGTGAGCAGCAGATGGCTCTAATCTCTGATTTAGCTTGTGTGAT
TGTGGAGGAACAAGTTGTGATTGAAAAATCTACCGAGCCAGTACAAGGCTGTAG
GAACTGCCAGTATCACCGGGATAAGTCCGGAGACCCGAACGCTTCCTGCGCTCT
GTGTTACATGAAATCTACTTTCAGCTTTATTTACAGTAAGTGGAGTGAATGTGAG
AGAGGCTGAGTACTTAACACATAACTGTAATGCTTGAACAGCTGTGCTAAGTGT
GGTTTATTTTTGTTACTAGGTCCGGTGTCAGAGGATGAGTCATCACCCTCAGAAG
AAGACCACCCGTCTCCCCCTGATCTCACAGATGACACGCCCCTGCAAGTGTTCAG
ACCCACCCCAGTCAGAGCCAGTGGCGAGAGGCGAGCGGCTGTTGACAAAATTGA
GGACTTGTTGCAGGACATGGGTGGGGATAAACCTTTGGACCTGAGCTTGAAACG
CCCCAGGAACTAGGCGCAGCTGCGCTTAGTCATGTGTAAATAAAGTTGTACAAT
AAAAGTATATGTGACGCATGCAAGGTGTGGTTTATGACTCATGGGCGGGGCTTA
GTCCTATATAAGTGGCAACACCTGGGCACTTGGGCACAGACCTTCAGGGAGTTC
CTGATGGATGTGTGGACTATCCTTGCAGACTTTAGCAAGACACGCCGGCTTGTAG
AGGATAGTTCAGACGGGTGCTCCGGGTTCTGGAGACACTGGTTTGGAACTCCTCT
ATCTCGCCTGGTGTACACAGTTAAGAAGGATTATAACGAGGAATTTGAAAATCT
TTTTGCTGACTGCTCTGGCCTGCTAGATTCTCTGAATCTTGGCCACCAGTCCCTTT
TCCAGGAAAGGGTACTCCACAGTCTTGATTTTTCCAGCCCAGGGCGCACTACAG
CCGGGGTTGCTTTTGTGGTTTTTCTGGTTGACAAATGGAGCCAGAACACCCAACT
GAGCAGGGGCTACATTCTGGACTTCGCGGCCATGCACCTGTGGAGGTCCTGGAT
CAGGCAGCGGGGACAGAGAATCTTGAACTACTGGCTTCTACAGCCAGCAGCTCC
GGGTCTTCTTCGTCTACACAGACAAACATCCATGTTGGAGGAAGAAATGAGGCA
GGCCATGGACGAGAACCCGAGGAGCGGCCTGGACCCTCCGTCGGAAGAGGAGC
TGGATTGAATCAGGTATCCAGCCTGTACCCAGAGCTTAGCAAGGTGCTGACATC
CATGGCCAGGGGAGTGAAGAGGGAGAGGAGCGATGGGGGCAATACCGGGATGA
TGACCGAGCTGACGGCCAGCCTGATGAATCGCAAGCGCCCAGAACGCATTACCT
GGCACGAGCTACAGATGGAGTGCAGGGATGAGGTGGGCCTGATGCAGGATAAA
TATGGCCTGGAGCAGATAAAAACCCACTGGTTGAACCCAGATGAGGATTGGGAG
GAAGCCATTAAGAAATATGCCAAGATAGCCTTGCGCCCAGATTGCAAGTACAGG
GTGACCAAGACCGTGAATATCAGACATGCCTGCTACATCTCGGGGAACGGGGCA
GAGGTGGTCATCGATACCCTGGACAAGGCCGCCTTTAGGTGTTGCATGATGGGA
ATGAGAGCCGGAGTGATGAATATGAATTCCATGATCTTCATGAACATGAAGTTC
AATGGAGAGAAGTTTAATGGGGTGATGTTCATGGCCAACAGCCACATGACCCTG
CATGGCTGCAGTTTCTTTGGTTTCAACAATATGTGTGCAGAGGTCTGGGGCGCTG
CTAAGATCAGGGGATGTAAGTTTTATGGCTGCTGGATGGGCGTGGTCGGAAGAC
CCAAGAGCGAGATGTCTGTGAAGCAGTGTGTGTTTGAGAAATGCTACCTGGGAG
TCTCTACTGAGGGCAATGCTAGAGTGAGACACTGCTCTTCCCTGGAGACGGGCT
GCTTCTGCCTGGTGAAGGGCACGGCCTCTCTGAAGCATAATATGGTGAAGGGCT
GCACGGATGAGCGCATGTACAACATGCTGACCTGCGACTCGGGGTCTGCCATA
TCCTGAAGAACATCCATGTGACCTCCCACCCCAGAAAGAAGTGGCCAGTGTTTG
AGAATAACCTGCTGATCAAGTGCCATATGCACCTGGGCGCCAGAAGGGGCACCT
TCCAGCCGTACCAGTGCAACTTTAGCCAGACCAAGCTGCTGTTGGAGAACGATG
CCTTCTCCAGGGTGAACCTGAACGGCATCTTTGACATGGATGTTTCGGTGTACAA
GATCCTGAGATACGATGAGACCAAGTCCAGGGTGCGCGCTTGCGAGTGCGGGG
CAGACACACCAGGATGCAGCCAGTGGCCCTGGATGTGACCGAGGAGCTGAGAC
CAGACCACCTGGTGATGGCATGTACCGGGACCGAGTTCAGCTCCAGTGGGGAGG
ACACAGATTAGAGGTAGGTTTTGAGTAGTGGGCGTGGCTAAGGTGAGTATAAAG
GCGGTGTCTTACGAGGGTCTTTTTGCTTTTCTGCAGACATCATGAACGGGACCGG
CGGAGCCTTCGAAGGGGGGCTTTTTAGCCCTTATTTGACAACCCGCCTGCCGGGA
TGGGCCGGAGTTCGTCAGAATGTGATGGGATCTACGGTGGATGGGCGTCCAGTG
CTTCCAGCAAATTCCTCGACCATGACCTACGCGACCGTGGGGAGCTCGTCGCTCG
ACAGCACCGCCGCAGCCGCGGCAGCCGCAGCCGCCATGACAGCGACGAGACTG
GCCTCGAGCTACATGCCCAGCAGCGGTAGCAGCCCCTCTGTGCCCAGTTCCATCA
TCGCCGAGGAGAAACTGCTGGCCCTGCTGCCCGAGCTGGAAGCCCTGAGCCGCC
AGCTGGCCGCCCTGACCCAGCAGGTGTCCGAGCTCCGCGAGCAGCAACAGCAGC
AAAATAAATGATTCAATAAACACAGATTCTGATTCAAACAGCAAAGCATCTTTA
TTATTTATTTTTTCGCGCGGTAGGCCCTGGTCCACCTCTCCCGATCATTGAGA
GTGCGGTGAATTTTTTCCAGGACCCGGTGAGGTGGGATTGGATGTTGAGGTAC
ATGGGCATGAGCCCGTCCCGGGGGTGGAGGTAGCACCACTGCATGGCCTCGTGC

TABLE 7-continued

Nucleic Acid Sequences of Vectors

| SEQ ID NO | Sequence |
|---|---|
| | TCTGGGGTCGTGTTGTAGATGATCCAGTCATAGCAGGGGCGCTGGGCGTGGTGC
TGGATGATGTCTTTGAGGAGGAGACTAATGGCCACGGGGAGCCCCTTGGTGTAG
GTGTTGGCAAAGCGGTTGAGCTGGGAGGGATGCATGCGGGGGGAGATGATGTG
CAGTTTGGCCTGGATCTTGAGGTTGGCAATGTTGCCGCCCAGATCCCGCCGGGG
GTTCATGTTGTGCAGGACCACCAGGACGGTGTAGCCCGTGCACTTGGGGAACTT
GTCATGCAACTTGGAAGGGAATGCGTGGAAGAATTTGGAGACGCCCTTGTGCCC
GCCCAGGTTTTCCATGCACTCATCCATGATGATGGCGATGGGCCCGTGGGCTGCG
GCTTTGGCAAAGACGTTTCTGGGGTCAGACACATCATAATTATGCTCCTGGGTGA
GATCATCATAAGACATTTTAATGAATTTGGGGCGAAGGGTGCCAGATTGGGGGA
CGATGGTTCCCTCGGGCCCCGGGGCGAAGTTCCCCTCACAGATCTGCATCTCCCA
GGCTTTCATCTCGGAGGGGGGGATCATGTCCACCTGCGGGGCAATGAAAAAAAC
GGTTTCCGGGGCGGGGGTGATGAGCTGCGAAGAGAGCAGGTTTCTCAACAGCTG
GGACTTGCCGCACCCGGTCGGGCCGTAGATGACCCCGATGACGGGTTGCAGGTG
GTAGTTCAAGGACATGCAGCTGCCGTCGTCCCGGAGGAGGGGGGCCACCTCGTT
GAGCATGTCTCTGACTTGGAGGTTTTCCCGGACGAGCTCGCCAAGGAGGCGGTC
CCCGCCCAGCGAGAGGAGCTCTTGCAGGGAAGCAAAGTTTTTCAGGGGCTTGAG
CCCGTCGGCCATTGGCATCTTGGCGAGGGTCTGCGAGAGGAGCTCCAGGCGGTC
CCAGAGCTCGGTGACGTGCTCTACGGCATCTCGATCCAGCAGACTTCCTCGTTTC
GGGGGTTGGGACGACTGCGACTGTAGGGCACGAGACGATGGGCGTCCAGCGCG
GCCAGCGTCATGTCCTTCCAGGGTCTCAGTGTCCGCGTGAGGGTGGTCTCCGTCA
CGGTGAATGGGTGGGCCCCGGGCTGGGCGCTTGCAAGGGTGCGCTTGAGACTCA
TCCTGCTGGTGCTGAAACGGGCACGGTCTTCGCCCTGCGCGTCGGCGAGATAGC
AGTTGACCATCAGCTCGTAGTTGAGGGCCTCGGCGGCGTGGCCCTTGGCGCGGA
GCTTGCCCTTGGAAGAGCGCCCGCAGGCGGGACATAGGAGGGATTGCAGGGCGT
AGAGCTTGGGCGCGAGAAAGACCGACTCGGGGGCGAAGGCGTCCGCTCCGCAG
TGGGCGCAGACGGTCTCGCACTCGACGAGCCAGGTGAGCTCTGGCTGCTCGGGG
TCAAAAACCAGTTTTCCCCCGTTCTTTTTGATGCGCTTCTTACCTCGCGTCTCCAT
GAGTCTGTGTCCGCGCTCGGTGACAAACAGGCTGTCGGTGTCCCCGTAGACGGA
CTTGATTGGCCTGTCCTGCAGGGGCGTCCCGCGGTCCTCCTCGTAGAGAAACTCG
GACCACTCTGAGACAAAGGCGCGCGTCCACGCCAAGACAAAGGAGGCCACGTG
CGAGGGGTAGCGGTCGTTGTCCACCAGGGGGTCCACCTTTTCCACCGTGTGCAG
ACACATGTCCCCCTCCTCCGCATCCAAGAAGGTGATTGGCTTGTAGGTGTAGGCC
ACGTGACCGGGGGTCCCCGACGGGGGGGTATAAAAGGGGGCGGGTCTGTGCTC
GTCCTCACTCTCTTCCGCGTCGCTGTCCACGAGCGCCAGCTGTTGGGGTAGGTAT
TCCCTCTCGAGAGCGGGCATGACCTCGGCACTCAGGTTGTCAGTTTCTAGAAACG
AGGAGGATTTGATGTTGGCTTGCCCTGCCGCGATGCTTTTTAGGAGACTTTCATC
CATCTGGTCAGAAAAGACAATTTTTTATTGTCAAGCTTGGTGGCAAGGAGCC
ATAGAGGGCGTTGGAGAGAAGCTTGGCGATGGATCTCATGGTCTGATTTTTGTC
ACGGTCGGCGCGCTCCTTGGCCGCGATGTTGAGCTGGACATATTCGCGCGCAAC
ACACTTCCATTCGGGAAAGACGGTGGTGCGCTCGTCGGGCACGATCCTGACGCG
CCAGCCGCGGTTATGCAGGGTGACCAGGTCCACGCTGGTGGCCACCTCGCCGCG
CAGGGGCTCGTTGGTCCAGCAGAGTCTGCCGCCCTTGCGCGAGCAGAACGGTGG
CAGCACATCAAGCAGATTCTCGTCAGGGGGGTCCGCATCGATGGTGAAGATGCC
CGGACAGAGTTCCTTGTCAAAATAATCGATTTTTGAGGATGCATCATCCAAGGCC
ATCTGCCACTCGCGGGCGGCCATCGCTCGCTCGTAGGGGTTGAGGGGCGGACCC
CAGGGCATGGGATGCGTGAGGGCGGAGGCGTACATGCCGCAGATGTCGTAGAC
ATAGATGGGCTCCGAGAGGATGCCGATGTAGGTGGGATAACAGCGCCCCCCGCG
GATGCTGGCGCGCACGTAATCATACAACTCGTGCGAGGGGGCCAAGAAGGCGG
GGCCGAGATTGGTGCGCTGGGGCTGCTCGGCGCGGAAGACGATCTGGCGAAAG
ATGGCATGCGAGTTTGAGGAGATGGTGGGCCGTTGGAAGATGTTAAAGTGGGCG
TGAGGCAGGCGGACCGAGTCGCGGATGAAGTGCGCGTAGGAGTCTTGCAGCTTG
GCGACGAGCTCGGCGGTGACGAGGACGTCCATGGCGCAGTAGTCCAGCGTTTCG
CGGATGATGTCATAACCCGCCTCTCCTTTCTTGTCCCACAGCTCGCGGTTGAGGG
CGTACTCCTCGTCATCCTTCCAGTACTCCCGGAGCGGGAATCCTCGATCGTCCGC
ACGGTAAGAGCCCAGCATGTAGAAATGGTTCACGGCCTTGTAGGGACAGCAGCC
CTTCTCCACTGGGAGGGCGTAAGCTTGTGCGGCCTTGCGGAGCGAGGTGTGCGT
CAGGGCGAAGGTGTCCCTGACCATGACTTTCAAGAACTGGTACTTGAAGTCCGA
GTCGTCGCAGCCGCCGTGCTCCCAGAGCTCGAAATCGGTGCGCTTCTTCGAGAG
GGAGTTAGGCAGAGCGAAAGTGACGTCATTGAAGAGAATCTTGCCTGCCCCGCGG
CATGAAATTGCGGGTGATGCGAAAGGGCCCGGAACGGAGGCTCGGTTGTTGAT
GACCTGGGCGGCGAGGACGATCTCGTCGAAGCCGTTGATGTTGTGCCCGACGAT
GTAGAGTTCCATGAATCGCGGGCGGCCTTTGATGTGCGGCAGCTTTTTGAGTTCC
TCGTAGGTGAGGTCCTCGGGGCATTGCAGGCCGTGCTGCTCGGAGCGCCCACTCCT
GGGAGATGTGGGTTGGCTTGCATGAAGGAAGCCCAGAGCTCGCGGGCCAGGAGG
GTCTGGAGCTCGTCGCGAAAGAGGCGGAACTGCTGGCCCACGGCCATCTTTTCG
GGTGTGACGCAGTAGAAGGTGAGGGGGTCCCGCTCCCAGCGATCCCAGCGTAAG
CGCACGGCGAGATCGCGAGCGAGGGCGACCAGCTCGGGGTCCCCCGAGAATTTC
ATGACCAGCATGAAGGGGACGAGCTGCTTGCCGAAGGACCCCATCCAGGTGTAG
GTTTCTACATCGTAGGTGACAAAGAGCCGCTCCGTGCGAGGATGAGAGCCGATT
GGGAAGAACTGGATTTCCTGCCACCAGTTGGACGATTGGCTGTTGATGTGATGA
AAGTAGAAATCCCGCCGGCGAACCAGCACTCGTGCTGATGCTTTGTAAAAGCGT
CCGCAGTACTCGCAGCGCTGCACGGGCTGTACCTCATCCACGAGATACACAGCG
CGTCCCTTGAGGAGGAACTTCAGGAGTGCGGCCCTGGCTGGTGGTTTTCATGTT
CGCCTGCGTGGGACTCACCCTGGGGCTCCTCGAGGACGGAGAGGCTGACGAGCC
CGCGCGGGAGCCAGGTCCAGATCTCGGCGCGCGGGGGCGGAGAGCGAAGACG
AGGGCACGCAGTTGGGAGCTGTCCATGGTGTCGCGGAGATCCAGGTCCGGGGGC |

TABLE 7-continued

Nucleic Acid Sequences of Vectors

SEQ ID NO Sequence

```
AGGGTTCTGAGGTTGACCTCGTAGAGGCGGGTGAGGGCGTGCTTGAGATGCAGA
TGGTACTTGATCTCCACGGGTGAGTTGGTGGCCGTGTCCACGCATTGCATGAGCC
CGTAGCTGCGCGGGGCCACGACCGTGCCGCGGTGCGCTTTTAGAAGCGGTGTCG
CGGACGCGCTCCCGGCGGCAGCGGCGGTTCCGGCCCCGCGGGCAGGGGCGGCA
GAGGCACGTCGGCGTGGCGCTCGGGCAGGTCCCGGTGCTGCGCCCTGAGAGCGC
TGGCGTGCGCGACGACGCGGCGGTTGACATCCTGGATCTGCCGCCTCTGCGTGA
AGACCACGGGCCCCGTGACTTTGAACCTGAAAGACAGTTCAACAGAATCAATCT
CGGCGTCATTGACGGCGGCCTGACGCAGGATCTCTTGCACGTCGCCCGAGTTGTC
CTGGTAGGCGATCTCGGACATGAACTGCTCGATCTCCTCCTCCTGGAGATCGCCG
CGGCCCGCGCGCTCCACGGTGGCGGCGAGGTCATTTGAGATGCGACCCATGAGC
TGCGAGAAGGCGCCCAGGCCGCTCTCGTTCCAGACGCGGCTGTAGACCACGTCC
CCGTCGGCGTCGCGCGCGCATGACCACCTGCGCGAGGTTGAGCTCCACGTGC
CGCGCGAAGACGGCGTAGTTGCGCAGGCGCTGGAAGAGGTAGTTGAGGGTGGT
GGCGATGTGCTCGGTGACGAAGAAGTACATGATCCAGCGGCGCAGGGGCATCTC
GCTGATGTCGCCGATGGCCTCCAGCCTTTCCATGGCTTCGTAGAAATCCACGGCG
AAGTTGAAAAACTGGGCGTTGCGGGCCGACACCGTGAGCTCGTCTTCCAGGAGC
CGGATGAGCTCGGCGATGGTGGCGCGCACCTCGCGCTCAAAATCCCCGGGGCC
TCCTCCTCTTCTTCCTCTTCTTCCATGACGACCTCTTCTTCTATTTCTTCCTCTGGG
GGCGGTGGTGGTGGCGGGGCCCGACGACGACGGCGACGCACCGGGAGACGGTC
GACGAAGCGCTCGATCATCTCCCCGCGGCGGCGACGCATGGTTTCGGTGACGGC
GCGACCCCGTTCGCGAGGACGCAGCGTGAAGACGCCGCCGGTCATCTCCCGGTA
ATGGGGCGGGTCCCCGTTGGGCAGCGATAGGGCGCTGACGATGCATCTTATCAA
TTGCGGTGTAGGGGACGTGAGCGCGTCGAGATCGACCGGATCGGAGAATCTTTC
AAGGAAAGCGTCTAGCCAATCGCAGTCGCAAGGTAAGCTCAAACACGTAGCAG
CCCTGTGGACGCTGTTAGAATTGCGGTTGCTGATGATGTAATTGAAGTAGGCGTT
TTTAAGGCGGCGGATGGTGGCGAGGAGGACCAGGTCCTTGGGTCCAGCTTGCTG
GATGCGGAGCCGCTCGGCCATGCCCCAGGCCTGGCCCTGACACCGGCTCAGGTT
CTTGTAGTAGTCATGCATGAGCCTTTCAATGTCATCACTTGCGGAGGCGGAGTCT
TCCATGCGGGTGACCCCGACGCCCTGAGCGGCTGCACGAGCGCCAGGTCGGCG
ACGACGCGCTCGGCGAGGATGGCCTGTTGCACGCGGGTGAGGGTGTCCTGGAAG
TCGTCCATGTCGACGAAGCGGTGGTAGGCCCCGGTGTTGATGGTGTAGGTGCAG
TTGGCCATGAGCGACCAGTTAACGGTCTGCAGGCCGGGCTGCACGACCTCCGAG
TACCTGAGCCGCGAGAAGGCGCGCGAGTCGAAGACGTAGTCGTTGCAGGTGCGC
ACGAGGTACTGGTAGCCGACTAGGAAGTGCGGCGGCGGCTGGCGGTAGAGCGG
CCAGCGCTGGGTGGCCGGCGCGCCCGGGGCCAGGTCCTCGAGCATGAGGCGGTG
GTAGCCGTAGAGGTAGCGGGACATCCAGGTGATGCCGGCGGCGGTGGTGGAGG
CGCGCGGGAACTCGCGGACGCGGTTCCAGATGTTGCGCAGCGGCAGGAAATAAT
CCATGGTCGGCACGGTCTGGCCGGTGAGACGCGCAGTCATTGACGCTCTAGA
GGCAAAAACGAAAGCGGTTGAGCGGGCTCTTCCTCCGTAGCCTGGCGGAACGCA
AACGGGTTAGGCCGCTGTGTACCCCGGTTCGAGTCCCCTCGAATCAGGCTGGA
GCCGCGACTAACGTGGTATTGGCACTCCCGTCTCGACCCGAGCCCGATAGCCGC
CAGGATACGGCGGAGAGCCCTTTTTGCCGGCCGAGGGGGTCGCTCGACTTGAAA
GCGGCCGAAAACCCTGTCGGGTAGTGGCTCGCGCCCGTAGTCTGGAGAAGCATC
GCCAGGGTTGAGTCGCGGCAGAACCCGGTTCGCGGACGGCCGCGGCGAGCGGG
ACTTGGTCACCCCGCCAATTTAAAGACCCACAGCCAGCCGACTTCTCCAGTTACG
GGAGCGAGCCCCCTTTTTTCTTTTTGCCAGATGCATCCCGTCCTGCGCCAAATGC
GTCCCGCCCCCCGGCGACCACCGCGACCGCGGCCGTAGCAGGCGCCGGCGCTA
GCCAGCCACAGACAGAGATGGACTTGGAAGAGGGCGAAGGGCTGGCGAGACTG
GGGGCGCCGTCCCCGGAGCGACACCCCGCGTGCAGCTGCAGAAGGACGTGCGC
CCGGCGTACGTGCCTGCGCAGAACCTGTTCAGGGACCGCAGCGGGGAGGAGCCC
GAGGAGATGCGCGACTGCCGTTTTCGGGCGGGCAGGGAGCTGCGCGAGGGCTTG
GACCGCCAGCGCGTGCTGCGCGACGAGGATTTCGAGCCGAACGAGCAGACGGG
GATCAGCCCGCTCGCGCGCACGTGGCGGCGGCCAACCTGGTGACGGCCTACGA
GCAGACGGTGAAGCAGGAGCGCAACTTCCAAAAGAGTTTCAACAACCACGTGC
GCACCCTGATCGCGCGCGAGGAGGTGGCCCTGGGCCTGATGCACCTGTGGGACC
TGGCGGAGGCCATCGTGCAGAACCCGGACAGCAAGCCTCTGACGGCGCAGCTGT
TCCTGGTGGTGCAGCACAGCAGGGACAACGAGGCGTTCAGGGAGGCGCTGCTGA
ACATCGCCGAGCCCGAGGGTCGCTGGCTGCTGGAGCTGATTAACATCTTGCAAA
GCATCGTAGTGCAGGAGCGCAGCCTGGCCTGGCCGAGAAGGTGGCGGCGATC
AACTACTCGGTGTTGAGCCTGGGCAAGTTTTACGCGCGCAAGATTTACAAGACG
CCGTACGTGCCCATAGACAAGGAGGTGAAGATAGACAGCTTTTACATGCGCATG
GCGCTCAAGGTGCTGACGCTGAGCGACGACCTGGGCGTGTACCGCAACGACCGC
ATCCACAAGGCCGTGAGCACGAGCCGGCGGCGCGAGCTGAGCGACCGCGAGCT
GATGCTTAGCCTGCGCCGGGCGCTGGTAGGGGCGCCGCCGGCGGCGAGGAGTC
CTACTTCGACATGGGGGCGGACCTGCATTGGCAGCCGAGCCGGCGCGCCTTGGA
AGCCGCCTACGGTCCAGAGGACTTGGATGAGGATGAGGAAGAGGAGGAGGATG
CACCCGCTGCGGGGTACTGACGCCTCCGTGATGTGTTTTTAGATGCAGCAAGCCC
CGGACCCCGCCATAAGGGCGGCGCTGCAAAGCCAGCCGTCCGGTCTAGCATCGG
ACGACTGGGAGGCCGCGATGCAACGCATCATGGCCCTGACGACCCGCAACCCCG
AGTCCTTTAGACAACAGCCGCAGGCCAACAGACTCTCGGCCATTCTGGAGGCGG
TGGTCCCCTCTCGGACCAACCCCACGCACGAGAAGGTGCTGGCGATCGTGAACG
CGCTGGCGGAGAACAAGGCCATCCGTCCCGACGAGGCCGGGCTGGTGTACAACG
CCCTGCTGGAGCGCGTGGCCGCTACAACAGCACGAACGTGCAGTCCAACCTGG
ACCGGCTGGTGACGGACGTGCGCGAGGCCGTGGCGCAGCGCGAGCGGTTCAAG
AACGAGGGCCTGGGCTCTCTGGTGGCGCTGAACGCCTTCCTGGCGACGCAGCCG
GCGAACGTGCCGCGCGGGCAGGACGATTACACCAACTTTATCAGCGCGCTGCGG
```

TABLE 7-continued

Nucleic Acid Sequences of Vectors

SEQ ID NO Sequence

```
CTGATGGTGACCGAGGTGCCCCAGAGCGAGGTGTACCAGTCGGGCCCGGACTAC
TTTTTCCAGACGAGCCGGCAGGGCTTGCAGACGGTGAACCTGAGCCAGGCTTTC
AAGAACCTGCGCGGGCTGTGGGCGTGCAGGCGCCCGTGGGCGACCGGTCGAC
GGTGAGCAGCTTGCTGACGCCCAACTCGCGGCTGCTGCTGCTGATCGCGCCC
TTCACCGACAGCGGCAGCGTGAACCGCAACTCGTACCTGGGCCACCTGCTGACG
CTGTACCGCGAGGCCATAGGCCAGGCGCAGGTGGACGAGCAGACCTTCCAGGA
GATCACGAGCGTGAGCCGCGCGCTGGGGCAGAACGATACCGACAGTCTGAGGG
CCACCCTGAACTTTTTGCTGACCAATAGACAGCAGAAGATCCCGGCGCAGTACG
CACTGTCGGCCGAGGAGGAAAGGATCCTGAGATATGTGCAGCAGAGCGTAGGG
CTGTTCCTGATGCAGGAGGGCGCCACCCCCAGCGCCGCGCTGGACATGACCGCG
CGCAACATGGAACCTAGCATGTACGCCGCCAACCGGCCGTTCATCAATAAGCTG
ATGGACTACCTGCACCGCGCGGCGGCCATGAACACGGACTACTTTACAAACGCC
ATCCTGAACCCGCACTGGCTCCCGCCGCCGGGGTTCTACACGGGCGAGTACGAC
ATGCCCGACCCCAACGACGGGTTCCTGTGGGACGACGTGGACAGCGTGGTGTTC
TCGCCGACCTTTCAAAAGCGCCAGGAGGCGCCGCCGAGCGAGGGCGCGGTGGGT
CGGAGCCCCTTTCCTAGCTTAGGGAGTTTGCATAGCTTGCCGGGCTCGGTGAACA
GCGGCAGGGTGAGCCGGCCGCGCTTGCTGGGCGAGGACGAGTACCTGAACGACT
CGCTGCTGCAGCCGCCGCGGGCCAAGAACGCCATGGCCAATAACGGGATAGAG
AGTCTGGTGGACAAACTGAACCGCTGGAAGACCTACGCTCAGGACCATAGGGAC
GCGCCCGCGCCGCGGCGACAGCGCCACGACCGGCAGCGGGGCCTGGTGTGGGA
CGACGAGGACTCGGCCGACGATAGCAGCGTGTTGGACTTGGGCGGGAGCGGTG
GGGCCAACCCGTTCGCACATCTGCAGCCCAAACTGGGGAGGCGGATGTTTTGAA
ATGCAAAATAAAACTCACCAAGGCCATAGCGTGCGTTCTCTTCCTTGTTAGAGAT
GAGGCGCGCGGTGGTGTCTTCCTCTCCTCCTCCCTCGTACGAGAGCGTGATGGCG
CAGGCGACCCTGGAGGTTCCGTTTGTGCCTCCGCGGTATATGGCTCCTACGAGG
GCAGAAACAGCATTCGTTACTCGGAGCTGGCTCCGCAGTACGACACCACTCGCG
TGTACTTGGTGGACAACAAGTCGGCGGACATCGCTTCCCTGAACTACCAAAACG
ACCACAGCAACTTCCTGACCACGGTGGTGCAGAACAACGATTTCACCCCCGCCG
AGGCCAGCACGCAGACGATAAATTTTGACGAGCGGTCGCGGTGGGGCGGTGATC
TGAAGACCATTCTGCACACCAACATGCCCAATGTGAACGAGTACATGTTCACCA
GCAAGTTTAAGGCGCGGGTGATGGTGGCTAGAAAAAAGGCGGAAGGGGCTGAT
GCAAATGATAGGAGCAAGGATATCTTAGAGTATCAGTGGTTTGAGTTTACCCTG
CCCGAGGGCAACTTTTCCGAGACCATGACCATAGACCTGATGAACAACGCCATC
TTGGAAAACTACTTACAAGTGGGGCGGCAGAATGGCGTGCTGGAGAGCGATATC
GGAGTCAAGTTTGACAGCAGGAATTTCAAGCTGGGCTGGGACCCGGTGACCAAG
CTGGTGATGCCAGGGGTCTACACCTACGAGGCCTTCCACCCGGACGTGGTGCTG
CTGCCGGGCTGCGGGGTGGACTTCACCGAGAGCCGCCTGAGCAACCTCCTGGGC
ATTCGCAAGAAGCAACCTTTCCAAGAGGGCTTCAGAATCATGTATGAGGATCTA
GTAGGGGGCAACATCCCCGCCCTGCTTGATGTGCCCAAGTACTTGGAAAGCAAG
AAGAAACTGGAGGAAGGCGCTAAGGAAGCTGGCAACACCAAAGCTCCAATTAG
AGGAGATACTTATGCTACCACAGCTGAGGAAGAGGCTGCTAAAAAAGAGTTAGT
TATTTTGCCAGTAACAGAAGATGAAAGCAAAAGAAGCTATAATTTAATTGAGGG
AACCACAGACACGCTGTACCGAAGCTGGTACCTGTCCTATACCTACGGGGACCC
CGAGAAGGGGGTGCAGTCGTGGACGCTGCTCACCACCCCGGACGTCACCTGCGG
CGCGGAGCAAGTCTACTGGTCGCTGCCGGACCTCATGCAAGACCCCGTCACCTT
CCGCTCCACCCAGCAAGTCAGCAACTACCCCGTGGTCGGCGCCGAGCTCATGCC
CTTCCGCGCCAAGAGCTTTTACAACGACCTCGCCGTCTACTCCCAGCTCATCCGC
AGCTACACCTCCCTCACCCACGTCTTCAACCGCTTCCCCGACAACCAGATCCTCT
GCCGCCCGCCCGCGCCCACCATCACCACCGTCAGTGAAAACGTGCCTGCTCTCA
CAGATCACGGGACGCTACCGCTGCGCAGCAGTATCCGCGGAGTCCAGCGAGTGA
CCGTCACTGACGCCCGTCGCCGCACCTGTCCCTACGTCTACAAGGCCCTGGGCAT
AGTCGCGCCGCGCGTGCTCTCCAGTCGCACCTTCTAAAAAATGTCTATTCTCATC
TCGCCCAGCAATAACACCGGCTGGGGTCTTACTAGGCCCAGCACCATGTACGGA
GGAGCCAAGAAGCGCTCCCAGCAGCACCCCGTCCGCGTCCGCGGCCACTTCCGC
GCTCCCTGGGGCGCATACAAGCGCGGGCGGACTGCCACCGCCGCCGCCGTGCGC
ACCACCGTCGACGATGTCATCGACTCGGTGGTCGCCGATGCGCGCAACTATACC
CCCGCCCCTCCACCGTGGACGCGGTCATCGACAGCGTGGTGGCCGACGCGCGC
GACTATGCCAGACGCAAGAGCCGGCGGCGACGGATCGCCAGGCGCCACCGGAG
TACGCCCGCTATGCGCGCCGCCCGGGCTCTGCTGCGCCGCCAGACGCACGGG
CCGCCGGGCCATGATGCGAGCCGCGCGCCGCGCTGCCACTGCACCCACCCCCGC
AGGCAGGACTCGCAGACGAGCGGCCGCCGCCGCCGCGGCCATTTCTAGCAT
GACCAGACCCAGGCGCGGAAACGTGTACTGGGTGCGCGACTCCGTCACGGGCGT
GCGCGTGCCCGTGCGCACCCGTCCTCCTCGTCCCTGATCTAATGCTTGTGTCCTC
CCCCGCAAGCGACGATGTCAAAGCGCAAAATCAAGGAGGAGATGCTCCAGGTC
GTCGCCCCGGAGATTTACGGACCCCCGGACCAGAAACCCCGCAAAATCAAGCGG
GTTAAAAAAAAGGATGAGGTGGACGAGGGGGCAGTAGAGTTTGTGCGCGAGTT
CGCTCCGCGGCGGCGCGTAAATTGGAAGGGGCGCAGGGTGCAGCGCGTGTTGCG
GCCCGGCACGGCGGTGGTATTCACGCCCGGCGAGCGGTCCTCGGTCAGGAGCAA
GCGTAGCTATGACGAGGTGTACGGCGACGACGACATCCTGGACCAGGCGGCGG
AGCGGGCGGGCGAGTTCGCCTACGGGAAGCGGTCGCGCGAAGAGGAGCTGATC
TCGCTGCCGCTGGACGAGAGCAATCCCACGCCGAGCCTGAAGCCCGTGACCCTG
CAGCAGGTGCTGCCCCAGGCGGTGCTGCTGCCGAGCCGCGGGATCAAGCGCGAG
GGCGAGAACATGTACCCGACCATGCAGATCATGGTGCCCAAGCGCCGGCGCGTG
GAGGAAGTGCTGGACACCGTGAAAATGGATGTGGAGCCCGAGGTCAAGGTGCG
CCCCATCAAGCAGGTGGCGCCGGGCCTGGGCGTGCAGACCGTGGACATTCAGAT
CCCCACCGACATGGATGTCGACAAAAAACCCTCGACCAGCATCGAGGTGCAGAC
```

TABLE 7-continued

Nucleic Acid Sequences of Vectors

SEQ ID NO Sequence

```
CGACCCCTGGCTCCCAGCCTCCACCGCTACCGTCTCCACTTCTACCGCCGCCACG
GCCACCGAGCCTCCCAGGAGGCGAAGATGGGGCCCTGCCAACCGGCTGATGCCC
AACTACGTGTTGCATCCTTCCATCATCCCGACGCCGGGCTACCGCGGCACCCGGT
ACTACGCCAGCCGCAGGCGCCCAGCCAGCAAACGCCGCCGCCGCACCACCACCC
GCCGCCGTCTGGCCCCCGCCCGCGTGCGCCGCGTAACCACGCGCCGGGGCCGCT
CGCTCGTTCTGCCCACCGTGCGCTACCACCCCAGCATCCTTTAATCCGTGTGCTG
TGATACTGTTGCAGAGAGATGGCTCTCACTTGCCGCCTGCGCATCCCCGTCCCGA
ATTACCGAGGAAGATCCCGCCGCAGGAGAGGCATGGCAGGCAGCGGCCTGAAC
CGCCGCCGGCGGCGGGCCATGCGCAGGCGCCTGAGTGGCGGCTTTCTGCCCGCG
CTCATCCCCATAATCGCCGCGGCCATCGGCACGATCCCGGGCATAGCTTCCGTTG
CGCTGCAGGCGTCGCAGCGCCGTTGATGTGCGAATAAAGCCTCTTTAGACTCTG
ACACACCTGGTCCTGTATATTTTTAGAATGGAAGACATCAATTTTGCGTCCCTGG
CTCCGCGGCACGGCACGCGGCCGTTCATGGGCACCTGGAACGAGATCGGCACCA
GCCAGCTGAACGGGGGCGCCTTCAATTGGAGCAGTGTCTGGAGCGGGCTTAAAA
ATTTCGGCTCGACGCTCCGGACCTATGGGAACAAGGCCTGGAATAGTAGCACGG
GGCAGTTGTTGAGGGAAAAGCTCAAAGACCAGAACTTCCAGCAGAAGGTGGTG
GACGGGCTGGCCTCGGGCATTAACGGGGTGGTGGACATCGCGAACCAGGCCGTG
CAGCGCGAGATAAACAGCCGCCTGGACCCGCGGCCGCCCACGGTGGTGGAGAT
GGAAGATGCAACTCTTCCGCCGCCCAAGGGCGAGAAGCGGCCGCGGCCCGACG
CGGAGGAGACGATCCTGCAGGTGGACGAGCCGCCCTCGTACGAGGAGGCCGTC
AAGGCCGGCATGCCCACCACGCGCATCATCGCGCCGCTAGCCACGGGTGTAATG
AAACCCGCCACCCTTGACCTGCCTCCACCACCCACGCCCGCTCCACCGAAGGCA
GCTCCGGTCGTGCAGGCCCCCCGGTGGCGACTGCCGTGCGCCGCGTCCCCGCC
CGCCGTCAGGCCCAGAACTGGCAGAGCACGCTGCACAGTATCGTGGGCCTGGGA
GTGAAAAGTCTGAAGCGCCGCCGATGCTATTGACAGAGAGGAAAGAGGACACT
AAAGGGAGAGCTTAACTTGTATGTGCCTTACCGCCAGAGAACGCGCGAAGATGG
CCACCCCCTCGATGATGCCGCAGTGGGCGTACATGCACATCGCCGGGCAGGACG
CCTCGGAGTACCTGAGCCCGGGTCTGGTGCAGTTTGCCCGCGCCACCGACACGT
ACTTCAGCCTGGGCAACAAGTTTAGGAACCCCACGGTGGCTCCCACCCACGATG
TGACCACGGACCGGTCCCAGCGTCTGACGCTGCGCTTCGTGCCCGTGGATCGCG
AGGACACCACGTACTCGTACAAGGCGCCTTCACTCTGGCCGTGGGCGACAACC
GGGTGCTAGACATGGCCAGCACTTACTTTGACATCCGCGGCGTCCTGGACCGCG
GTCCCAGTTTCAAACCCTACTCGGGCACAGCCTACAACAGCCTGGCCCCCAAGG
GTGCCCCCAATCCTAGTCAGTGGATTACAAAGAAAAGCAAACCGGAGTAAATG
CAGGAGACAAAGATGTTACAAAGACATTTGGAATTGCCGCCATGGGAGGCAGTA
ATATTTCTAAAGACGGTTTACAGATTGGAACTGACACAACAGCAGCTGCTGCAA
AACCAATATATGCAGACAAAACTTTCCAGCCAGAACCTCAAGTTGGAGAAGAAA
ACTGGCAGGATAATGATGAATATTATGGCGGCAGGGCTCTTAAAAAAGATACCA
AAATGAAGCCATGCTATGGTTCATTTGCTAAACCCACAAACAAGGAAGGTGGGC
AGGCTAAATTGAAAGAAACACCCAATGGTGCCGATCCTCAATATGATGTGGACA
TGGCTTTCTTTGACTCAACCACTATAAATATACCAGATGTTGTGTTATACACTGA
AAATGTAGATTTGGAAACTCCAGATACACATGTGGTGTACAAACCAGGCAAAGA
GGATGACAGTTCTGAAGCTAATTTAACTCAGCAGTCCATGCCTAACAGACCAAA
CTACATTGGCTTCAGAGACAACTTTGTGGGGCTATTGTACTACAACAGCACTGGC
AACATGGGTGTGCTGGCTGGTCAGGCATCTCAGTTGAATGCCGTGGTCGACTTGC
AAGACAGAAACACCGAACTGTCTTACCAGCTCTTGCTAGATTCTCTGGGTGACA
GAACCAGATATTTTAGTATGTGGAACTCTGCGGTGGACAGCTATGATCCCGATGT
CAGGATCATTGAGAACCACGGTGTGGAAGACGAACTTCCTAACTATTGCTTCCC
CTTGGACGGTGTTCAAACTAATTCAGCCTACCAAGGTGTTAAACTAAAGGCTAA
TCCAGCAGGAGGCGGAGCTAATGGAGATTGGGAAAAGGATGATACCATTTCAGT
CCATAATCAAATTGGAAAGGGCAACATCTTTGCCATGGAGATCAACCTCCAGGC
CAACCTGTGGAAAAGTTTTCTGTACTCGAACGTGGCCCTGTACCTGCCCGACTCC
TACAAGTACACGCCGGCCAACGTCACGCTGCCCACCAACACCAACACCTACGAC
TACATGAACGGCCGCGTGGTAGCCCCATCCCTGGTGGACGCCTACATCAACATC
GGCGCCCGCTGGTCGCTGGATCCCATGGACAACGTCAACCCCTTCAACCACCAC
CGCAATGCGGGGCTGCGCTACCGCTCCATGCTTCTGGGCAACGGCCGCTACGTA
CCCTTCCACATCCAAGTGCCCCAAAAGTTCTTTGCCATCAAGAACCTGCTCCTGC
TCCCCGGCTCCTACACCTACGAGTGGAACTTCCGCAAGGATGTCAACATGATCCT
GCAGAGCTCCCTCGGCAACGACCTGCGCGTCGACGGCGCCTCCGTGCGCTTCGA
CAGCGTCAACCTCTACGCCACCTTCTTCCCCATGGCGCACAACACCGCCTCCACC
CTGGAAGCCATGCTGCGCAACGACACCAACGACCAGTCCTTCAACGACTACCTC
TCGGCCGCCAACATGCTCTACCCCATCCCTGCCAAGGCCACCAACGTGCCCATCT
CCATTCCCTCGCGCAACTGGGCCGCCTTCCGCGGCTGGAGTTTCACCCGGCTCAA
GACCAAGGAAACTCCCTCCCTCGGCTCGGGTTTCGACCCCTACTTTGTCTACTCG
GGCTCCATTCCCTACCTCGACGGGACCTTCTACCTCAACCACACCTTCAAGAAGG
TCTCCATCATGTTCGACTCCTCGGTCAGCTGGCCCGGCAACGACCGGCTGCTCAC
GCCGAACGAGTTCGAGATCAAGCGCAGCGTCGACGGGGAGGGCTACAACGTGG
CCCAATGCAACATGACCAAGGACTGGTTCCTCGTCCAGATGCTCTCCCACTACAA
CATCGGCTACCAGGGCTTCTACGTGCCCGAGGGCTACAAGGACCGCATGTACTC
CTTCTTCCGCAACTTCCAGCCCATGAGCAGGCAGGTGGTCGATGAGATCAACTA
CAAGGACTACAAGGCCGTTACCCTGCCCATTCCAGCACAACAACTCGGGCTTCAC
CGGCTACCTCGCACCCACCATGCGTCAGGGGCAGCCCTACCCCGCCAACTTCCCC
TACCCGCTCATTGGTCAGACAGCCGTGCCCTCCGTCACCCAGAAAAAGTTCCTCT
GCGACAGGGTCATGTGGCGCATCCCCTTCTCCAGCAACTTCATGTCCATGGGCGC
CCTCACCGACCTGGGTCAGAACATGCTCTACGCCAACTCGGCCCACGCGCTCGA
CATGACCTTCGAGGTGGACCCCATGGATGAGCCCACCCTCCTCTATCTTCTCTTC
```

TABLE 7-continued

Nucleic Acid Sequences of Vectors

SEQ ID NO Sequence

GAAGTTTTCGACGTGGTCAGAGTGCACCAGCCGCACCGCGGCGTCATCGAGGCC
GTCTACCTGCGCACGCCATTCTCCGCCGGCAACGCCACCACCTAAGCATGAGCG
GCTCCAGCGAACGAGAGCTCGCGGCCATCGTGCGCGACCTGGGCGTGTGGGCCCT
ACTTTTTGGGCACCCACGACAAGCGATTCCCGGGCTTCCTCGCCGGCGACAAGCT
GGCCTGCGCCATCGTCAACACGGCCGGCCGCGAGACCGGAGGCGTGCACTGGCT
CGCCTTTGGCTGGAACCCGCGCTCGCGCACCTGCTACATGTTCGACCCATTTGGG
TTCTCGGACCGCCGGCTCAAGCAGATTTACAGCTTCGAGTACGAGGCCATGCTG
CGCCGAAGCGCCCTGGCCTCCTCGCCCGACCGCTGTCTCAGCCTAGAGCAGTCC
ACCCAGACCGTGCAGGGGCCCGACTCCGCCGCCTGCGGACTCTTCTGTTGCATGT
TCTTGCATGCCTTCGTGCACTGGCCCGACCGACCCATGGACGGAAACCCCACCAT
GAACTTGCTGACGGGGGTGCCCAACGGCATGCTACAATCGCCACAGGTGCTGCC
CACCCTCAGGCGCAACCAGGAGGAGCTCTACCGCTTCCTCGCGCGCCACTCCCCT
TACTTTCGCTCCCACCGCGCCGCCATCGAACATGCCACCGCTTTTGATAAAATGA
AACAACTGCGTGTATCTCAATAAACAGCACTTTTATTTTACATGCACTGGAGTAT
ATGCAAGTTATTTAAAAGTCGAAGGGGTTCTCGCGCTCGTCGTTGTGCGCCGCGC
TGGGGAGGGCCACGTTGCGGTACTGGTACTTGGGCTGCCACTTGAACTCGGGGA
TCACCAGTTTGGGCACTGGGGTCTCGGGGAAGGTCTCGCTCCACATGCGCCGGC
TCATCTGCAGGGCACCCAGCATGTCCGGGCCGGAGATCTTGAAATCGCAGTTGG
GGCCGGTGCTCTGCGCGCGCGAGTTGCGGTACACGGGGTTGCAGCACTGGAACA
CCATAAGACTGGGGTACTTCACACTGGCCAGCACGCTCTTGTCGCTGATCTGATC
CTTGTCCAGGTCCTCGGCGTTGCTCAGGCCGAACGGGGTCATCTTGCACAGCTGG
CGGCCCAGGAAGGGCACGCTCTGAGGCTTGTGGTTACACTCGCAGTGCACGGGC
ATCAGCATCATCCCCGCGCCGCGCTGCATATTCGGGTAGAGGGCCTTGACAAAG
GCCGCGATCTGCTTGAAAGCTTGCTGGGCCTTGGCCCCCTCGCTGAAAAACAGG
CCGCAGCTCTTCCCGCTGAACTGGTTATTCCCGCACCCGGCATCCTGCACGCAGC
AGCGCGCGTCATGGCTGGTCAGTTGCACCACGCTCCGTCCCCAGCGGTTCTGGGT
CACCTTGGCCTTGCTGGGTTGCTCCTTCAACGCGCGCTGCCCGTTCTCACTGGTC
ACATCCATCTCCACCACGTGGTCCTTGTGGATCATCACCGTTCCATGCAGACACT
TGAGCTGGCCTTCCACCTCGGTGCAGCCGTGGTCCCACAGGACGCAGCCGGTGC
ACTCCCAGTTCTTGTGCGCGATCCCGCTGTGGCTGAAGATGTAACCTTGCAACAT
GCGGCCCATGATGGTGCTAAAGGTTTTCTGAGTGGTGAAAGTCAGTTGCAGACC
GCGAGCCTCCTCGTTCATCCAGGTCTGGCACATCTTTTGGAAGATCTCGGTCTGC
TCGGGCATTAGCTTGTAAGCATCGCGCAGGCCGCTGTCGACGCGGTAGCGTTCC
ATCAGCACGTTCATGGTATCCATGCCCTTCTCCCAAGACGAGACCAGAGGCAGA
CTTAGGGGGTTGCGCACGTTCAGGACACCGGGGGTCGCGGGCTCGACGATGCGT
TTTCCGTCCTTGCCTTCCTTCAACAGAACCGGCGGCTGGCTGAATCCCACTCCCA
CGATCACGGCTTCTTCCTGGGGCATCTCTTCGTCGGGGTCTACCTTGGTCACATG
CTTGGTCTTCCTGGCTTGCTTCTTTTTTGGAGGGCTGTCCACGGGGACCACGTCCT
CCTCGGAAGACCCGGAGCCCACCCGCTGATACTTTCGGCGCTTGGTGGGCAGAG
GAGGCGGCGGCGGCGAGGGGCTCCTCTCCTGCTCCGGCGGATAGCGCGCCGACC
CGTGGCCCCGGGCGGAGTGGCCTCTCGCTCCATGAACCGGCGCACGTCCTGAC
TGCCGCCGGCCATTGTTTCCTAGGGGAAGATGGAGGAGCAGCCGCGTAAGCAGG
AGCAGGAGGAGGACTTAACCACCCACGAGCAACCCAAAATCGAGCAGGACCTG
GGCTTCGAAGAGCCGGCTCGTCTAGAACCCCCACAGGATGAACAGGAGCACGA
GCAAGACGCAGGCCAGGAGGAGACCGACGCTGGGCTCGAGCATGACTACCTGG
GAGGAGAGGAGGATGTGCTGCTGAAACACCTGCAGCGCCAGTCCCTCATCCTCC
GGGACGCCCTGGCCGACCGGAGCGAAACCCCCCTCAGCGTCGAGGAGCTGTGTC
GGGCCTACGAGCTCAACCTCTTCTCGCCGCGCGTGCCCCCCAAACGCCAGCCCA
ACGGCACATGCGAGCCCAACCCGCGTCTCAACTTCTATCCCGTCTTTGCGGTCCC
CGAGGCCCTCGCCACCTATCACATCTTTTTCAAGAACCAAAAGATCCCCGTCTCC
TGCCGCGCCAACCGCACCCGCGCCGACGCGCTCCTCGCTCTGGGCCCGGCGCG
CGCATACCTGATATCGCTTCCCTGGAAGAGGTGCCCAAGATCTTCGAAGGGCTC
GGTCGGGACGAGACGCGCGGCGAACGCTCTGAAAGAAACAGCAGAGGAAGA
GGGTCACACTAGCGCCCTGGTAGAGTTGGAAGGCGACAACGCCAGGCTGGCCGT
GCTCAAGCGCAGCGTCGAGCTCACCCACTTCGCCTACCCCGCCGTCAACCTCCCG
CCCAAGGTCATGCGTCGCATCATGGATCAGCTCATCATGCCCCACATCGAGGCC
CTCGATGAAAGTCAGGAGCAGCGCCCCGAGGACGCCCGGCCCGTGGTCAGCGAC
GAGATGCTCGCGCGCTGGCTCGGGACCCGCGACCCCCAGGCTTTGGAGCAGCGG
CGCAAGCTCATGCTGGCCGTGGTCCTGGTCACCCTCGAGCTCGAATGCATGCGCC
GCTTCTTCAGCGACCCCGAGACCCTGCGCAAGGTCGAGGAGACCCTGCACTACA
CTTTCAGGCACGGTTTCGTCAGGCAGGCCTGCAAGATCTCCAACGTGGAGCTGA
CCAACCTGGTCTCCTGCCTGGGGATCCTGCACGAGAACCGCCTGGGACAGACCG
TGCTCCACTCTACCCTGAAGGGCGAGGCGCGTCGGGACTATGTCCGCGACTGCG
TCTTTCTATTTCTCTGCCACACATGGCAAGCGGCCATGGGCGTGTGGCAGCAGTG
TCTCGAGGACGAGAACCTGAAGGAGCTGGACAAGCTTCTTGCTAGAAACCTTAA
AAAGCTGTGGACGGGCTTCGACGAGCGCACCGTCGCCTCGGACCTGGCCGAGAT
CGTCTTCCCCGAGCGCCTGAGGCAGACGCTAAAAGGCGGCCTGCCCGACTTCAT
GAGCCAGAGCATGTTGCAAAATTACCGCACTTTCATTCTCGAGCGCTCGGGGAT
CCTGCCCGCCACCTGCAACGCCTTCCCCTCCGACTTTGTCCCACTGAGCTACCGC
GAGTGTCCCCCGCCGCTGTGGAGCCACTGCTATCTTGCAGCTGGCCAACTACA
TCGCCTACCACTCGGACGTGATCGAGGACGTGAGCGGTGAGGGGCTTCTCGAGT
GCCACTGCCGCTGCAACCTGTGCTCTCCGCACCGCTCCCTGGTCTGCAACCCCCA
GCTCCTGAGCGAAACCCAGGTCATCGGTACCTTCGAGCTGCAAGGTCCGCAGGA
GTCCACCGCTCCGCTGAAACTCACGCCGGGGTTGTGGACTTCCGCGTACCTGCGC
AAATTTGTACCCGAGGACTACCACGCCCATGAGATAAAGTTCTTCGAGGACCAA
TCGCGGCCGCAGCACGCGGATCTCACGGCCTGCGTCATCACCCAGGGCGCGATC

TABLE 7-continued

Nucleic Acid Sequences of Vectors

SEQ ID NO Sequence

CTCGCCCAATTGCACGCCATCCAAAAATCCCGCCAAGAGTTTCTTCTGAAAAAG
GGTAGAGGGGTCTACCTGGACCCCCAGACGGGCGAGGTGCTCAACCCGGGTCTC
CCCCAGCATGCCGAGGAAGAAGCAGGAGCCGCTAGTGGAGGAGATGGAAGAAG
AATGGGACAGCCAGGCAGAGGAGGACGAATGGGAGGAGGAGACAGAGGAGGA
AGAATTGGAAGAGGTGGAAGAGGAGCGGGCAACAGAGCAGCCCGTCGCCGCAC
CATCCGCGCCGGCAGCCCCTCCGGTCACGGATACAACCTCCGCAGCTCCGGTCA
AGCCTCCTCGTAGATGGGATCGAGTGAAGGGTGACGGTAAGCACGAGCGGCAG
GGCTACCGATCATGGAGGGCCCACAAAGCCGCGATCATCGCCTGCTTGCAAGAC
TGCGGGGGGAACATCGCTTTCGCCCGCCGCTACCTGCTCTTCCACCGCGGGGTGA
ACATCCCCCGCAACGTGTTGCATTACTACCGTCACCTTCACAGCTAAGAAAAAG
CAAGTAAGAGAAGTCGCCGGAGGAGGAGGAGGCCTGAGGATCGCGGCGAACGA
GCCCTTGACCACCAGGGAGCTGAGGAACCGGATCTTCCCCACTCTTTATGCCATT
TTTCAGCAGAGTCGAGGTCAGCAGCAAGAGCTCAAAGTAAAAAACCGGTCTCTG
CGCTCGCTCACCCGCAGTTGCTTGTACCACAAAAACGAAGATCAGCTGCAGCGC
ACTCTCGAAGACGCCGAGGCTCTGTTCCACAAGTACTGCGCGCTCACTCTTAAAG
ACTAAGGCGCGCCCACCCGGAAAAAAGGCGGGAATTACCTCATCGCCACCATGA
GCAAGGAGATTCCCACCCCTTACATGTGGAGCTATCAGCCCCAGATGGGCCTGG
CCGCGGGCGCCTCCCAGGACTACTCCACCCGCATGAACTGGCTCAGTGCCGGCC
CCTCGATGATCTCACGGGTCAACGGGGTCCGCAGTCATCGAAACCAGATATTGT
TGGAGCAGGCGGCGGTCACCTCCACGCCCAGGGCAAAGCTCAACCCCCGTAATT
GGCCCTCCACCCTGGTGTATCAGGAAATCCCGGGCCGACTACCGTACTACTTCC
GCGTGACGCACTGGCCGAAGTCCGCATGACTAACTCAGGTGTCCAGCTGGCCGG
CGGCGCTTCCCGGTGCCCGCTCCGCCCACAATCGGGTATAAAAACCCTGGTGAT
CCGAGGCAGAGGCACACAGCTCAACGACGAGTTGGTGAGCTCTTCGATCGGTCT
GCGACCGGACGGAGTGTTCCAACTAGCCGGAGCCGGGAGATCCTCCTTCACTCC
CCACCAGGCCTACCTGACCTTGCAGAGCAGCTCTTCGGAGCCTCGCTCCGGAGG
CATCGGAACCCTCCAGTTCGTGGAGGAGTTTGTGCCCTCGGTCTACTTCAACCCC
TTCTCGGGATCGCCAGGCCTCTACCCGGACGAGTTCATACCGAACTTCGACGCA
GTGAGAGAAGCGGTGGACGGCTACGACTGAATGTCCCATGGTGACTCGGCTGAG
CTCGCTCGGTTGAGGCATCTGGACCACTGCCGCCGCCTGCGCTGCTTCGCCCGGG
AGAGCTGTGGCCTCATCTACTTTGAGTTTCCCGAGGAGCACCCCAACGGCCCTGC
ACACGGAGTGCGGATCACCGTAGAGGGCACCACCGAGTCTCACCTGGTCAGGTT
CTTCACCCAGCAACCCTTCCTGGTCGAGCGGGACCGGGGCGCCACCACCTACAC
CGTCTACTGCATCTGTCCTACCCCGAAGTTGCATGAGAATTTTTGCTGTACTCTTT
GTGCTGAGTTTAATAAAAGCTGAAATAAAAATCTTCTCTGGACCTTGTCATCGAC
CTCGGAACAGCACCGTCTTACTCACCAATCAGACCAAGGTTCGTCTGAACTGCA
CAACCAACAGGAAGTACCTTCTCTGGACTTTCCAAAACACCTCACTCGCTGTTGT
CAACGCCCGTGACGACGACGGTGTTTTAATCCCCAACAACCTCACCAGTGGACT
TACTTTCAGCACAAGAAAAACTAAGCTCGTCCTCCACAAACCTTTTGTAGAGGG
AACCTACCAGTGCCGACACGGACCTTGTGTTCTCAACTTCCATTTGGTGAACATT
ACCAGCAGCAGTACAGTTGCTCCTGAAACAACTAACCTTTCTTCTGATACTAACA
AACCTCGTGTCGGAGGTGAGCTTTGGGTTCCCTCTCTAACAGAGGGTGGGAGTTC
TATTGAAGTGGTTGGGTATTTGATTTTAGGGGTGGTCCTGGGTGGGTGCATAGCG
GTGCTATATCACCTTCCTTGCTGGGTCGAAATCAGAGTCTTTATCTGCTGGGTCA
GACATTGTGGGGAGGAACCATGAAGGGGCTCTTGCTGATTATCCTTTCCCTGGTG
GGGGGTGTACTGTCATGCCACGAACAGCCACGATGTAACATCACCACAGGCAAT
GAGAGAAGCGAATGCTCTATAGTGATCAAATGTGAGCACAAATGTTCTCTCAAC
ATCACATTCAAGAATAAGACCATGGGAAATGTATGGGTGGGATTCTGGCAACCA
GGAGATGAGCAGAACTACACGGTCACTGTCCATGGTAGCGATGGAAATCACACT
TTCGGTTTCAAATTCATTTTTGAAGTCATGTGTGATATCACACTGCATGTGGCTA
GACTTCATGGCTTGTGGCCCCCTACCAAGGAGAACATGGTGGGTTTTCTTTGGC
TTTTGTGATCATGGCCTGCTTTATGTCAGGTCTGCTGGTAGGGGCTCTAGTGTGG
TTTCTGAAGCGCAAGCCCAGGTATGGAAATGAGGAGAAGGAAAAATTGCTATAA
ATCTTTTTCTCTTCGCAGAACCATGAATACTTTGACCAGTGTCGTGCTGCTCTC
TTCCTTGTAGCTTTTAGTCAGGGACAAGCTGTGCATGTGAAACTTGAAATTTGTTA
TGGTTGTAATGGTACACTAATAGGACCACATAAAACTCCAGTTGAGTGGTATGA
CGGCAGAGGACACAAACTTTGTGCAGGATCTGATACTTTTCACAAGGAACTAAA
TCACACATGTGATTTACAAAATATGACACTTACATTTGTTAACTTAACTCATAAG
GGTACTTACTATGGTTTTGGCAGTGATAACAAAAACTCTAAAGTATACCAGGTTA
CTATTAAGCCACCTGTTCTGACAACTCGCAGGCCTTTATTAAAACCTGAAGATAT
TGTAATCACTAAGGGAAGCAACAAAACTCTTGTGGGTCCTCCAGATACACCAGT
TGACTGGTATGATGGTTCAGGACATAAATTGTGTAAAGGAAAAGAAGTTCATTA
CCCTGAACTCAATCACACCTGTGATGAGCAGAACCTTACACTCATATTTGTAAAT
GCCACTTTTAAGGGAACCTATTATGGCTTTAGAAAAGATGGCACAGACAAAAG
GAATATAGAGTCAAAATTGATGATTTATATGCAAAACAACTAAAACAGGAAAAA
GATGAAAAACCAAGGTCTGGCCATGATAAGCAGAAATCAAAAACAGAAGAAAA
ACAAAATCCAAAAACAGAAGAAAGGCATGGGCATAGAGATGTTGTTAAAGAAG
TTAGTTTTAGAACTGGAACTAATCAAACTCTAGTGGGCCCACCAGGGTCTAAGG
TTGATTGGCTTAAAGTTGGAAATGGTGGGACATTTAGCGAACTTTGTAAAAGCG
ATAATAAACACTATTCTTGTAATTCTCAAACTTAACAATAATCAATGTTACCAG
ATTTGATGAAGGTAGCTATTATGGCTCTAATGACGGTTCAGCTCATTACAGAGTT
TCAGTCTATGACCCAGTACAGAAAAAAGGGTTATGAAAATACAACCACACACA
ACAAAAACTACTGCAAAAAAAACTACAAAAAGCAGCGCTAATGAACAGATGA
AAACTTTGCTTTGCAACAGGGTAACAATGGGAAAATCAATATGATGAAACTAA
TATTCCTTCAACTACTGTGGCAATCGTGGTGGGAGTGATTGCGGGCTTCATAACT
ATAATCATTGTCATTCTGTGCTACATCTGCTGCCGCAAGCGTCCCAGGGCATACA

TABLE 7-continued

Nucleic Acid Sequences of Vectors

| SEQ ID NO | Sequence |
|---|---|
| | ATCATATGGTAGACCCACTACTCAGCTTCTCTTACTGAGACTCAGTCACTTTCAT
TTCAGAACCATGAAGGCTTTCACAGCTTGCGTTCTGATTAGCCTAGTCACACTTA
GTTTAGCCAAAATTAATCAAATCAGTGTCAAAAGAGGTGAAAATGTTACACTAG
ATGGAACTTATCCAAATACTACATGGACAAGATATCCACCTTACAAAATGGGATA
ATATTTGCAAATGGAATATTTCAACATATAAATGTCATAATAATGGAAGCATTAC
AATTCATACTTTTAATATCACTTCTGGATTATACAAGGGAGATAGCTATAAAAGA
GAAGTGATAACATCAATGTCTAAATTTGGAAATATGACAGACACTTATTTCAGC
GAATATCAACAATTAAAAATGTATAATTTAACAATAATTGAACCACCAACTACT
AAAGCACCCACTACCACTAAGCCTACCACAGTTAAGACAACAACAACCTACCACT
GTGCCCACTACACATCCAACCACCGCAGTCAGTACAACTATTGAAACCACTACT
CACACTACACAGCTAGACACTACAGTGCAGAATAGTACTGTGTTGGTTAGGTAT
CTGTTGAGGGAGGAAAGTACTACTGAACAGACAGAGGCTACCTCAAGTGCCTTC
AGCAGCACTGCAAATTTAACTTCGCTTGCTTCAATAAATGAGACCCTCGTGCCGA
TGAAACAGGATCAACCTAATTACTCAGGTTTGGATATGCAAATTACTTTCTTAAT
TGTCTGTGGAGTCTTTATTCTTGTGGTTCTTCTTTACTTTGTCTTTTGCAAAGCCA
GACAAAAATCTCATAGAACAATCTACAGGCCAGTGATTGGGGAACCTCAGCCCC
TCCAAGTGGACGGAGGCTTAAGGAATCTTCTCTTCTCTTTTACAGTATGGTGATC
AGCCATGATTCCTAGGTTCTTCCTATTTAACATCCTCTTCTGTCTCTTCAACATCT
GTGCTGCCTTCGCGGCCGTCTCGCACGCCTCACCCGACTGTCTCGGGCCCTTCCC
CACCTACCTCCTCTTTGCCCTGCTCACCTGCACCTGCGTCTGCAGCATTGTTTGCT
TGGTCGTCACCTTCCTGCAGCTCATCGACTGGTGCTGCGCGCGCTACAATTATCT
CCACCACAGTCCCGAATACAGGGACGAGAACGTAGCCAGAATATTAAGGCTCAT
ATGACCATGCAGACTCTGCTCATATTGCTATCCCTCTTATCCCCTGCCATTGCCGC
TCCTGATTACTCTAAATGCAAATTTGTGGAACTATGGAATTTCTTAGACTGCTAT
GATGCTAAAATGGATATGCCTTCCTATTACTTGGTAATTGTGGGGATAGTCATGG
TCTGCTCATGCACTTTCTTTGCCATCATGATCTACCCCTGTTTTGATCTCGGCTGG
AATTCTGTTGAGGCATTCACATACACACTAGAAAGCAGTTCACTAGCCTCCACGC
CACCACCCACACCGCCTCCCCGCAGAAATCAGTTCCCCTTGATACAATACTTAGA
AGAGCCCCCTCCCCGACCCCCTTCCACTGTTAGCTACTTTCACATAACCGGCGGC
GATGACTGACCACCTGGACCTCGAGATGGACGGCCAGGCCTCCGAGCAGCGCAC
CCTGCAACTGCGCGTCCGTCAGCAGCAGGAGCGGGCCGCCAAGGAGCTCCTCGA
TGCCATCAACATCCACCAGTGCAAGAAGGGCATCTTCTGCCTGGTCAAACAGGC
AAAGATCACCTACGAGCTCGTGTCCGGCGGCAAACAGCATCGCCTCGCCTATGA
GCTGCCCCAGCAGAAGCAGAAGTTCACCTGCATGGTGGGCATCAACCCCATAGT
CATCACCCAGCAGTCGGGCGAGACCAGCGGCTGCATCCACTGCTCCTGCGAAAG
CCCCGAGTGCATCTACTCACTGCTCAAGACCCTTTGCGGACTCCGCGACCTTCTC
CCCATGAACTGATGTTGATTAAAATCCCAGAAACCAATCAGCCCCTTACCCCATT
CCCCTCCCCAATTACTCATAACACATTTGGAATTAATGATTCAATAAAGATCACT
TACTTGAAATCTGAAAGTATGTCTCTGGTGTAGTTGTTCAGCAGCACCTCGGTAC
CCTCCTCCCAGCTCTGGTACTCCAGTCCTCGGCGGGCGGCGAACTTCCTCCACAC
CTTGAAAGGGATGTCAAATTCCTGGTCCACAATTTTCATTGTCTTCCCTCTCAGA
TGTCAAAGAGGCTCCGGGTGGAAGATGACTTCAACCCCGTCTACCCCTATGGCT
ACGCGCGGAATCAGAATATCCCCTTCCTTACTCCCCCCTTTGTCTCATCCGATGG
ATTCAAAAACTTCCCACCTGGGGTCCTGTCACTCAAACTGGCTGACCCAATCGCC
ATCACTAATGGGGATGTCTCACTCAAGGTGGGAGGGGGACTAACTGTGGAACAA
GATAGTGGAAACCTAAGTGTAAACCCTAAGGCTCCATTGCAAGTTGGAACAGAC
AAAAAACTGGAATTGGCTTTAGCACCTCCATTTGATGTCAGAGATAACAAGCTA
GCTATTCTAGTAGGAGATGGATTAAAGGTAATAGATAGCAATATCTGATTTG
CCAGGTTTGTTAAACTATCTTGTAGTTTTGACTGGCAAAGGAATTGGAAATGAAG
AATTAAAAAATGACGATGGTAGCAATAAAGGAGTCGGTTTATGTGTGAGAATTG
GAGAAGGAGGTGGTTTAACTTTTGATGATAAAGGTTATTTAGTAGCATGGAACA
ATAAACATGACATCCGCACACTTTGGACAACTTTAGACCCTTCTCCAAATTGTAA
GATAGATATAGAAAAAGACTCAAAACTAACTTTGGTACTGACAAAGTGCGGAAG
TCAGATTTTGGCAAATGTATCTCTAATTATAGTCAACGGAAAGTTTAAGATCCTT
AATAACAAAACAGACCCATCCCTACCTAAATCATTTAACATCAAACTACTGTTTG
ATCAAAATGGAGTTCTATTGGAAAATTCAAACATTGAAAAACAGTACCTAAACT
TTAGAAGTGGAGACTCTATTCTTCCAGAGCCATATAAAAATGCAATTGGATTTAT
GCCTAATTTACTAGCTTATGCTAAAGCTACAACTGATCAGTCTAAAATTTATGCA
AGGAACACTATATATGGAAATATCTACTTAGATAATCAGCCATATAATCCAGTT
GTAATTAAAATTACTTTTAATAATGAAGCAGATAGTGCTTATTCTATCACTTTTA
ACTATTCATGGACCAAGGACTATGACAATATCCCTTTTGATTCTACTTCATTTAC
CTTCTCCTATATCGCCCAAGAATGAAAGACCAATAAACATGTTCTCATTTGAAAA
TTTTCATGTATCTTTATTGATTTTTACACCAGCACGGGTAGTCAGTCCCACCAC
CAGCCCATTTCACAGTGTAAACAATTCTCTCAGCACGGGTGGCCTTAAATAGGG
AAATGTTCTGATTAGTGCGGGAACTGGACTTGGGGTCTATAATCCACACAGTTTC
CTGGCGAGCCAAACGGGGGTCGGTGATTGAGATGAAGCCGTCCTCTGAAAAGTC
ATCCAAGCGGGCCTCACAGTCCAAGGTTACAGTCTGGTGGAATGAGAAGAACGC
ACAGATTCATACTCGGAAAACAGGATGGGTCTGTGCCTCTCCATCAGCGCCCTC
AGCAGTCTCTGCCGCCGGGGCTCGGTGCGACTGCTGCAGATGGGATCGGGATCA
CAAGTCTCTCTGACTATGATCCCCACAGCCTTCAGCATCAGTCTCCTGGTGCGTC
GGGCACAGCACCGCATCCTGATCTCTGCCATGTTCTCACAGTAAGTGCAGCACAT
AATCACCATGTTATTCAGCAGCCCATAATTCAGGGTGCTCCAGCCAAAGCTCATG
TTGGGGATGATGGAACCCACGTGACCATCGTACCAGATGCGGCAGTATATCAGG
TGCCTGCCCCTCATGAACACACTG |

TABLE 7-continued

Nucleic Acid Sequences of Vectors

SEQ ID NO | Sequence

SEQ ID NO: 1435
CATCATCAATAATATACCCCACAAAGTAAACAAAAGTTAATATGCAAATGAGCT
TTTGAATTTAGGGCGGGGCCAGCACTGATTGGCCGTTGCAAGAACCGTTAGTGA
CGTCACGACGCACGGCGTCAACGGTCGCCGCGGAGGCGTGGCCTAGTCCGGAAG
CAAGTCGCGGGGCTGATAACGTATAAAAAAGCGGACTTTAAACCCGGAAACGG
CCGATTTTCCCGCGGCCACGCCCGGATATGAGGTAATTCTGGGCGGATGCAAGT
GAAATTAGGCCATTTTGGCGCGAAAACTGAATGAGGAAGTGAAAAGTGAAAAA
TACCGGGCCCGCCCAGGGCGGAATATTTACCGAGGGCCGAGAGACTTTGACCGA
TTACGTGGGGGTTTCGATTGCGGTGTTTTTTCGTGAATTTCCGCGTCCGTGTCAA
AGTCCGGTGTTTATGTCACAGATCAGCTGATCCACAGGGTATTTAAACCAGTCGA
TCCCGTCAAGAGGCCACTCTTGAGTGCCAGCGAGTAGAGATTTCTCTGAGCTCCG
CTCCCAGAGTCTGAGAAAAATGAGACACCTGCGCCTCCTGTCTTCAACTGTGCCT
ATTGACATGGCCGCATTATTGCTGGAGGATTATGTGAGTACAATATTGGAGGAC
GAACTGCATCCATCTCCATTCGAGCTGGGACCTACACTTCAGGACCTATATGATT
TGGAGGTAGATGCCCATGATGACGACCCGAACGAAGAGGCTGTGAATTTAATAT
TTCCAGAATCTCTGATTCTTCAGGCTGACATAGCCAGCGAAGCTGTACCTACACC
ACTTCATACACCGACTCTGTCACCCATACCTGAATTGGAAGAGGAGGACGAGCT
AGACCTCCGATGTTATGAGGAAGGTTTTCCTCCCAGCGATTCAGAGGACGAACA
GGGTGAGCAGAGCATGACTCTAATCTCAGAATATGCTTGTGTGGTTGTGGAAGA
GCATTTTGTGTTGGACAATCCTGAGGTGCCCGGGCAAGGCTGTAGATCCTGCCA
GTACCACCGGGATAAGACCGGAGACACGAACGCCTCCTGCGCTCTGTGTTACAT
GAAAAAGAACTTCAGCTTTATTTACAGTAAGTGGAGTAAATGTGAGAGAGACTG
AGTGCTTAACACATAACTGGGTGATGCTTAAACAGCTGTGCTAAGTGTGGTTTAT
TTTTGTTTCTAGGTCCGGTGTCAGAGGATGAGTCATCACCCTCAAAAGAAGACCA
CCCGTGTCCCCCTGAGCTGTCAGGCGAAACGCCCCTGCAAGTGCACAGACCCAC
CCCAGTCAGACCCAGTGGCGAGAGGCGAGCAGCTGTTGAAAAAATTGAGGACTT
GTTACATGACATGGGTGGGGATGAACCTTTGGACCTAAGCTTGAAACGCCCCAG
GAACTAGGCTCAGCTGTGCTTAGTCATGTGTAAATAAAGTTGTACAATAAAAGT
ATATGTGACGCATGCAAGGTGTGGTTTATGACTCATGGGCGTGGCTTAGTCCTAT
ATAAGTGGCAACACCTGGGCACTGGGGCACAGACCTTCAGGGAGTTCCTGATGG
ATGTGTGGACTATCCTTGCAGACTTTAGCAAGACACGCCGGCTTGTAGAGGATA
GTTCAGACGGGTGCTCCGGGTTCTGGAGACACTGGTTTGGAACTCCTCTATCTCG
TCTGGTGTACACAGTTAAGAAGGATTATAACGAGGAATTTGAAAATCTTTTTGCT
GATTGCTCTGGCCTGCTAGATTCTCTGAATCTCGGCCACCAGTCCCTTTTCCAGG
AAAGGGTACTCCACAGCCTTGATTTTTCCAGCCCAGGGCGCACTACAGCCGGGG
TTGCTTTTGTGGTTTTTCTGGTTGACAAATGGAGCCAGAACACCCAACTGAGCAG
GGGCTACATTCTGGACTTCGCAGCCATGCACCTGTGGAGGGCATGGGTGAGGCA
GCGGGGACAGAGAATCTTGAACTACTGGCTTATACAGCCAGCAGCTCCGGGTCT
TCTTCGTCTACACAGACAAACATCCATGTTGAGGAAGAAATGAGGCAGGCCAT
GGACGAGAACCCGAGGAGCGGCCTGGACCCTCCGTCGGAAGAGGAGCTGGATT
GAATCAGGTATCCAGCTTGTACCCAGAGCTTAGCAAGGTGCTGACATCCATGGC
CAGGGGAGTGAAGAGGGAGAGGAGCGATGGGGGCAATACCGGGATGATGACCG
AGCTGACGGCCAGCCTGATGAATCGCAAGCGCCCAGAGCGCATTACATGGCACG
AGCTACAGATGGAGTGCAGGGATGAGTTGGGCCTGATGCAGGATAAATATGGCC
TGGAGCAGATAAAAACACATTGGTTGAACCCAGATGAGGATTGGGAGGAGGCC
ATTAAGAAATATGCCAAGATAGCCCTGCGCCCAGATTGCAAGTACATAGTGACC
AAGACCGTGAATATTAGACATGCCTGCTACATTTCGGGTAACGGGGCAGAGGTG
GTCATCGATACCCTGGACAAGGCCGCCTTCAGGTGTTGCATGATGGGAATGAGA
GCAGGAGTGATGAATATGAATTCCATGATCTTCATGAACATGAAGTTCAATGGA
GAGAAGTTTAATGGGGTGCTGTTCATGGCCAACAGCCACATGACCCTGCATGGC
TGCAGTTTCTTTGGCTTCAACAATATGTGCGCCGAGGTCTGGGGCGCTTCCAAGA
TCAGGGGATGTAAGTTTTATGGCTGTTGGATGGGCGTAGTGGGAAGACCCAAGA
GTGAGATGTCTGTGAAGCAGTGTGTGTTTGAGAAATGCTACCTGGGAGTCTCTAC
CGAGGGCAATGCTAGAGTGAGACACTGCTCTTCCCTGGATACGGGCTGTTTCTGC
CTGGTGAAGGGTACGGCCTCTCTGAAGCATAATATGGTGAAGGGCTGCACAGAT
GAGCGCATGTACAACATGCTGACCTGCGACTCGGGGTCTGCCATATCCTGAAG
AACATCCATGTGACCTCCCACCCCAGAAAGAAGTGGCCAGTGTTTGAGAATAAC
CTGCTGATCAAGTGCCATATGCACCTGGGTGCCAGAAGGGGCACCTTCCAGCCG
TACCAGTGCAACTTTAGCCAGACCAAGCTGCTGTTGGAGAACGATGCCTTCTCCA
GGGTGAACCTGAACGGCATCTTTGACATGGATGTCTCGGTGTACAAGATCCTGA
GATACGATGAGACCAGGTCCAGGGTGCGCGCTTGCGAGTGCGGGGCAGACAC
ACCAGGATGCAGCCTGTGGCCCTGGATGTGACAGAGGAGCTGAGACCAGACCAC
CTGGTGATGGCCTGTACCGGGACCGAGTTCAGCTCCAGCGGGGAGGACACAGAT
TAGAGGTAGGTTTGAGTAGTGGGCGTGGCTAATGTGAGTATAAAGGTGGGTGTC
TTACGAGGGTCTTTTTGCTTTTCTGCAGACATCATGAACGGGACCGGGGGCCT
TCGAAGGGGGCTTTTTAGCCCTTATTTGACAACCCGCCTGCCGGGATGGGCCG
GAGTTCGTCAGAATGTGATGGGATCTACGGTGGATGGGCGCCCAGTGCTTCCAG
CAAATTCCTCGACCATGACCTACGCGACCGTGGGGAACTCGTCGCTCGACAGCA
CCGCCGCAGCCGCGGCAGCCGCAGCCGCCATGACAGCAACGAGACTAGCCTCGA
GCTACATGCCCAGCAGCGGTAGCAGCCCTCTGTGCCCAGTTCCATCATCGCCGA
GGAGAAACTGCTGGCCCTGCTGGCCGAGCTGGAAGCCCTGAGCCGCAGCTGGC
CGCCCTGACCCAGCAGGTGTCCGAGCTCCGCGAGCAGCAGCAGCAAAATAAATG
ATTCAATAAACACAGATTCTGATTCAAAAGCAAAGCATCTTTATTATTTATTTTT
TCGCGCGCGGTAGGCCCTGGTCCACCTCTCCCGATCATTGAGAGTGCGGTGGATT
TTTTCCAGGACCCGATAGAGGTGGGATTGGATGTTGAGGTACATGGGCATGAGC
CCGTCCCGGGGGTGGAGGTAGCACCACTGCATGGCCTCGTGCTCTGGGGTCGTG

TABLE 7-continued

Nucleic Acid Sequences of Vectors

| SEQ ID NO | Sequence |
|---|---|
| | TTGTAGATGATCCAGTCATAGCAGGGGCGCTGGGCGTGGTGCTGGATGATGTCC |
| | TTGAGGAGGAGACTGATGGCCACGGGGAGCCCCTTGGTGTAGGTGTTGGCAAAA |
| | CGGTTGAGCTGGGAGGGATGCATGCGGGGGGAGATGATGTGCAGTTTGGCCTGG |
| | ATCTTGAGGTTGGCGATGTTGCCGCCCAGATCCCGCCGGGGGTTCATGTTGTGCA |
| | GGACCACCAGGACGGTGTAGCCTGTGCACTTGGGGAACTTGTCATGCAACTTGG |
| | AAGGGAATGCGTGGAAGAATTTGGAGACGCCCTTGTGCCCGCCCAGGTTTTCCA |
| | TGCACTCATCCATGATGATGGCGATGGGTCCGTGGGCTGCGGCTTTGGCAAAGA |
| | CGTTTCTGGGGTCAGAGACATCATAATTATGCTCCTGGGTGAGATCATCATAAGA |
| | CATTTTAATGAATTTGGGGCGGAGGGTGCCAGATTGGGGGACTATGGTTCCCTC |
| | GGGCCCCGGGGCGAAGTTCCCCTCACAGATCTGCATCTCCCAGGCTTTCATCTCG |
| | GAGGGGGGAATCATGTCCACCTGCGGGGCGATGAAAAAAACGGTTTCCGGGGC |
| | GGGGGTGATGAGCTGCGAGGAGAGGAGGTTTCTCAGCAGCTGGGACTTGCCGCA |
| | CCCGGTCGGACCGTAGATGACCCCGATGACTGGTTGCAGGTGGTAGTTCAAGGA |
| | GATGCAGCTGCCGTCGTCCCGAGGAGGGGGGCCACCTCGTTAAGCATGTCTCT |
| | GACTTGGAGGTTTTCCCGGACGAGCTCGCCGAGGAGGCGGTCCCCGCCCAGCGA |
| | GAGGAGCTCTTGCAGGGAAGCAAAGTTTTTCAGGGGCTTGAGTCCGTCGGCCAT |
| | GGGCATCTTGGCGAGGGTCTGCGAGAGGAGTTCCAACCGGTCCCAGAGCTCGGT |
| | GACGTGCTCTACGGCATCTCGATCCAGCAGACTTCCTCGTTTCGGGGGTTGGGAC |
| | GACTGCGACTGTAGGGCACGAGACGATGGGCGTCCAGCGCGGCCAGCGTCATGT |
| | CCTTCCAGGGTCTCAGGGTCCGAGTGAGGGTGGTCTCCGTCACGGTGAATGGGT |
| | GGGCCCCGGGCTGGGCGCTTGCAAGGGTGCGCTTGAGACTCATCCTGCTGGTGC |
| | TGAAACGGGCACGGTCTTCGCCCTGCGCGTCGGCGAGATAGCAGTTGACCATGA |
| | GCTCGTAGTTGAGGGCCTCGGCGGCGTGGCCCTTGGCGCGGAGCTTTCCTTTGGA |
| | AGAGCGCCCGCAGGCGGGACATAGGAGGGATTGCAGGGCGTAGAGCTTGGGCG |
| | CTAGAAAGACGGACTCGGGGGCGAAGGCGTCCGCTCCGCAGTGGGGCGCAGACG |
| | GTCTCGCACTCGACGAGCCAGGTGAGCTCGGGGTGATCGGGGTCAAAAACCAGT |
| | TTTCCCCCGTTCTTTTTGATGCGCTTCTTACCTCGCGTCTCCATGAGTCTGTGTCC |
| | GCGTTCGGTGACAAACAGGCTGTCTGTGTCCCCGTAGACGGACTTGATGGGCCT |
| | GTCCTGCAGGGGCGTCCCGCGGTCCTCCTCGTAGAGAAACTCGGACCACTCTGA |
| | GACAAAGGCGCGCGTCCACGCCAAGACAAAGGAGGCCACGTGCGAGGGGTAGC |
| | GGTCGTTGTCCACCAGGGGGTCCACCTTTTCCACGGTATGCAGACACATGTCCCC |
| | CTCCTCCGCATCCAAGAAGGTGATTGGCTTGTAGGTGTAGGCCACGTGACCTGG |
| | GGTCCCCGACGGGGGGGTATAAAAGGGGGCGGGTCTGTGCTCGTCCTCACTCTC |
| | TTCCGCGTCGCTGTCTACGAGCGCCAGCTGTTGGGGTAGGTATTCCCTCTCGAGA |
| | GCGGGCATGACCTCGGCACTCAGGTTGTCAGTTTCTAGAAACGAGGAGGATTTG |
| | ATGTTGGCCTGCCCTGCCGCGATGCTTTTGAGTAAACTTTCATCCATCTGGTCAG |
| | AAAAGACAATTTTTTTATTGTCAAGCTTGGTGGCGAAGGAGCCATAGAGGGCGT |
| | TGGAGAGAAGCTTGGCGATGGATCTCATGGTCTGATTTTTTGTCACGGTCGGCGCG |
| | CTCCTTGGCCGCGATGTTGAGCTGGACATACTCGCGCGCGACGCACTTCCATTCG |
| | GGGAAGACGGTGGTGCGCTCGTCGGGCACGATCCTGACGCGCCAGCCGCGGTTA |
| | TGCAGGGTGACCAGGTCCACGCTGGTGGCCACCTCGCCGCGCAGGGGCTCGTTG |
| | GTCCAGCAGAGTCTGCCGCCCTTGCGCGAGCAGAACGGGGGCAGCACATCCAGG |
| | AGGTGCTCGTCGGGGGGGTCCGCATCGATGGTGAAGATGCCCGGACAGAGTTCC |
| | TTGTCAAAATAATCGATTTTTGAGGATGCATCATCCAAGGCATCTGCCACTCGC |
| | GGGCGGCCAGCGCTCGCTCGTAGGGGTTGAGGGGCGGACCCCAAGGCATGGGA |
| | TGTGTGAGGGCGGAGGCGTACATGCCGCAGATGTCGTAGACATAGATGGGCTCC |
| | GAGAGGATGCCGATGTAGGTGGGATAACAGCGCCCCCGCGGATGCTGGCGCGC |
| | ACGTAGTCATACAACTCGTGCGAGGGGGCCAAGAAGGCGGGGCCGAGATTGGT |
| | GCGCTGGGGCTGCTCGGCGCGGAAGACGATCTGGCGAAAGATGGCATGCGAGTT |
| | TGAGGAGATGGTGGGCCGTTGGAAGATGTTAAAGTGGGCGTGGGGCAGGCGGA |
| | CCGAGTCGCGGATGAAGTGCGCGTAGGAGTCTTGCAGCTTGGCGACGAGCTCGG |
| | CGGTGACGAGGACGTCCATGGCGCAGTAGTCCAGTGTTTCGCGGATGATGTCAT |
| | AACCCGCCTCTCCTTTCTTCTCCCATAGCTCGCGGTTGAGGGCGTACTCCTCGTC |
| | ATCCTTCCAGTACTCCCGGAGCGGGAATCCTCGATCGTCCGCACGGTAAGAGCC |
| | CAGCATGTAGAAATGGTTCACGGCCTTGTAGGGACAGCAGCCCTTCTCCACGGG |
| | GAGGGCGTAAGCTTGAGCGGCCTTGCGGAGCGAGGTGTGCGTCAGGGCGAAGG |
| | TGTCCCTGACCATGACTTTCAAGAACTGGTACTTGAAGTCCGAGTCGTCGCAGCC |
| | GCCGTGCTCCCAGAGCTCGAAATCGGTGCGCTTCTTCGAGAGGGGGTTAGGCAG |
| | AGCGAAAGTGACGTCATTGAAGAGAATCTTGCCTGCCCGCGGCATGAAATTGCG |
| | GGTGATGCGGAAAGGGCCCGGGACGGAGGCTCGGTTGTTGATGACCTGGCGGC |
| | GAGGACGATCTCGTCGAAGCCGTTGATGTTGTGCCCGACGATGTAGAGTTCCAT |
| | GAATCGCGGGCGGCCTTTGATGTGCGGCAGCTTTTTGAGTTCCTCGTAGGTGAGG |
| | TCCTCGGGGCATTGCAGGCCGTGCTGCTGAGCGCCCACTCCTGGAGATGTGGG |
| | TTGGCTTGCATGAAGGAAGCCCAGAGCTCGCGGGCCATGAGGGTCTGGAGCTCG |
| | TCGCGAAAGAGGCGGAACTGCTGGCCCACGGCCATCTTTTCTGGGGTGACGCAG |
| | TAGAAGGTGAGGGGTCACGCTCCCAGCGATCCCAGCGTAAGCGCACGGCGAG |
| | ATCGCGAGCGAGGGCGACCAGCTCGGGGTCCCCCGAGAATTTCATGACCAGCAT |
| | GAAGGGGACGAGCTGCTTGCCGAAGGACCCCATCCAGGTGTAGGTTTCTACATC |
| | GTAGGTGACAAAGAGCCGCTCCGTGCGAGGATGAGAGCCGATTGGGAAGAACT |
| | GGATTTCCTGCCACCAGTTGGACGAGTGGCTGTTGATGTGATGAAAGTAGAAAT |
| | CCCGCCGGCGAACCGAGCACTCATGCTGATGCTTGTAAAAGCGTCCGCAGTACT |
| | CGCAGCGCTGCACGGGCTGTACCTCATCCACGAGATACACAGCGCGTCCCTTGA |
| | GGAGGAACTTCAGGAGTGCGGCCCTGGCTGGTGGTTTTCATGTTCGCCTGCGTG |
| | GGACTCACCCTGGGGCTCCTCGAGGACGGAGAGGCTGACGAGCCCGCGCGGGA |
| | GCCAGGTCCAGATCTCGGCGCGGCGGGGGCGGAGAGCGAAGACAAGGGCGCGC |
| | AGTTGGGAGCTGTCCATGGTGTCGCGGAGATCCAGGTCAGGGGGCAGGGTTCTG |

TABLE 7-continued

Nucleic Acid Sequences of Vectors

SEQ ID NO Sequence

AGGTTGACCTCGTAGAGGCGGGTGAGGGCGTGCTTGAGATGCAGATGGTACTTG
ATTTCTACGGGTGAGTTGGTGGCCGTGTCCACGCATTGCATGAGCCCGTAGCTGC
GCGGGGCCACGACCGTGCCGCGGTGCGCTTTTAGAAGCGGTGTCGCGGACGCGC
TCCCGGCGGCAGCGGCGGTTCCGGCCCCGCGGGCAGGGGCGGCAGAGGCACTTC
GGCGTGGCGCTCGGGCAGGTCCCGGTGCTGCGCCCTGAGAGCGCTGGCGTGCGC
GACGACGCGGCGGTTGACATCCTGGATCTGCCGCCTCTGTGTGAAGACCACTGG
CCCCGTGACTTTGAACCTGAAAGACAGTTCAACAGAATCAATCTCGGCGTCATT
GACGGCGGCCTGACGCAGGATCTCTTGCACGTCGCCCGAGTTGTCCTGGTAGGC
GATCTCGGACATGAACTGCTCGATCTCCTCCTCCTGGAGATCGCCGCGGCCCGCG
CGCTCGACGGTGGCGGCGAGGTCGTTGGAGATGCGACCCATGAGCTGCGAGAAG
GCGCCCAGGCCGCTCTCGTTCCAGACGCGGCTGTAGACCACGTCCCCGTCGGCG
TCGCGCGCGCGCATGACCACCTGCGCTAGGTTGAGCTCCACGTGGCGCGTGAAG
ACAGCGTAGTTGCGCAGGCGTTGGAAGAGGTAGTTGAGGGTGGTGGCGATGTGC
TCGGTGACGAAGAAGTACATGATCCAGCGGCGCAGGGGCATCTCGCTGATGTCG
CCGATGGCCTCCAGCCTTTCCATGGCCTCGTAGAAGTCCACGGCGAAGTTGAAA
AACTGGGCGTTGCGGGCCGAGACCGTGAGCTCGTCTTCCAGGAGCCGGATGAGC
TCGGCGATGGTGGCGCGCACCTCGCGCTCGAAATCCCCGGGGGCCTCCTCCTCTT
CCTCTTCTTCCATGACGACCTCTTCTTCTATTTCTTCCTCTGGGGGCGGTGGTGGT
GGCGGGGCGCGACGACGACGGCGACGCACCGGGAGACGGTCGACGAAGCGCTC
GATCATCTCCCCGCGGCGGCGACGCATGGTTTCGGTGACGGCGCGACCCCGTTC
GCGAGGACGCAGCGTGAAGACGCCGCCGGTCATCTCCCGGTAATGGGGCGGGTC
CCCGTTGGGCAGCGAGAGGGCGCTGACGATGCATCTTATCAATTGCGGTGTAGG
GGACGTGAGCGCGTCGAGATCGACCGGATCGGAGAATCTTTCGAGGAAAGCGTC
TAGCCAATCGCAGTCGCAAGGTAAGCTCAAACACGTAGCAGCCCTGTGGACGCT
GTTAGAATTGCGGTTGCTGATGATGTAATTGAAGTAGGCGTTTTTGAGGCGGCG
GATGGTGGCGAGGAGGACCAGGTCCTTGGGTCCCGCTTGCTGGATGCGGAGCCG
CTCGGCCATGCCCCAGGCCTGGCCCTGACACCGGCTCAGGTTCTTGTAGTAGTCA
TGCATGAGCCTTTCAATGTCATCACTGGCGGAGGCAGAGTCTTCCATGCGGGTG
ACCCCGACGCCCCTGAGCGGCTGCACGAGCGCCAGGTCGGCGACGACGCGCTCG
GCGAGGATGGCCTGTTGCACGCGGGTGAGGGTGTCCTGGAAGTCGTCCATGTCG
ACGAAGCGGTGGTAGGCCCCTGTGTTGATGGTGTAGGTGCAGTTGGCCATGAGC
GACCAGTTAACGGTCTGCAAGCCGGGCTGCACGACCTCCGAGTACCTGAGCCGC
GAGAAGGCGCGCGAGTCGAATACGTAGTCGTTGCAGGTGCGCACGAGGTACTGG
TATCCGACTAGAAAGTGCGGCGGCGGCTGGCGGTAGAGCGGCCAGCGCTGGGTG
GCCGGCGCGCCCGGGGCCAGGTCCTCGAGCATGAGGCGGTGGTAGCCGTAGACG
TAGCGGGACATCCAGGTGATGCCGGCGGCGGTGGTGGAGGCGCGCGGGAACTC
GCGGACGCGGTTCCAGATGTTGCGCAGCGGCAGGAAATAGTCCATGGTCGGCAC
GGTCTGGCCGGTGAGACGCGCAGTCATTGACGCTCTAGAGGCAAAAACGAAA
GCGGTTGAGCGGGCTCTTCCTCCGTAGCCTGGCGGAACGCAAACGGGTTAGGCC
GCGTGTGTACCCCGGTTCGAGTCCCCTCGAATCAGGCTGGAGCCGCGACTAACG
TGGTATTGGCACTCCCGTCTCGACCCAAGCCCGATAGCCGCCAGGATACGGCGG
AGAGCCCTTTTTGCCGGCCGAGGGGGGTCGCTAGACTTGAAAGCGGCCGAAAAC
CCTGTCGGGCAGTGGCTCGCGCCCGTAGTCTGGAGAAGCATCGCCAGGGTTGAG
TCGCGGCAGAACCCGGTTCGCGGACGGCCGCGGCGAGCGGGACTTGGTCACCCC
GCCGATTTAAAGACCCACAGCCAGCCGACTTCTCCAGTTACGGGAGCGAGCCCC
CTTTTTTCTTTTTGCCAGATGCATCCCGTCCTGCGCCAAATGCGTCCCACCCCCCC
GGCGACCACCGCGACCGCGGCCGTAGCAGGCGCCGGCGCTAGCCAGCCACAGC
CACAGACAGAGATGGACTTGGAAGAGGGCGAAGGGCTGGCGAGACTGGGGGCG
CCGTCCCCGGAGCGACACCCCCGAGTGCAGCTGCAGAAGGACGTGCGCCCGGCG
TACGTGCCTGCGCAGAACCTGTTCAGGGACCGCAGCGGGGAGGAGCCCGAGGA
GATGCGCGACTGCCGGTTTCGGGCGGGCAGGGAGCTGCGCGAGGGCCTGGACCG
CCAGCGCGTGCTGCGCGACGAGGATTTCGAGCCGAACGAGCAGACGGGCATCA
GCCCCGCGCGCTCACGTGGCGGCGGCCAATCTGGTGACGGCCTACGAGCAGA
CGGTGAAGCAGGAGCGCAACTTCCAAAAGAGTTTCAACAACCACGTGCGCACCC
TGATCGCGCGCGAGGAGGTGGCCCTGGGCCTGATGCACCTGTGGGACCTGGCGG
AGGCCATCGTGCAGAACCCGGACAGCAAGCCTCTAACGGCGCAGCTGTTCCTGG
TGGTGCAGCACAGCAGGGACAACGAGGCGTTCAGGGAGGCGCTGCTGAACATC
GCCGAGCCCGAGGGTCGCTGGCTGCTGGAGCTGATCAACATCTTGCAGAGCATC
GTAGTGCAGGAGCGCAGCCTGAGCCTGGCCGAGAAGGTGGCGGCGATCAACTA
CTCGGTGTTGAGCCTCGGCAAGTTTTACGCGCGCAAGATTTACAAGACGCCGTA
CGTGCCCATAGACAAGGAGGTGAAGATAGACAGCTTTTACATGCGCATGGCGCT
CAAGGTGCTGACGCTGAGCGACGACCTGGGCGTGTACCGCAACGACCGCATCCA
CAAGGCCGTGAGCACGAGCCGGCGGCGCGAGCTGAGCGACCGCGAGCTCATGC
TGAGTCTGCGCCGGGCGCTGGTAGGGGGCGCCGCCGGCGGCGAGGAGTCCTACT
TCGACATGGGGGCGGACCTGCATTGGCAGCCGAGCCGGCGCGCCTTGGAGGCCG
CCTATGGTCCAGAGGACTTGGATGAGGAAGAGGAAGAGGAGGAGGATGCACCC
GTTGCGGGGTACTGACGCCTCCGTGATGTGTTTTTAGATGTCCAGCAAGCCCCG
GACCCCGCCATAAGGGCGGCGCTGCAAAGCCAGCCGTCCGGTCTAGCATCGGAC
GACTGGGAGGCCGCGATGCAACGCATCATGGCCCTGACGACCCGCAACCCCGAG
TCCTTTAGACAACAGCCGCAGGCCAACAGACTTTCGGCTATTCTGGAGGCGGTG
GTCCCCTCTCGGACCAACCCCACGCACGAGAAGGTGCTGGCGATCGTGAACGCG
CTGGCGAAAACAAGGCCATCCGTCCCGACGAGGCCGGGCTGGTGTACAACGCC
CTGCTGGAGCGCGTGGGCCGCTACAACAGCACGAACGTGCAGTCCAACCTGGAC
CGGCTGGTGACGGACGTGCGCGAGGCCGTGGCGCAGCGCGAGCGGTTCAAGAA
CGAGGGCCTGGGCTCGTTGGTGGCGCTGAACGCCTTCCTGGCGACGCAGCCGGC
GAACGTGCCGCGCGGGCAGGACGATTATACCAACTTTATCAGCGCGCTGCGGCT

TABLE 7-continued

Nucleic Acid Sequences of Vectors

SEQ ID NO Sequence

GATGGTGACCGAGGTGCCCCAGAGCGAGGTGTACCAGTCGGGCCCGGACTACTT
TTTCCAGACTAGCAGACAGGGCCTGCAGACGGTGAACCTGAGCCAGGCTTTCAA
GAATCTGCGCGGGCTGTGGGCGTGCAGGCGCCCGTGGGCGACCGGTCGACGGT
GAGCAGCTTGCTGACGCCCAACTCGCGGCTGCTGCTGCTGATCGCGCCCTTC
ACCGACAGCGGCAGCGTGAACCGCAACTCGTACCTGGGTCACCTGCTGACGCTG
TACCGCGAGGCCATAGGCCAGGCGCAGGTGGACGAGCAGACCTTCCAGGAGAT
CACTAGTGTAAGCCGCGCGCTGGGTCAGAACGACACCGACAGTCTTAGAGCCAC
CCTGAACTTCTTGCTGACAAATAGACAGCAGAAGATTCCGGCGCAGTACGCGCT
GTCGGCCGAGGAGGAGCGCATCCTGAGATATGTGCAGCAGAGCGTAGGGCTTTT
CCTGATGCAGGAGGGGGCCACCCCCAGCGCCGCGCTGGACATGACCGCGCGCAA
CATGGAACCTAGCATGTACGCCGCCAACCGGCCGTTTATCAATAAGCTGATGGA
CTACCTGCACCGCGCGGCGTCCATGAACTCGGACTACTTTACCAATGCCATTTTG
AACCCGCACTGGCTCCCGCCGCCGGGGTTCTACACGGGCGAGTACGACATGCCT
GACCCCAACGACGGGTTTTTGTGGGACGACGTGGACAGCGCGGTGTTCTCACCG
ACCTTGCAAAAGCGCCAGGAGGCGGTGCGCACGCCCGCGAGCGAGGGCGCGGT
GGGTCGGAGCCCCTTTCCTAGCTTAGGGAGTTTGCATAGCTTGCCGGGCTCGGTG
AACAGCGGCAGGGTGAGCCGGCCGCGCTTGCTGGGCGAGGACGAGTACCTGAA
CGATTCGCTGCTGCAGCCGCCGCGGGTCAAGAACGCCATGGCCAATAACGGGAT
AGAGAGTTTGGTGGACAAACTGAACCGCTGGAAGACCTACGCTCAGGACCATAG
GGAGCCTGCGCCCGCGCCGCGGCGACAGCGCCACGACCGGCAGCGGGGCCTGG
TGTGGGACGACGAGGACTCGGCCGACGATAGCAGCGTGTTGGACTTGGGCGGGA
GCGGTGGGGTCAACCCGTTCGCGCATCTGCAGCCCAAACTGGGGCGGCGGATGT
TTTGAATGCAAAATAAAACTCACCAAGGCCATAGCGTGCGTTCTCTTCCTTGTTA
GAGATGAGGCGTGCGGTGGTGTCTTCCTCTCCTCCTCCCTCGTACGAGAGCGTGA
TGGCGCAGGCGACCCTGGAGGTTCCGTTTGTGCCTCCGCGGTATATGGCTCCTAC
GGAGGGCAGAAACAGCATTCGTTACTCAGAGCTGGCTCCGCTGTACGACACCAC
TCGCGTGTACTTGGTGGACAACAAGTCGGCGGACATCGCTTCCCTGAACTACCA
AAACGACCACAGCAACTTCCTGACCACGGTGGTGCAGAACAACGATTTCACCCC
CGCCGAGGCCAGCACACAAACAATAAATTTTGACGAGCGGTCGCGGTGGGGCG
GTGATCTGAAGACCATTCTGCACACCAACATGCCCAATGTGAACGAGTACATGT
TTACCAGCAAGTTTAAGGCGCGGGTGATGGTGGCTAGAAAAAAGGCGGAAGGG
GCTGATGCAAATGATAGGAGCAAGGATATCTTAGAGTACCAGTGGTTTGAGTTT
ACCCTGCCCGAGGGCAACTTTTCCGAGACCATGACCATAGACCTGATGAACAAC
GCCATCTTGGAAAACTACTTGCAAGTGGGGCGGCAAAATGGCGTGCTGGAGAGC
GATATTGGAGTCAAGTTTGACAGCAGGAATTTCAAGCTGGGCTGGGACCCGGTG
ACCAAGCTGGTGATGCCAGGGGTTTACACCTATGAGGCCTTCCACCCGGACGTG
GTGCTGCTGCCTGGCTGCGGGGTGGACTTCACCGAGAGCCGCTGAGCAACCTC
CTGGGCATTCGCAAGAAGCAACCTTTCCAAGAGGGCTTCAGAATCATGTATGAG
GATCTAGTAGGGGGCAACATCCCCGCCCTCCTGAATGTCAAGGAGTATCTGAAG
GATAAGGAAGAGCTGGCACAGCAGATGCAAATACCATTAAGGCTCAGAATGA
TGCAGTCCCAAGAGGAGATAACTATGCATCAGCGGCAGAAGCCAAAGCAGCAG
GAAAAGAAATTGAGTTGAAGGCCATTTTGAAAGATGATTCAAACAGAAGCTACA
ATGTGATCGAGGGAACCACAGACACCCTGTACCGCAGTTGGTACCTGTCCTATA
CCTACGGGGACCCCGAGAAGGGGGTGCAGTCGTGGACGCTGCTCACCACCCCGG
ACGTCACCTGCGGCGCGGAGCAAGTCTACTGGTCGCTGCCGGACCTCATGCAAG
ACCCCGTCACCTTCCGCTCTACCCAGCAAGTCAGCAACTACCCCGTGGTTGGCGC
CGAGCTCATGCCCTTCCGCGCCAAGAGCTTTTACAACGACCTCGCCGTCTACTCC
CAGCTCATCCGCAGCTACACCTCCCTCACCCACGTCTTCAACCGCTTCCCCGACA
ACCAGATCCTCTGCCGCCCGCCCGCGCCCACCATCACCACCGTCAGTGAAAACG
TGCCTGCTCTCACAGATCACGGGACGCTTCCGCTGCGCAGCAGTATCCGCGGAG
TCCAGCGAGTGACCGTCACTGACGCCCGTCGCCGCACCTGTCCCTACGTCTACAA
GGCCCTGGGCATAGTCGCGCCGCGCGTGCTTTCCAGTCGCACCTTCTAAAAATG
TCTATTCTCATCTCGCCCAGCAATAACACCGGCTGGGGTCTTACTAGGCCCAGCA
CCATGTACGGAGGAGCCAAGAAGCGCTCCCAGCAGCACCCCGTCCGCGTCCGCG
GCCACTTCCGCGCTCCCTGGGGCGCTTACAAGCGCGGGCGGACTTCTACCGCCG
CCGCCGTGCGCACCACCGTCGACGATGTCATCGACTCGGTGGTCGCCGATGCGC
GCAACTATACCCCCGCCCCTCCACCGTGGACGCGGTCATCGACAGCGTGGTGG
CCGACGCGCGCGACTATGCCAGACGCAAGAGCCGGCGGCGACGAATCGCCAGG
CGCCACCGGAGTACCCGCCATGCGCGCCGCCGGGCTCTGCTGCGCCGCGCC
AGACGCACGGGCCGCCGGGCCATGATGCGAGCCGCGCGCCGCCGCCACTGCA
CCCCCCGCAGGCAGGACTCGCAGACGAGCGGCCGCCGCCGCCGCGGCCATT
TCTAGCATGACCAGACCCAGGCGCGGAAACGTGTACTGGGTGCGCGACTCCGTC
ACGGGCGTGCGCGTGCCCGTGCGCACCCGTCCTCCTCGTCCCTGATCTAATGCTT
GTGTCCTCCCCCGCAAGCGACGATGTCAAAGCGCAAAATCAAGGAGGAGATGCT
CCAGGTCGTCGCCCCGGAGATTTACGACCCCCGGACCAGAAACCCCGCAAAAT
CAAGCGGGTTAAAAAAAGGATGAGGTGGACGAGGGGGCAGTAGAGTTTGTGC
GCGAGTTCGCTCCGCGGCGGCGCGTAAATTGGAAGGGGCGCAGGGTGCAGCGC
GTGTTGCGGCCAGGCACGGCGGTGGTGTTCACGCCCGGCGAGCGGTCCTCGGTC
AGGAGCAAGCGTAGCTATGACGAGGTGTACGGCGACGACGACATCCTGGACCA
GGCGGCGGAGCGGGCGGGCGAGTTCGCCTACGGGAAGCGGTCGCGCGAAGAGG
AGCTGATCTCGCTGCCGCTGGACGAAAGCAACCCCACGCCGACCTGAAGCCCG
TGACCCTGCAGCAGGTGCTGCCCCAGGCGGTGCTGCTGCCGAGCCGCGGGGTCA
AGCGCGAGGGCGAGAGCATGTACCCGACCATGCAGATCATGGTGCCCAAGCGCC
GGCGCGTGGAGGACGTGCTGGACACCGTGAAAATGGATGTGGAGCCCGAGGTC
AAGGTGCGCCCCATCAAGCAGGTGGCGCCGGGCCTGGGCGTGCAGACCGTGGAC
ATTCAGATCCCCACCGACATGGATGTCGACAAAAAACCCTCGACCAGCATCGAG

TABLE 7-continued

Nucleic Acid Sequences of Vectors

SEQ ID NO Sequence

GTGCAGACCGACCCCTGGCTCCCAGCCTCCACCGCTACCGTCTCCACTTCTACCG
CCGCCACGGCCACCGAGCCTCCCAGGAGGCGAATATGGGGCGCCGCCAGCCGGC
TGATGCCCAACTACGTGTTGCATCCTTCCATCATCCCGACGCCGGGCTACCGCGG
CACCCGGTACTACGCCAGCCGCAGGCGCCCAGCCAGCAAACGCCGCCGCCGCAC
CACCACCCGCCGCCGTCTGGCCCCCGCCCGCGTGCGCCGCGTAACCACGCGCCG
GGGCCGCTCGCTCGTTCTGCCCACCGTGCGCTACCACCCCAGCATCCTTTAATCC
GTGTGCTGTGATACTGTTGCAGAGAGATGGCTCTCACTTGCCGCCTGCGCATCCC
CGTCCCGAATTACCGAGGAAGATCCCGCCGCAGGAGAGGCATGGCAGGCAGCG
GCCTGAACCGCCGCCGGCGGCGGGCCATGCGCAGGCGCCTGAGTGGCGGCTTTC
TGCCCGCGCTCATCCCCATAATCGCCGCGGCCATCGGCACGATTCCGGGCATAG
CTTCCGTTGCGCTGCAGGCGTCGCAGCGCCGTTGATGTGCGAATAAAGCCTCTTT
AGACTCTGACACACCTGGTCCTGTATATTTTTAGAATGGAAGACATCAATTTTGC
GTCCCTGGCTCCGGGCACGGCACGCGGCCGTTCATGGGCACCTGGAACGAGAT
CGGCACCAGCCAGCTGAACGGGGGCGCCTTCAATTGGAGCAGTGTCTGGAGCGG
GCTTAAAAATTTCGGCTCGACGCTCCGGACCTATGGGAACAAGGCCTGGAATAG
TAGCACGGGGCAGTTGTTAAGGGAAAAGCTCAAAGACCAGAACTTCCAGCAGA
AGGTGGTGGACGGGCTGGCCTCGGGCATTAACGGGGTGGTGGACATCGCGAACC
AGGCCGTGCAGCGCGAGATAAACAGCCGCCTGGACCCGCGGCCGCCCACGGTG
GTTGAGATGGAAGATGCAACTCTTCCGCCGCCCAAGGGCGAAAAGCGGCCGCGG
CCCGACGCGGAGGAGACGATCCTGCAGGTGGACGAGCCGCCCTCGTACGAGGA
GGCCGTGAAGGCCGGCATGCCCACCACGCGTATCATCGCGCCGCTGGCCACGGG
TGTAATGAAACCCGCCACCCTTGACCTGCCTCCACCACCCACGCCCGCTCCACCG
AAGGCAGCTCCGGTTGTGCAGGCCCCCCCGGTGGCGACCGCCGTGCGCCGCGTC
CCCGCCCGCCGCCAGGCCCAGAACTGGCAGAGCACGCTGCACAGTATCGTGGGC
CTGGGGAGTGAAAAGTCTGAAGCGCCGCCGATGCTATTGAGAGAGAGGAAAGAG
GACACTAAAGGGAGAGCTTAACTTGTATGTGCCTTACCGCCAGAGAACGCGCGA
AGATGGCCACCCCCTCGATGATGCCGCAGTGGGCGTACATGCACATCGCCGGGC
AGGACGCCTCGGAGTACCTGAGCCCGGGTCTGGTGCAGTTTGCCCGCGCCACCG
ACACGTACTTCAGCCTGGGCAACAAGTTTAGGAACCCCACGGTGGCTCCCACCC
ACGATGTGACCACGGACCGGTCCCAGCGTCTGACGCTGCGCTTCGTGCCCGTGG
ATCGCGAGGACACCACGTACTCGTACAAGGCGCGCTTCACTCTGGCCGTGGGCG
ACAACCGGGTGCTAGACATGGCCAGCACTTACTTTGACATCCGCGGCGTCCTGG
ACCGCGGTCCCAGCTTCAAACCCTACTCGGGCACGGCCTACAACAGTCTGGCCC
CCAAGGGCGCCCCCAACTCCAGTCAGTGGGAACAGAAAAAGGCCAATGCTGGA
GATCAAAAGGAAACACATACTTATGGTGTAGCTCCTATGGGTGGAGAAAACATT
ACAATTAGCGGTTTGCAAATTGGAACAGATACTACAAATGGCAAACAAGACCCG
ATATATGCTAATAAGCTGTATCAACCAGAGCCTCAAGTAGGAGAAGAAAACTGG
CAGGAAACAGAAGCCTTCTATGGAGGAAGGGCTCTTAAAAAGGAAACCAAGAT
GAAACCATGCTATGGCTCATTTGCCAGACCCACAAATGAAAAGGAGGACAGGC
AAAACTAAGAGACCCTGAAAAAAGTCAAGAAGATTTTGACATAGACCTAGCATT
CTTTGATACTCCGGGAGGAACTTTAACAGGTGGTGGAACGGAATACAAAGCAGA
CATTGTTATGTGCACTGAAAATGTTAATCTTGAAACCCCGGACACCCACGTGGTG
TATAAACCAGGCAAAGATGATGACAGTTCAGAAATCAACTTGGTTCAGCAGTCC
ATGCCCAACAGACCTAACTACATCGGCTTCAGGGACAACTTTGTGGGTCTCATGT
ACTACAACAGCACTGGCAACATGGGTGTGCTGGCCGGTCAGGCTTCTCAGTTGA
ATGCTGTGGTCGACTTGCAAGACAGAAACACAGAGCTGTCTTACCAGCTCTTGCT
AGATTCTCTGGGCGACAGAACCAGGTACTTTAGCATGTGGAACTCTGCGGTGGA
CAGCTATGATCCCGATGTCAGGATCATTGAGAATCACGGTGTGGAAGATGAACT
TCCCAACTATTGCTTCCCATTGGATGGGTCTGGCACCAATGCTGCTTATGAAGGT
GTAAAAGTTAAAAATGGAGAAGATGGGGATCAAGAGAGCGAATGGGAAAAGA
CACCAATGTGGCAGATCGAAACCAAATATGCAAGGGCAACATCTACGCCATGGA
GATCAACCTCCAGGCCAACCTGTGGAAGAGTTTTCTGTACTGAATGTGGCCCTG
TACCTGCCTGACTCCTACAAGTACACGCCGGCCAACGTCACGCTGCCCGCCAAC
ACCAACACCTACGAGTACATGAACGGCCGCGTGGTAGCCCCCTCGCTGGTGGAC
GCCTACATCAACATCGGCGCCCGCTGGTCGTTGGACCCCATGGACAACGTCAAC
CCCTTCAACCACCACCGCAATGCGGGCCTGCGCTACCGCTCCATGCTTCTGGGCA
ACGGCCGCTACGTGCCCTTCCACATCCAAGTGCCCCAAAAGTTCTTTGCCATCAA
GAACCTGCTCCTGCTCCCGGGCTCCTACACCTACGAGTGGAACTTCCGCAAGGA
CGTCAACATGATCCTGCAGAGTTCCCTCGGAAACGATCTGCGCGTCGACGGCGC
CTCCGTCCGCTTCGACAGCGTCAACCTCTACGCCACCTTCTTCCCCATGGCGCAC
AACACCGCCTCCACCCTGGAAGCCATGCTGCGCAACGACACCAACGACCAGTCC
TTCAACGACTACCTCTCGGCCGCCAACATGCTCTACCCCATCCCGGCCAAGGCCA
CCAACGTGCCCATCTCCATCCCCTCGCGCAACTGGGCCGCCTTCCGCGGCTGGAG
TTTCACCCGGCTCAAGACCAAGGAAACTCCCTCCCTCGGCTCGGGTTTCGACCCC
TACTTTGTCTACTCGGGCTCCATCCCCTATCTCGACGGGACCTTCTACCTCAACC
ACACCTTCAAGAAGGTCTCCATCATGTTCGACTCCTCGGTCAGCTGGCCCGGCAA
CGACCGGCTGCTCACGCCGAACGAGTTCGAGATCAAGCGCAGCGTCGACGGGGA
GGGCTACAATGTGGCCCAATGCAACATGACCAAGGACTGGTTCCTCGTCCAGAT
GCTCTCCCACTACAACATCGGTTACCAGGGCTTCCATGTGCCCGAGGGCTACAA
GGACCGCATGTACTCCTTCTTCCGCAACTTCCAGCCCATGAGCAGGCAGGTGGTC
GATGAGATCAACTACAAGGACTACAAGGCCGTCACCCTGCCCTTCCAGCACAA
AACTCTGGCTTCACCGGCTACCTCGCACCCACCATGCGTCAGGGGCAGCCCTACC
CCGCCAACTTCCCCTACCCGCTCATCGGCCAGACAGCCGTGCCATCCGTCACCCA
GAAAAAGTTCCTCTGCGACAGGGTCATGTGGCGCATCCCCTTCTCCAGCAACTTC
ATGTCCATGGGCGCCCTTACCGACCTGGGTCAGAACATGCTCTACGCCAACTCG
GCCCACGCGCTCGACATGACCTTTGAGGTGGACCCCATGGATGAGCCCACCCTC

TABLE 7-continued

Nucleic Acid Sequences of Vectors

SEQ ID NO Sequence

CTCTATCTTCTCTTCGAAGTTTTCGACGTGGTCAGAGTGCACCAGCCGCACCGCG
GCGTCATCGAGGCCGTCTACCTGCGCACGCCCTTCTCCGCCGGCAACGCCACCAC
CTAAGCATGAGCGGCTCCAGCGAACGAGAGCTCGCGGCCATCGTGCGCGACCTG
GGCTGCGGGCCCTACTTTTTGGGCACCCACGACAAGCGCTTCCCGGGCTTTCTCG
CCGGCGACAAGCTGGCCTGCGCCATCGTCAACACGGCCGGCCGCGAGACCGGAG
GCGTGCACTGGCTCGCCTTTGGCTGGAACCCGCGCTCGCGCACCTGCTACATGTT
CGACCCCTTTGGGTTCTCGGACCGCCGGCTGAAGCAGATTTACAGCTTCGAGTAC
GAGGCCATGCTACGCCGCAGCGCCCTGGCCTCCTCGCCCGACCGCTGTCTCAGCC
TCGAGCAGTCCACCCAGACCGTGCAGGGGCCCGACTCCGCCGCCTGCGGACTTT
TCTGTTGCATGTTCTTGCATGCCTTCGTGCACTGGCCCGACCGACCCATGGACGG
AAACCCCACCATGAACTTGCTGACGGGGGTGCCCAACGGCATGCTACAATCGCC
ACAGGTGCTACCCACCCTCCGGCGCAACCAGGAGCAGCTCTACCGCTTCCTCGC
GCGCCACTCCCCTTACTTTCGATCCCACCGCGCCGCCATCGAACACGCCACCGCT
TTTGATAAAATGAAACAACTGCGTGTATCTCAATAAACAGCACTTTTATTTTACA
TGCACTGGAGTATATGCAAGTTATTTAAAAGTCAAAGGGGTTCTCGCGCTCGTCG
TTGTGCGCCGCGCTGGGGAGGGCCACGTTGCGGTACTGGTACTTGGGCTGCCAC
TTGAACTCGGGGATCACCAGTTTGGGCACTGGGGTCTCGGGGAAGGTCTCGCTC
CACATGCGCCGGCTCATCTGCAGGGCGCCCAGCATGTCCGGGCCGGAGATCTTG
AAATCGCAGTTGGGGCCGGTGCTTTGCGCGCGCGAGTTGCGGTACACGGGGTTG
CAGCACTGGAACACCATCAGACTGGGGTACTTCACACTGGCAAGCACGCTCTTG
TCGCTGATCTGATCCTTGTCCAGGTCCTCGGCGTTGCTCAGGCCGAACGGGGTCA
TCTTGCACAGCTGGCGGCCCAGGAAGGGCACGCTCTGAGGCTTGTGGTTACACT
CGCAGTGAACGGGCATTAGCATCATTCCCGCGCCGCGCTGCATATTCGGGTAGA
GGGCCTTGACAAAGGCCGCGATCTGCTTGAAAGCTTGCTGGGCCTTGGCCCCCTC
GCTGAAAAACAGGCCGCAGCTCTTCCCGCTGAACTGGTTATTCCCGCATCCGGC
ATCCTGCACGCAGCAGCGCGCGTCATGGCTGGTCAGTTGCACCACGCTCCGGCC
CCAGCGGTTCTGGGTCACCTTGGCCTTGCTGGGTTGCTCCTTCAACGCGCGCTGC
CCGTTCTCACTGGTCACATCCATCTCCACCACGTGGTCCTTGTGGATCATCACCG
TTCCATGCAGACACTTGAGCTGACCTTCCACCTCGGTGCAGCCGTGGTCCCACAG
GGCGCAGCCGGTGCACTCCCAGTTCTTGTGCGCGATCCCGCTGTGGCTGAAGAT
GTAACCTTGCAACATGCGGCCCATTATGGTGCTAAAGGTTTTCTGAGTGGTGAAG
GTCAGTTGCAGACCGCGGGCCTCCTCGTTCATCCAGGTCTGGCACATCTTTTGGA
AGATCTCGGTCTGCTCGGGCATGAGCTTGTAAGCATCGCGCAGGCCGCTGTCGA
CGCGGTAACGTTCCATCAGCACGTTCATGGTATCCATGCCCTTCTCCCAGGACGA
GACCAGAGGCAGACTCAGGGGGTTGCGCACGTTCAGGACACCGGGTGTCGCGG
GCTCGACGATGCGTTTTCCGTCCTTGCCTTCCTTCAACAGAACCGGCGGCTGGCT
GAATCCCACTCCCACGATCACGGCATCTTCCTGGGGCATCTCTTCGTCGGGGTCT
ACCTTGGTCACATGCTTGGTCTTCCTGGCTTGCTTCTTTTTTGGAGGGCTGTCCAC
GGGAACCACGTCCTCCTCGGAAGACCCGGAGCCCACCCGCTGATACTTTCGGCG
CTTGGTGGGCAGAGGAGGTGGTGGCGGCGAGGGGCTCCTCTCCTGCTCCGGCGG
ATAGCGCGCCGACCCGTGGCCCCGGGGCGGAGTGGCCTCTCGCTCCATGAACCG
GCGCACGTCCTGACTGCCGCCGGCCATTGTTTCCTAGGGGAAGATGGAGGAGCA
GCCGCGTAAGCAGGAGCAGGAGGAGGACTTAACCACCCACGAGCAACCCAAAA
TCGAGCAGGACCTGGGCTTCGAAGAGCCGGCTCGTCTAGAACCCCCACAGGATG
AACAGGAGGAGACCGACGCTGGGCTCGAGCATGGCTACCTGGGAGGAGAGGAG
GATGTGCTGCTGAAACACCTGCAGCGCCAGTCCATCATCCTCCGGGACGCCCTG
GCCGACCGGAGCGAAACCCCCCTCAGCGTCGAGGAGCTAAGTAGGGCCTACGA
GCTCAACCTCTTCTCGCCGCGCGTGCCCCCCAAACGCCAGCCCAACGGCACATG
CGAGCCCAACCCGCGTCTCAACTTCTACCCCGTCTTTGCGGTCCCCGAGGCCCTC
GCCACCTATCACATCTTTTTCAAGAACCAAAAGATCCCCGTCTCCTGCCGCGCCA
ACCGCACCCGCGCCGACGCGCTCCTCGCTTTGGGGCCCGGCGCGCGCATACCTG
ATATCGCTTCCCTGGAAGAGGTGCCCAAGATCTTCGAAGGGCTCGGTCGGGACG
AGACGCGCGCGGCGAACGCTCTGAAAGAAACAGCAGAGGAAGAGGGTCACACT
AGCGCCCTGGTAGAGTTGGAAGGCGACAACGCCAGGCTGGCCGTGCTCAAGCGC
AGCGTCGAGCTTACCCACTTCGCCTACCCCGCCGTCAACCTCCCGCCCAAGGTCA
TGCGTCGCATCATGGATCAGCTCATCATGCCCCACATCGAGGCCCTCGATGAAA
GTCAGGAGCAGCGCCCCGAGGACGCCCGGCCCGTGGTCAGCGACGAGATGCTCG
CGCGCTGGCTCGGGACCCGCGACCCCCAGGCTTTGGAACAGCGGCGCAAACTCA
TGCTGGCCGTGGTCCTGGTCACCCTTGAGCTCGAATGCATGCGCCGCTTTTTCAG
CGACCCCGAGACCCTGCGCAAGGTCGAGGAGACCCTGCACTACACTTTCAGGCA
CGGTTTCGTCAGGCAGGCCTGCAAGATCTCCAACGTGGAGCTGACCAACCTGGT
CTCCTGCCTGGGGATCCTGCACGAGAACCGCCTGGGCCAGACCGTGCTCCACTCT
ACCCTGAAGGGCGAGGCGCGGCGGGACTATGTCCGCGACTGCGTCTTTCTCTTTC
TCTGCCACACATGGCAAGCGGCCATGGGCGTGTGGCAGCAGTGTCTCGAGGACG
AGAACCTAAAGGAGCTGGACAAGCTTCTTGCTAGAAACCTTAAAAAGCTGTGGA
CGGGCTTCGACGAGCGCACCGTCGCCTCGGACCTGGCCGAGATCGTCTTCCCCG
AGCGCCTGAGACAGACGCTGAAAGGCGGGCTGCCCGACTTCATGAGCCAGAGC
ATGTTGCAAAACTACCGCACTTTCATTCTTGAGCGATCAGGCATCCTGCCCGCCA
CCTGCAACGCCTTCCCCTCCGACTTTGTACCGCTGAGCTACCGCGAGTGTCCCCC
GCCGCTGTGGAGCCACTGCTACCTCTTGCAGCTGGCCAACTACATCGCCTACCAC
TCGGACGTGATCGAGGACGTGAGCGGCGAGGGGCTGCTCAGGTGCCACTGTGCC
TGCAACCTGTGCTCCCCGCATCGCTCCCTGGTCTGCAACCCCCAGCTCCTGAGCG
AGACCCAGGTCATCGGTACCTTCGAGCTGCAAGGTCCGCAGGAGTCCACCGCTC
CGCTGAAACTCACGCCGGGGTTGTGGACTTCCGCGTACCTGCGCAAATTTGTACC
CGAAGACTACCACGCCCATGAGATAAAGTTCTTTGAGGACCAATCGCGTCCGCA
GCACGCGGATCTCACGCCTGCGTCATCACCCAGGGCGCGATCCTCGCCCAATT

TABLE 7-continued

Nucleic Acid Sequences of Vectors

SEQ ID NO Sequence

GCACGCCATCCAAAAATCCCGCCAAGAGTTTCTTCTGAAAAAGGGTAGAGGGGT
CTACCTGGACCCCCAGACGGGCGAGGTGCTCAACCCGGGTCTCCCCCAGCATGC
CGAGGAAGAAGCAGGAGCCGCTAGTGGAGGAGATGGAAGAAGAATGGGACAG
CCAGGCAGAGGAGGACGAATGGGAGGAGGAGACAGAGGAGGAAGAATTGGAA
GAGGTGGAAGAGGAGCAGGCAACAGAGCAGCCCGTCGCCGCACCATCCGCGCC
GGCAGCCCCGCCGGTCACGGATACAACCTCCGCTCCGGTCAAGCCTCCTCGTAG
ATGGGATCAAGTGAAGGGTGACGGTAAGCACGAGCGGCAGGGCTACCGATCAT
GGAGGGCCCACAAAGCCGCGATCATCGCCTGCTTGCAAGACTGCGGGGGGAAC
ATCGCTTTCGCCCGCCGCTACCTGCTCTTCCACCGCGGGGTGAACATCCCCCGCA
ACGTGTTGCATTACTACCGTCACCTTCACAGCTAAGAAAAAGCAAGTCAAAGGA
GTCGCCGGAGGAGGAGGAGGAGGCCTGAGGATCGCGGCGAACGAGCCCTTGAC
CACCAGGGAGCTGAGGAACCGGATCTTCCCCACTCTTTATGCCATTTTTCAGCAG
AGTCGAGGTCAGCAGCAAGAGCTCAAAGTAAAAAACCGGTCTCTGCGCTCGCTC
ACCCGCAGTTGCTTGTACCACAAAAACGAAGATCAGCTGCAGCGCACTCTCGAA
GACGCCGAGGCTCTGTTCCACAAGTACTGCGCGCTCACTCTTAAAGACTAAGGC
GCGCCCACCCGGAAAAAAGGCGGGAATTACCTCATCGCCACCATGAGCAAGGA
GATTCCCACCCCTTACATGTGGAGCTATCAGCCCCAGATGGGCCTGGCCGCGGG
CGCCTCCCAGGACTACTCCACCCGCATGAACTGGCTCAGTGCCGGCCCCTCGATG
ATCTCACAGGTCAACGGGGTCCGTAACCATCGAAACCAGATATTGTTGGAGCAG
GCGGCGGTCACCTCCACGCCCAGGGCAAAGCTCAACCCGCGTAATTGGCCCTCC
ACCCTGGTGTATCAGGAAATCCCCGGGCGACTACCGTACTACTTCCGCGTGAC
GCACTGGCCGAAGTCCGCATGACTAACTCAGGTGTCCAGCTGGCCGGCGGCGCT
TCCCGGTGCCCGCTCCGCCCACAATCGGGTATAAAAACCCTGGTGATCCGAGGC
AGAGGCACACAGCTTAACGACGAGTTGGTGAGCTCTTCAATCGGTCTGCGACCG
GACGGAGTGTTCCAACTAGCCGGAGCCGGGAGATCCTCCTTCACTCCCCACCAG
GCCTACCTGACCTTGCAGAGCAGCTCTTCGGAGCCTCGCTCCGGAGGCATCGGA
ACCCTCCAGTTCGTGGAGGAGTTTGTGCCCTCGGTCTACTTCAACCCCTTCTCGG
GATCGCCAGGCCTCTACCCGGACGAGTTCATACCGAACTTCGATGCAGTGAGAG
AAGCGGTGGACGGCTACGACTGAATGTCCCATGCTGACTCGGCTGAGCTCGCTC
GGTTGAGGCATCTGGACCACTGCCGCCGCCTGCGCTGCTTCGCCCGGGAGAGCT
GCGGACTCATCTACTTTGAGTTTCCCGAGGAGCACCCCAACGGCCCTGCGCACG
GAGTGCGGATCACCGTAGAGGGCACCGCCGAGTCTCACCTGGTCAGGTTCTTCA
CCCAGCAACCCTTCCTGGTCGAGCGGGACCGGGGCGCCACCACCTACACCGTCT
ACTGCATCTGTCCTACCCCGAAGTTGCATGAGAATTTTTGTTGTACTCTGTGTGCT
GAGTTTAATAAAAGCTAAACTCCTACAATACTCTGGGATCCCGTGTCGTCGCACT
CGCAACGAGATCTTCAACCTCACCAACCAGACTGAGGTAAAACTCAACTGCAGA
CCGGGGGCAAATACATCCTCTGGCTCTTTGAAAACACTTCCTTCGCAGTCTCCA
ACGCCTGCGCCAACGACGGTATTGAAATACCCAACAACCTTACCAGTGGACTAA
CTTACACTACCAGAAAGACTAAGCTAGTACTCTACAATCCTTTTGTAGAGGGAA
CCTACCACTGCCAGAGCGGACCTTGCTTCCACACTTTCACTTTGGTGAACGTTAC
CGACAGCAGCACAGTCGCTCCAGAAACATCTAACCTTTTTGATACTAACACTCCT
AAAACCGGAGGTGAGCTCTGGGTTCCCTCTTTAACAGAGGGGGGTAAACATATT
GAAGCGGTTGGGTATTTGATTTTAGGGGTGGTCCTGGGTGGGTGCATAGCGGTG
CTGTATTACCTTCCTTGCTGGATCGAAATCAAAATCTTTATCTGCTGGGTCATAC
ATTGTTGGGAGGAACCATGAAGGGGCTCTTGCTGATTATCCTTTCCCTGGTTGGG
GGTGTACTGTCATGCCACGAACAGCCACGATGTAACATCACCACAGGCAATGAG
AGGAGTGTGATATGCACAGTAGTCATCAAATGCGAGCATGCATGTCCTCTCAAC
ATCACATTCAAGAATAAGACCATGGGAAATTCATGGGTGGGCGATTGGGAACCA
GGAGATGAGCAGAACTACACGGTCACTGTCCATGGTAGCGATGGGAATCACACT
TTCGGTTTCAAATTCATTTTTGAAGTCATGTGTGATATCACACTGCATGTGGCTA
GACTTCATGGCTTGTGGCCCCCTACCAAGGAGAACATGGTTGGGTTTTCTTTGGC
TTTTTGTGATCATGGCCTGCTTTATGTCAGGTCTGCTGGTAGGGGCTTTAGTATGG
TTCCTGAAGCACAAGCCTAGGTATGGAAATGAGGAGAAGGAAAAATTGCTATAA
ATCTTTTTCTCTTCGCAGAACCATGAATACTTTGACCAGTGTCGTGCTGCTCTCTC
TTCTTGTAGCTTTTAGTCAGGCAGGATTTCATACTATCAATGCTACATGGTGGGC
TAATGTAACTTTAGTGGGACCCTCAGATACGCCAGTCACATGGTATGATAAACA
GGGAATGCAGTTCTGTGATGGAAATACAGTTAAGAATCCTCAAATAAGACATGA
GTGTAATGAGCAAAACCTTACACTAATTCATGTGAACAAAACCCATGAAAGGAC
ATACATGGGTTATAATAGACAGAGTACTCATAAGGAAGACTATAAAGTCATAGT
TATACCGCCTCCTCCTGCTACTGTAAAGCCACAGTCAGGTCCAGAGTATGTATAT
GTTAATATGGGAGAGAACAAAACCTTAGTTGGACCTCCAGGAATACCAGTTACT
TGGTATGACGGAGAAGGAAATAAATTCTGCGATGGAGAAAAAGTTGAACATGC
AGAATTTAATCATACATGTGACGAGCAAAATCTTACACTGTTGTTTATAAATCTT
ACACATGATGGGCTTATCTTGGCTATAATCACCAGGGAACTAAAAGAACTTGG
TATGAGGTTGTAGTGACAGATGGTTTTCCAAAATCAGGGGAGATGAAAATCGAA
GATCAGAGTAGACAAACAGAACAAAACAAAATGAGCATAAACAGGGTGGGCA
GAAACAGGAGGGGCAAAAAGAGACAAGTCAAAAGAAAGATAATGACAAACAG
AAGGCGACACACAGGAGGCCATCAAAACTAAAGCCGCACACACCTGAAGCAAA
ACTGATTACAGTTTCTAGTGGGTCTAACTTAACATTACTTGGGCCAGATGGAAAG
GTCACTTGGTATGATGATGATTTAAAAAGACCATGCGAGCCTGGGTATAAGTTA
GGGTGTAAGTGTGACAATCAAAACCTAACGCTAATCAATGTAACTAAACTTTAT
GAGGGAGTTTACTATGGTACTAATGACAGAGGTAACAGCAAAAGATACAGATTA
AAAGTAAACACTACTAATTCTCAAAGTGTGAAAATTCAGCCATACAACAGGTCT
ACTACTCCTGATCAGAAACACAGATTTGAATTGCAAATTGATTCTAATCAAGAC
AATGACAAAATTCCATCAACCACTGTGGCAATCGTGGTGGGAGTGATTGCGGGC
TTCATAACTATAATCATTGTCATTCTGTGCTACATCTGCTGCCGCAAGCGTCCCA

TABLE 7-continued

Nucleic Acid Sequences of Vectors

| SEQ ID NO | Sequence |
|---|---|
| | GGGCATACAATCATATGGTAGACCCACTACTTAGCTTCTCTTACTGAGACTCAGT
CACTTTCATTTCAGAACCATGAAGGCTTTCACAGCTTGCGTTCTGATTAGCATAG
TCACATTAGTATCAGCTGATTACAAACAAGTTCAAGTTAGCAGAGGAGGAAATA
TTACATTAGATGGACCATTCGATAATACTACATGGACAAGATATCATAATGATG
GACATAAAAATGGTTGGATGAAAATTTGCACATGGACTGGAGCAACATATAAAT
GTCACAATAATGGAAGCATTACTATTTTTGCTTTCAACATTACATCCGGAGTTTA
CAAAGCAGAAGGGTATAAAAAAGAGGTTAGAACATTTTCATCTAGAAATCAAA
AACATACAATTGAAGATTCTGGAGATTATGAACAACAAAAAATATATCTATATA
ATCTAACAATAATTGAAGCGCCAACTACTAAAGCACCCACCACAGTTAGAACAA
CCACGCAGACAACTACTAGGGAAACAACACATCCAACCACCACAGTCAGTACAA
CTCACACTACACATCTAGACACTACAGTGCAGAATACTACTTTATTGATTGGGTT
TTTACTAAGAGGAAATGAAAGTACTACTGATCAGACAGAGGCTACCTCAAGTGC
CTTCAGCAGCACTGCAAATTTAACTTCGCTTGCTTCGGTAAATGAAACGATCGTG
CCGATGATGTATGGCCAACCTTACTCAGGTTTGGATATTCAAATTACTTTTCTGG
TTGTCTGTGGGATCTTTATTCTTGTGGTTCTTTTGTACTTTGTCTGCTGCAAAGCC
AGAGAAAAATCTAGGAGGCCCATCTACAGGCCAGTAATCGGGGATCCTCAGCCT
CTCCAAGTGGAAGGGGGTCTAAGGAATCTTCTCTTCTCTTTTTCAGTATGGTGAT
TCAGCCATGATTCCTAGGTTCTTCCTATTTAACATCCTCTTCTGTCTATTCAACGT
GTGCGCTGCCTTCGCGGCCGTCTCGCACGCCTCGCCCGACTGTCTTGGGCCCTTC
CCCACCTACCTTCTTTTTGCCCTGCTCACCTGCACCTGCGTCTGCAGCATTGTCTG
CCTGGTCGTCACCTTCCTGCAGCTCATCGACTGGTGCTGCGCGCGCTACAATTAT
CTCCACCACAGTCCCGAATACAGGGACGAGAACGTAGCCAGAATCTTAAGGCTC
ATTTGACCATGCAGACTCTGCTCATACTGCTATCCTTCCTCTCCCCTGCCCTCGCT
GATGATGATTACTCTAAGTGCAAATTTGTGGAGCTATGGAATTTCTTAGACTGCT
ATGATGCTAAAATGGATATGCCATCCTATTACTTGGTGATTGTGGGGATAGTCAT
GGTCTGCTCCTGCACTTTCTTTGCCATCATGATCTACCCCTGTTTTGATCTCGGCT
GGAACTCTGTTGAGGCATTCACATACACACTAGAAAGCAGTTCACTAGCTTCCA
CGCCGCCACCCACACCGCCTCCCCGCAGAAATCAGTTTCCCATGATTCAGTACTT
AGAAGAGCCCCCTCCCCGGCCCCCTTCCACTGTTAGCTACTTTCACATAACCGGC
GGCGATGACTGACAACCACCTGGACCTCGAGATGGACGGCCAGGCCTCCGAGCA
GCGCATCCTGCAACTGCGCGTCCGTCAGCAGCAGGAGCGGGCCGCCAAGGAGCT
CCTCGATGCCATCAACATCCACCAGTGCAAGAAGGGCATCTTCTGCCTGGTCAA
ACAGGCAAAGATCACCTACGAGCTCGTGTCCGGCGGCAAGCAGCATCGCCTCGC
CTATGAGCTGCCCCAGCAGAAGCAGAAGTTCACCTGCATGGTGGGCGTCAACCC
CATAGTCATCACCCAGCAGTCGGGCGAGACCAGCGGCTGCATCCACTGCTCCTG
CGAAAGCCCCGAGTGCATCTACTCCCTCCTCAAGACCCTTTGCGGACTTCGCGAC
CTCCTCCCCATGAACTGATTGATTAAAGCCCAAAAAACCAATCAAACCCCTTCCC
ATTAGCCCCAATAAACAATCATTGGAAATAATCATTCAATAAAGATCACTTAC
TTGAAATCTGAAAGTATGTCTCTGGTGTAGTTGTTTAGCAGCACCTCGGTACCCT
CCTCCCAGCTCTGGTACTCCAGTCCCCGGCGGGCGGCGAACTTTCTCCACACCTT
GAAAGGGATGTCAAATTCCTGGTCCACAATTTTCATTGTTTTCCCTCTCAGATGT
CAAAGAGGCTTCGGGTGGAAGATGACTTCAACCCCGTCTACCCCTATGACTACG
CGCGGAATCAGAATATCCCCTTCCTCACTCCCCCCTTTGTCTCCTCCGATGGATTC
CAAAACTTCCCCCCTGGTGTCCTGTCACTCAAATTGGCTGACCCAATCGCTATCA
CCAATGGTGATGTCTCACTCAAGGTGGGAGGGGACTTACTTTACAAGATGGAA
CCGGAAAACTAACTATCGACACCAAGACTCCCTTGCAAGTTGCAAATAATAAAT
TAGAACTTGCGTTTGATGCACCATTGTATGAAAAAAATGGAAAACTTGCTTTAA
AAACAGGCCATGGATTAGCTGTTTTAACCAAAGACATTGGCATACCAGAATTAA
TTGGATCCCTTGTGATCTTAACTGGAAAAGGAATTGGGACAGGTACTGTTGCAG
GAGGAGGAACTATAGATGTAAGACTGGGTGATGATGGAGGTTTATCATTTGATA
AAAAGGGTGATCTAGTAGCCTGGAATAAAAAAAATGACAGGCGCACTTTGTGGA
CAACACCTGATCCATCCCCAAACTGCAGAGTATCAGAAGATAAAGATTCAAAAC
TAACTTTAATTCTTACAAAATGTGGAAGTCAGATCCTAGCAAGTTTTTCACTGCT
TGTAGTCAAAGGGACGTATGCAACTGTTGATAAAAATACAACTAATAAACAATT
TAGCATTAAACTACTGTTTGATGCAAATGGAAAGCTTAAAAGCGAATCAAACCT
TAGTGGTTATTGGAACTATAGAAGTGATAATAGTGTTGTTAGTACTCCCTATGAC
AATGCAGTGCCTTTCATGCCAAATACCACGGCTTATCCTGAAAATAAGAAAAGT
TCGGCTAAAAAAACTATTGTTGGCAATGTCTACCTAGAAGGTAATGCGGGTCAA
CCAGTAGCCGTTGCTATTAGTTTCAATAAGGAAACTACTGCTGACTATTCAATAA
CATTTGACTTTGCGTGGAGCAAAGCTTATGAAACCCCTGTGCCTTTTGACACCTC
CTCCATGACATTCTCATATATTGCCCAGGAAAATCAAGACAAAGGCGAATAAAG
TGTTTTGAAATGAACTTATGTATCTTTATTGATTTTTACACCAGCACGGGTAGTC
AGTCTCCCACCACCAGCCCATTTCACAGTGTACACGATTCTCTCAGCACGGGTGG
CCTTAAATAGGGAAATGTTCTGATTAGTGCGGGAACTGGACTTGGGGTCTATAA
TCCACACAGTTTCCTGGCGAGCCAAACGGGGGTCGGTGATTGAGATGAAGCCGT
CCTCTGAAAAGTCATCCAAGCGGGCCTCACAGTCCAAGGTCACAGTCTAGTGGA
ATGAGAAGAACGCACAGATTCATATTCGGAAAACAGGATGGGTCTGTGCCTCTC
CATCAGCGCCCTCAGCAGTCTCTGCCGCCGGGGCTCGGTGCGGCTGCTGCAGAT
GGGATCGGGATCACAAGTCTCTCTGACTATGATCCCCACAGCCTTCAGCATCAGT
CTCCTGGTGCGTCGGGCACAGCACCGCATCCTGATCTCGCTCATGTTCTCACAGT
AAGTGCAGCACATAATCACCATGTTATTCAGCAGACCATAATTCAGGGTGCTCC
AGCCAAAACTCATGTTGGGGATGATGGAACCCACGTGACCATCGTACCAGATGC
GGCAGTATATCAGGTGCCTGCCCCTCATGAACACACTGCCCATATACATGATCTC
TTTGGGCATGTCTCTGTTCACAATCTGACGGTACCATGGGAAAC |

TABLE 7-continued

Nucleic Acid Sequences of Vectors

SEQ ID NO Sequence

SEQ ID NO: 1436
CATCATCAATAATATACCTTATAGATGGAATGGTGCCAATATGCAAATGAGGTA
ATTTAAAAAAGTGCGCGTTGTGTGGTGATTGGCTGCGGGTGAACGGCTAAAAG
GGGCGGGGCAATGTTGGGAGGTTACGTGACTTATGTGGGAGGAGTTATGTTGCA
AGTTATCGCGGTAAAGGTGACGTAAAACGAGGTGTGGTTTGGACACGGAAGTAG
ACAGTTTTCCCACGCTTACTGACAGGATATGAGGTAGTTTTGGGCGGATGCAAGT
GAAAATTCTCCATTTTCGCGCGAAAACTGAATGAGGAAGTGAATTTCTGAGTCA
TTTCGCGGTTATGACAGGGTGGAGTATTTGCCGAGGGCCGAGTAGACTTTGACC
GTTTACGTGGAGGTTTCGATTACCGTGTTTTTCACCTAAATTTCCGCGTACGGTGT
CAAAGTCCTGTGTTTTTACGTAGGTGTCAGCTGATCGCTAGGGTATTTAAACCTG
ACGAGTTCCGTCAAGAGGCCACTCTTGAGTGCCAGCGAGAAGAGTTTTCTCCTCC
GCGCCGCGAGTCAGTTCTGCGCTTTGAAAATGAGACACCTGCGATTCCTGCCAC
AGGAGATTATCTCCAGCGAGACCGGGATCGAAATACTGGAGTTTGTGGTAAATA
CCCTGATGGGAGATGACCCGGAACCGCCAGTGCAGCCTTTCGATCCACCTACGC
TGCACGACCTGTATGATTTAGAGGTAGACGGGCCGGATGATCCCAATGAGGAAG
CTGTAAATGGGTTTTTTACTGATTCTATGCTGCTAGCTGCCGATGAAGGATTGGA
CATAAACCCTCCTCCTGAGACCCTTGATACCCCAGGGGTGGTTGTGGAAAGCGG
CACAGGTGGGAAAAAATTGCCTGATCTGGGAGCAGCTGAAATGGACTTGCGTTG
TTATGAAGAGGGTTTTCCTCCGAGTGATGATGAAGATGGGGAAACTGAACAGTC
CATCCATACCGCAGTGAATGAGGGAGTAAAAGCTGCCAGCGATGTTTTTAAGTT
GGACTGTCCGGAGCTGCCTGGTCATGGCTGTAAGTCTTGTGAATTTCACAGGAAT
AACACTGGAATGAAAGAACTATTGTGCTCGCTTTGCTATATGAGAATGCACTGC
CACTTTATTTACAGTAAGTGTATTTAAGTGAAATTTAAAGGAATAGTGTAGCTGT
TTAATAACTGTTGAATGGTAGATTTATGTTTTTACTTGCGATTTTTTGTAGGTCCT
GTGTCTGATGATGAGTCGCCTTCTCCTGATTCAACTACCTCACCTCCTGAAATTC
AGGCGCCCGTACCTGCAAACGTATGCAAGCCCATTCCTGTGAAGCCTAAGTCTG
GGAAACGCCCTGCTGTGGATAAGCTTGAGGACTTGTTGGAGGGTGGGGATGGAC
CTTTGGACCTTAGTACCCGGAAACTGCCAAGGCAATGAGTGCCCTGCAGCTGTG
TTTATTTAATGTGACGTCATGTAATAAAATTATGTCAGCTGCTGAGTGTTTTATTG
CTTATTGGGTGGGGACTTGGATATATAAGTAGGAGCAGATCTGTGTGGTTAGCTC
ATAGCAACCTGCTGCCATCCATGGAGGTTTGGGCTATCTTGGAAGACCTGAGAC
AGACTAGGCTACTGCTAGAAAACGCCTCGGACGGAGTCTCTGGCTTTTGGAGAT
TCTGGTTCGGAGGTGATCTAGCTAGGCTAGTGTTTAGGATAAAACAGGACTACA
GGGAAGAATTTGAAAAGTTATTGGACGACAGTCCAGGACTTTTTGAAGCTCTTA
ACTTGGGCCATCAGGCTCATTTTAAGGAGAAGGTTTTATCAGTTTTAGATTTTTC
TACTCCTGGTAGAACTGCTGCTGCTGTAGCTTTTCTTACTTTTATATTGGATAAAT
GGATCCGCCAAACCCACTTCAGCAAGGGATACGTTTTGGATTTCATAGCAGCAG
CTTTGTGGAGAACATGGAAGGCTCGCAGGATGAGGACAATCTTAGATTACTGGC
CAGTGCAGCCTCTGGGAGTAGCAGGGATACTGAGACACCCACCGGCCATGCCAG
CGGTTCTGGAGGAGGAGCAGCAGGAGGACAATCCGAGAGCCGGCCTGGACCCT
CCGGTGGAGGAGTAGCTGACCTGTTTCCTGAACTGCGACGGGTGCTTACTAGGT
CTACGTCCAGTGGACAGGACAGGGGCATTAAGAGGGAGAGGAATCCTAGTGGG
AATAATTTAAGAACCGAGTTGGCTTTAAGTTTAATGAGCCGTAGGCGTCCTGAA
ACTGTTTGGTGGCATGAGGTTCAGAGCGAAGGCAGGGATGAAGTTTCAATATTG
CAGGAGAAATATTCACTAGAACAACTTAAGACCTGTTGGTTGGAACCTGAGGAT
GATTGGGAAGTGGCCATTAGGAATTATGCTAAGATATCTCTGAGGCCTGATAAA
CAGTATAGAATTACTAAGAAGATTAATATTAGAAATGCATGCTACATATTAGGG
AATGGGCAGAGGTTATAATAGATACACAAGATAAAGCAGCTTTTAGATGTTGT
ATGATGGGTATGTGGCCAGGGGTTGTCGGCATGGAAGCAGTAACATTTATGAAT
ATTAGGTTTAGAGGGGATGGGTATAATGGCATTGTATTTATGGCTAACACTAAG
CTGATTCTACATGGTTGTAGCTTTTTTGGGGTTAATAATACTTGTGTAGAAGCTT
GGGGGCAAGTTAGTGTGAGGGGTTGTAGTTTTTATGCATGCTGGATTGCAACATC
AGGTAGGGTCAAGAGTCAGTTGTCTGCGAAGAAATGCATGTTTGAGAGATGTAA
TCTTGGCATACTGAATGAAGGTGAAGCAAGGGTCCGCCACTGCGCAGCTACAGA
AACTGGCTGCTTCATTCTAATAAAGGGAAATGCCAGTGTGAAGCATAATATGAT
CTGTGGACATTCGGATGAGAGACCTTATCAGATGCTGACCTGCGCTGGTGGACA
TTGCAATATTCTTGCTACCGTGCATATCGTTTCCCATGCACGCAAGAAATGGCCT
GTATTTGAACATAATGTGATTACCAAGTGCACCATGCACATAGGTGGTCGCAGG
GGAATGTTTATGCCTTACCAGTGTAACATGAATCATGTGAAGGTGATGTTGGAA
CCAGATGCCTTTTCCAGAGTGAGTTTAACAGGAATCTTTGATATGAATATTCAAC
TATGGAAGATCCTGAGATATGATGACACTAAACCGAGGGTGCGCGCATGCGAAT
GCGGAGGCAAGCATGCTAGATTCCAGCCGGTGTGCGTGGATGTGACTGAAGACC
TGAGACCCGATCATTTGGTGCTTGCCTGCACTGGAGCGGAGTTCGGTTCTAGTGG
TGAAGAAACTGACTAAAGTGAGTAGTGGGCAAGATGTGGATGGGACTTTGA
GGTTGGTAAGGTGGACAGATTGGGTAAATTTTGTTAATTTCTGTCTTGCAGCTGC
CATGAGTGGAAGCCCTTCTTTTGAGGGGGAGTATTTAGCCCTTATCTGACGGGC
AGGCTCCCACCATGGGCAGGAGTTCGTCAGAATGTCATGGGATCCACTGTGGAT
GGGAGACCCGTCCAGCCCGCCAATTCCTCAACGCTGACCTATGCCACTTTGAGTT
CGTCATCATTGGATGCAGCTGCAGCCGCCGCCGCTACTGCTGCGGCCAACACCA
TCCTTGGAATGGGCTATTACGGAAGCATCGTTGCCAATTCCACTTCCTCTAATAA
CCCTTCAACCCTGGCTGAGGACAAGCTACTTGTTCTCTTGGCTCAGCTTGAGGCC
TTAACCCAACGCTTAGGCGAACTGTCTAAGCAGGTGGCCCAGTTGCGTGAGCAA
ACTGAGTCTGCTGTTGCCACAGCAAAGTCTAAATAAAGATCTCAAATCAATAAA
TAAAGAAATACTTGTTATAAAACAAATGAATGTTTATTTGATTTTTCGCGCGCG
GTATGCCCTGGACCATCGGTCTCGATCATTGAGAACTCGGTGGATTTTTTCCAGT
ACCCTGTAAAGGTGGGATTGAATGTTTAGATACATGGGCATTAGTCCGTCTCGG

TABLE 7-continued

Nucleic Acid Sequences of Vectors

SEQ ID NO Sequence

```
GGGTGGAGATAGCTCCATTGAAGAGCCTCTTGCTCCGGGGTAGTGTTATAAATC
ACCCAGTCATAGCAAGGTCGGAGTGCATGGTGTTGCACAATATCTTTTAGGAGC
AGACTAATTGCAACGGGGAGGCCCTTAGTGTAGGTGTTTACAAATCTGTTGAGC
TGGGACGGGTGCATCCGGGGTGAAATTATATGCATTTTGGACTGGATCTTGAGG
TTGGCAATGTTGCCGCCTAGATCCCGTCTCGGGTTCATATTGTGCAGAACCACCA
AGACAGTGTATCCGGTGCACTTGGGAAATTTATCATGCAGCTTAGAGGGAAAAG
CATGAAAAAATTTGGAGACGCCTTTGTGACCCCCCAGATTCTCCATGCACTCATC
CATAATGATAGCGATGGGGCCGTGGGCAGCGGCACGGGCGAACACGTTCCGGG
GGTCTGAAACATCATAGTTATGCTCCTGAGTCAGGTCATCATAAGCCATTTTAAT
AAACTTTGGGCGGAGGGTGCCAGATTGGGGGATGAAAGTTCCCTCTAGCCCGGG
AGCATAGTTTCCCTCACATATTTGCATTTCCCAGGCTTTCAGTTCCGAGGGGGGG
ATCATGTCCACCTGCGGGGCTATAAAAAATACCGTTTCTGGAGCCGGGGTGATT
AACTGGGATGAGAGCAAATTCCTAAGCAGCTGAGACTTGCCGCACCCAGTGGGA
CCGTAAATGACCCCAATTACGGGTTGCAGATGGTAGTTTAGGGAGCGACAGCTG
CCGTCCTCCCGGAGCAGGGGGGCCACTTCGTTCATCATTTCCCTTACATGGATAT
TTTCCCGCACCAAGTCCGTTAGGAGGCGCTCTCCCCAAGGGATAGAAGCTCCT
GGAGCGAGGAGAAGTTTTTCAACGGTTTCAGCCCGTCAGCCATGGGCATTTTGG
AAAGAGTCTGTTGCAAGAGCTCGAGCCGATCCCAGAGCTCGGTGATGTGCTCTA
TGGCATCTCGATCCAGCAGACCTCCTCGTTTCGCGGGTTGGGACGGCTCCTGGAG
TAGGGAATCAGACGATGGGCGTCCAGCGCTGCTAGGGTCCGATCCTTCCATGGT
CGCAGCGTCCGAGTCAGGGTTGTTTCCGTCACGGTGAAGGGGTGCGCGCCTGGT
TGGGCGCTTGCGAGGGTGCGCTTCAGACTCATCCTGCTGGTCGAGAACCGCTGC
CGATCGGCGCCCTGCATGTCGGCCAGGTAGCAGTTTACCATGAGTTCGTAGTTGA
GCGCCTCGGCCGCGTGGCCTTTGGCACGGAGCTTACCTTTGGAAGTTTTATGGCA
GGCGGGGCAGTAGATACATTTGAGGGCATACAGCTTGGGCGCGAGGAAAATGG
ATTCGGGGGAGTATGCATCCGCACCGCAGGAGGCGCAGACGGTTTCGCACTCCA
CGAGCCAGGTCAGATCCGGCTCATCGGGGTCAAAAACAAGTTTTTCCGCCATGTT
TTTTGATGCGTTTCTTACCTTTGGTTTCCATGAGTTCGTGTCCCCGCTGGGTGACA
AAGAGGCTGTCCGTGTCCCCGTAGACCGACTTTATGGGCCTGTCCTCGAGCCGGA
GTGCCTCGGTCCTCTTCGTAGAGGAACCCAGCCCACTCTGATACAAAAGCGCGT
GTCCAGGCCAGCACAAAGGAGGCCACGTGGGAGGGGTAGCGGTCGTTGTCAAC
CAGTGGGTCCACCTTCTCTACGGTATGTAAACACATGTCCCCCTCCTCCACATCC
AAGAATGTGATTGGCTTGTAAGTGTAGGCCACGTGACCAGGGGTCCCCGCCGGG
GGGGTATAAAAGGGGGCGGGCCTCTGTTCGTCCTCACTGTCTTCAGGATCGCTGT
CCAGGAGCGCCAGCTGTTGGGGTAGGTATTCCCTCTCGAAGGCGGGCATGACCT
CTGCACTCAGGTTGTCAGTTTCTAGGAACGAGGAGGATTTGATATTGACAGTACC
AGCAGAGATGCCTTTCATAAGACTCTCGTCCATCTGGTCAGAAAACACAATCTTC
TTGTTGTCCAGCTTGGTGGCAAATGATCCATAAAGGGCATTGGACAGAAGCTTG
GCGATGGAGCGCATGGTTTGGTTCTTTTCCTTGTCCGCGCGCTCCTTGGCGGCGA
TGTTAAGCTGGACGTACTCGCGCGCCACACATTTCCATTCAGGGAAGATGGTTGT
CAGTTCATCCGGAACTATTCTGACTCGCCATCCCTATTGTGCAGGGTTATCAGA
TCCACACTGGTGGCCACCTCGCCTCGGAGGGGCTCATTGGTCAGCAGAGTCGA
CCTCCTTTTCTTGAACAGAAAGGGGGAGGGGGTCTAGCATGAACTCATCAGGG
GGGTCCGCATCTATGGTAAATATTCCCGGTAGCAAATCTTTGTCAAAATAGCTGA
TGGTGGCGGGATCACCCAAGGTCATCTGCCATTCTCGAACTGCCAGCGCGCGCT
CATAGGGGTTAAGAGGGGTGCCCCAGGGCATGGGGTGGGTGAGCGCGGAGGCA
TACATGCCACAGATATCGTAGACATAGAGGGGCTCTTCGAGGATGCCGATGTAA
GTGGGATAACAGCGCCCCCCTCTGATGCTTGCTCGCACATAGTCATAGAGTTCAT
GTGAGGGGGCGAGAAGACCCGGGCCCAGATTGGTGCGGTTGGGTTTTTCCGCCC
TGTAAACGATCTGGCGAAAGATGGCATGGGAATTGGAAGAGATAGTAGGTCTCT
GGAATATGTTAAAATGGGCATGAGGTAGGCCTACAGAGTCCCTTATGAAGTGGG
CATATGACTCTTGCAGCTTGGCTACCAGCTCGGCGGTGACGAGTACGTCCAGGG
CACAGTAGTCGAGAGTTTCCTGGATGATGTCATAACGCGGTTGGCTTTTCTTTTC
CCACAGCTCGCGGTTGAGAAGGTATTCTTCGCGATCCTTCCAGTACTCTTCGAGG
GGAAACCCGTCTTTTTCTGCACGGTAAGAGCCCAACATGTAGAACTGATTGACT
GCCTTGTAGGGACAGCATCCCTTCTCCACTGGGAGAGAGTATGCTTGGGCTGCAT
TGCGCAGCGAGGTATGAGTGAGAGCAAAAGTGTCCCTGACCATGACTTTGAGGA
ATTGATACTTGAAGTCGATGTCATCACAGGCCCCCTGTTCCCAGAGTTGGAAGTC
CACCCGCTTCTTGTAGGCGGGGTTGGGCAAAGCGAAAGTAACATCATTGAAGAG
GATCTTGCCGGCCCTGGGCATGAAATTTCGGGTGATTCTGAAAGGCTGAGGGAC
CTCTGCTCGGTTATTGATAACCTGAGCGGCCAAGACGATCTCATCAAAGCCATTG
ATGTTGTGCCCCACTATGTACAGTTCTAAGAATCGAGGTGTGCCCCTGACATGAG
GCAGCTTCTTGAGTTCTTCAAAAGTGAGGTCTGTAGGGTCAGTGAGGACATAGT
GTTCGAGGGCCCATTCGTGCACGTGAGGGTTCGCTTTGAGGAAGGAGGACCAGA
GGTCCACTGCCAGTGCTGTTTGTAACTGGTCCCGGTACTGACGAAATGCTGCCC
GACTGCCATCTTTTCTGGGGTGACGCAATAGAAGGTTTGGGGGTCCTGCCGCCA
GCGATCCCACTTGAGTTTTATGGCCAGGTCATAGGCGATGTTGACGAGCCGCTG
GTCTCCAGAGAGTTTCATGACCAGCATGAAGGGGATTAGCTGCTTGCCAAAGGA
CCCCATCCAGGTGTAGGTTTCCACATCGTAGGTGAGGAAGAGCCTTTCTGTGCGA
GGATGAGAGCCAATCGGGAAGAACTGGATCTCCTGCCACCAGTTGGAGGAATGG
CTGTTGATGTGATGGAAGTAGAACTCCCTGCGACGCGCCGAGCATTCATGCTTGT
GCTTGTACAGACGCCGCAGTACTCGCATCGATTCACGGGATGCACCTCATGAA
TGAGTTGTACCTGACTTCCTTTGACGAGAAATTTCAGTGAAAATTGAGGCCTGG
CGATTGTACCTCGCGCTCTACTATGTTGTCTGCATCGGCATGACCATCTTCTGTCT
CGATGGTGGTCATGCTGACGAGCCCTCGCGGGAGGCAAGTCCAGACCTCGGCGC
GGCAGGGGCGGAGCTCGAGGACGAGAGCGCGCAGGCCGGAGCTGTCCAGGGTC
```

TABLE 7-continued

Nucleic Acid Sequences of Vectors

SEQ ID NO Sequence

CTGAGACGCTGCGGAGTCAGGTTAGTAGGCAGTGTCAGGAGATTGACTTGCATG
ATCTTTTCGAGGGCGTGAGGGAGGTTCAGATGGTACTTGATCTCCACGGGTCCGT
TGGTGGAGATGTCGATGGCTTGCAGGGTTCCGTGCCCCTTGGGCGCTACCACCGT
GCCCTTGTTTTTCCTTTTGGGCGGCGGTGGCTCTGTTGCTTCTTGCATGTTTAGAA
GCGGTGTCGAGGGCGCGCACCGGGCGGCAGGGGCGGTTCGGGACCCGGCGGCA
TGGCCGGCAGTGGTACGTCGGCGCCGCGCGCGGGTAGGTTCTGGTACTGCGCCC
TGAGAAGACTCGCATGCGCGACGACGCGGCGGTTGACATCCTGGATCTGACGCC
TCTGGGTGAAAGCTACCGGTCCCGTGAGCTTGAACCTGAAAGAGAGTTCAACAG
AATCAATCTCGGTATCGTTGACGGCGGCTTGCCTAAGGATTTCTTGCACGTCGCC
AGAGTTGTCCTGGTAGGCGATCTCGGCCATGAACTGCTCGATCTCTTCCTCTTGA
AGATCTCCGCGGCCCGCTCTCGACGGTGGCCGCGAGGTCGTTGGAGATGCGC
CCAATGAGTTGAGAGAATGCATTCATGCCCGCCTCGTTCCAGACGCGGCTGTAG
ACCACAGCCCCCACGGGATCTCTCGCGCGCATGACCACCTGGGCGAGGTTGAGC
TCCACGTGGCGGGTGAAGACCGCATAGTTGCATAGGCGCTGGAAAAGGTAGTTG
AGTGTGGTGGCGATGTGCTCGGTGACGAAGAAATACATGATCCATCGTCTCAGC
GGCATCTCGCTGACATCGCCCAGCGCTTCCAAGCGCTCCATGGCCTCGTAGAAGT
CCACGGCAAAGTTGAAAAACTGGGAGTTACGCGGACACGGTCAACTCCTCTT
CCAAAAGACGGATGAGTTCGGCGATGGTGGTGCGCACCTCGAGCTCGAAAGCCC
CTGGGATTTCTTCCTCAATCTCTTCTTCTTCCACTAACATCTCTTCCTCTTCAGGT
GGGGCTGCAGGAGGAGGGGGAACTCGGCGACGCCGGCGGCGCACGGGCAGACG
GTCGATGAATCTTTCAATGACCTCTCCGCGGCGGCGGCGCATGGTCTCGGTGACG
GCACGACCGTTCTCCCTGGGTCTCAGAGTGAAGACGCCTCCGCGCATCTCCCTGA
AGTGGTGACTGGGAGGCTCTCCGTTGGGCAGGGACACCGCGCTGATTATGCATT
TTATCAATTGCCCCGTAGGTACTCCGCGCAAGGACCTGATCGTCTCAAGATCCAC
GGGATCTGAAAACCTTTCGACGAAAGCGTCTAACCAGTCGCAATCGCAAGGTAG
GCTGAGCACTGTTTCTTGCGGGCGGGGGCGGCTAGACGCTCGGTCGGGGTTCTCT
CTTTCTTCTCCTTCCTCCTCTTGGGAGGGTGAGACGATGCTGCTGGTGATGAAAT
TAAAATAGGCAGTTTTGAGACGGCGGATGGTGGCTAGGAGCACCAGGTCTTTGG
GTCCGGCTTGTTGGATGCGCAGGCGATGTGCCATTCCCCAAGCATTATCCTGACA
TCTGGCCAGATCTTTATAGTAGTCTTGCATGAGTCGTTCCACGGGCACTTCTTCTT
CGCCCGCTCTGCCATGCATGCGAGTGATCCCGAACCCGCGCATGGGCTGGACAA
GTGCCAGGTCCGCTACAACCCTTTCGGCGAGGATGGCTTGCTGCACCTGGGTGA
GGGTGGCTTGGAAGTCATCAAAGTCCACGAAGCGGTGGTAGGCCCCGGTGTTGA
TTGTGTAGGAGCAGTTGGCCATGACTGACCAGTTGACTGTCTGGTGCCCAGGGC
GCACGAGCTCGGTGTACTTGAGGCGCGAGTATGCGCGGGTGTCAAAGATGTAAT
CGTTGCAGGTGCGCACCAGGTACTGGTAGCCGATGAGAAAGTGTGGCGGTGGCT
GGCGGTACAGGGGCCATCGCTCTGTAGCCGGGCGCCGGGGCGAGGTCTTCCA
GCATGAGTCGGTGGTAGCCGTAGATGTACCTGGACATCCAGGTGATACCGGAGG
CGGTGGTGGATGCACGTGGGAACTCGCGCACGCGGTTCCAGATGTTGCGCAGCG
GCATGAAGTAGTTCATGGTAGGCACGGTTTGGCCCGTGAGGCGCGCACAGTCGT
TGATGCTCTAGACATACGGGCAAAAAACGAAAGCGGTCAGCGGCTCGTCTCCGT
GGCCTGGAGGCTAAGCGAACGGGTTGGGCTGCGCGTGTACCCCGGTTCGAATCT
CGGATCAGGCTGGAGCCGCAGCTAACGTGGTACTGGCACTCCCGTCTCGACCCA
GGCCTGCACAAAACCTCCAGGATACGGAGGCGGGTCGTTTTTTTTTTGTCTTTTT
CCTGGATGGGAGCCAGTGCTGCGTCAAGCTTTAGAACGCTCAGTTCTCGGGGCT
GGGAGTGGCTCGCGCCCGTAGTCTGGAGAATCAATCGCCAGGGTTGCGTTGCGG
TGTGCCCCGGTTCGAGTCTTAGCGCGTCGGATCGGCCGGTTTCCGCGACAAGCG
AGGGTTTGGCAGCCCCGTCATTTCTAAGACCCCGCCAGCCGACTTCTCCAGTTTA
CGGGAGCGAGCCCTCTTTTTTTTTTGTTTTTTGTTGCCCAGATGCATCCCGTGCT
GCGACAGATGCGCCCCCAGCAACAGCCCCCTTCTCAGCAGCAGCTACAACAACA
GCCACAAAAGGCTCTTCCTGCTCCTGTAACTACTGCGGCTGCAGCCGTCAGCGGC
GCGGGACAGCCCGCCTATGATCTGGACTTGGAAGAGGGCGAGGGATTGGCGCGC
CTGGGGGCTCCATCGCCCGAGCGGCACCCACGGGTGCAACTAAAAAAGGACTCT
CGCGAGGCGTACGTGCCCCAACAGAACCTATTCAGGGACAGGAGCGGCGAGGA
GCCAGAGGAGATGCGAGCATCTCGATTTAACGCGGGTCGCGAGCTGCGCCACGG
TCTGGATCGAAGACGGGTGCTGCAAGACGAGGATTTTGAGGTCGATGAAGTGAC
AGGGATCAGCCCAGCTAGGGCACATGTGGCCGCGGCCAACCTAGTCTCGGCCTA
CGAGCAGACCGTGAAGGAGGAGCGCAACTTCCAAAAATCTTTCAACAACCATGT
GCGCACCCTGATCGCCCGCGAGGAAGTGACCCTGGGTCTGATGCACCTGTGGGA
CCTGATGGAGGCTATCACCCAGAACCCCACTAGCAAACCCCTGACAGCTCAGCT
GTTTCTGGTTGTTCAACATAGCAGGGACAACGAGGCATTCAGGGAGGCGTTGTT
AAACATCACCGAGCCCGATGGGAGATGGCTGTATGATCTGATTAACATCCTGCA
AAGTATTATAGTGCAGGAACGTAGCCTGGGTTTGGCTGAGAAAGTGGCAGCTAT
TAACTACTCGGTCTTGAGTCTGGGCAAATACTACGCTCGCAAGATCTACAAGAC
CCCCTACGTACCCATAGACAAGGAGGTGAAGATAGATGGGTTTTACATGCGCAT
GACTCTCAAGGTGCTGACTCTGAGCGACGATCTGGGGGTGTATCGTAATGACAG
GATGCACCGCGCGGTGAGCGCCAGCAGGAGGCGCGAGCTGACGACAGAGAAC
TTATGCACAGCTTGCAAAGAGCTCTAACGGGGGCCGGAACTGATGGGGAGAACT
ACTTTGACATGGGAGCGGACTTGCAATGGCAACCCAGTCGCAGGGCCATGGAGG
CTGCGGGGTGTGAGCTTCCTTACATAGAAGAGGTGGATGAAGCCGAGGACGAGG
AGGGCGAGTACTTGGAAGACTGATGGCGCGACCCATATTTTTGCTAGATGGAAC
AGCAGCAGGCACCGGACCCCGCAATGCGGGCGGCGCTACAGAGCCAGCCGTCC
GGCATTAACTCCTCGGACGATTGGACCCAGGCCATGCAACGCATAATGGCGCTG
ACGACCCGCAACCCCGAAGCCTTTAGACAGCAACCCCAGGCCAACCGCCTTTCG
GCCATACTGGAGGCCGTAGTGCCCTCCCGCTCCAACCCCACCCACGAGAAGGTC
CTGGCTATCGTGAACGCGCTGGTGGAGAACAAGGCCATCCGTCCCGATGAGGCC

TABLE 7-continued

Nucleic Acid Sequences of Vectors

| SEQ ID NO | Sequence |
|---|---|
| | GGGCTGGTATACAATGCTCTCTTGGAGCGCGTGGCCCGTTACAACAGCAGCAAC
GTGCAGACCAACCTGGACCGGATGGTGACCGATGTGCGCGAGGCTGTGTCTCAG
CGCGAGCGGTTCCAACGCGACGCCAACTTGGGGTCGTTGGTAGCGCTAAACGCT
TTCCTTAGCACCCAGCCCGCCAACGTGCCCCGTGGTCAGCAAGACTATACAAAC
TTTTTAAGTGCATTAAGACTCATGGTATCTGAGGTGCCCCAGAGCGAGGTGTACC
AGTCCGGGCCAGATTACTTCTTCCAGACCAGCAGACAGGGCTTGCAGACAGTGA
ACCTGACCCAGGCTTTCAAGAACCTGAAGGGTCTGTGGGGAGTGCACGCCCCAG
TAGGAGATCGCGCGACCGTGTCTAGTTTGCTGACTCCCAACTCCCGCCTGCTGCT
GCTGCTGGTATCCCCCTTCACTGACAGCGGTAGCATCGACCGCAACTCCTACTTG
GGCTACCTGCTTAACCTGTATCGCGAGGCCATAGGGCAGAGCCAGGTGGACGAG
CAGACTTATCAAGAAATCACCCAAGTAAGCCGCGCCCTGGGTCAGGAAGACACG
GGCGGTTTGGAAGCCACCCTGAACTTCTTACTAACCAACCGGTCGCAGAAGATC
CCTCCTCAGTATGCGCTTACCGCCGAGGAGGAGCGGATCCTAAGATACGTGCAA
CAGAGCGTTGGACTGTTCCTGATGCAGGAGGGGGCGACACCTACCGCCGCGCTG
GATATGACAGCTCGAAACATGGAGCCCAGCATGTATGCTAGTAACAGGCCTTTC
ATTAACAAACTGCTGGACTACCTGCACAGGGCGGCCGCCATGAACTCTGATTAT
TTCACCAATGCTATTCTGAACCCACACTGGCTGCCTCCACCTGGTTTCTACACTG
GCGAATACGACATGCCCGATCCCAATGACGGGTTCCTGTGGGACGATGTGGACA
GTAGCATATTTTCCCCGCCTCCAGGTTATACGGTTTGGAAGAAGGAAGGGGGCG
ATAGAAGGCACTCTTCCGTATCGTTGCCCGGAACGGCTGGTGCTGCCGCGGCCG
TGCCCGAAGCTGCGAGTCCTTTCCCTAGCTTGTCCTTTTCACTAAACAGCGTTCG
CAGCAGTGAACTGGGGAGAATAAACCGCCCGCGCTTGATGGGCGAGGATGAGT
ACTTGAATGACTCTTTGCTGAGGCCAGAGAGGGAAAAAAACTTCCCTAACAATG
GAATAGAGAGCCTGGTGGATAAGATGAGTAGATGGAAGACCTATGCGCAGGAT
CACAGAGACGAGCCCAGGATCTTGGGGGCTACAAGCAGACCGAGCCGTAGACG
CCAGCGCCACGACAGGCAGATGGGTCTTGTGTGGGACGACGAGGACTCTGCCGA
TGACAGCAGCGTGTTGGACTTGGGTGGAAAAGGAGTTGGCAACCCGTTCGCTCA
TCTGCGTCCCCGTTTCGGTCGCATGTTGTAAAAGTGAAAGTAAAAATAAAAAGG
CAACTCACCAAGGCCATGGCAACCGAGCGTGCGTTCGTTCTTTTTTTTGTTATCT
GTATCTAGTACGATGAGGAGACGAGCCGTGCTAGGCGGAGCGGTGGTGTATCCG
GAGGGTCCTCCTCCTTCTTACGAGAGCGTGATGCAGCAACAGGCGGCGATGATA
CAGCCCCCACTGGAGGCTCCCTTCGTACCCCCTCGGTACCTGGCGCCTACGGAAG
GGAGAAATAGCATTCGTTACTCGGAGCTGTCACCCCAGTACGATACCACCAAGT
TGTATCTGGTGGACAACAAGTCGGCGGACATCGCCTCCCTGAACTATCAGAACG
ACCACAGCAACTTCCTGACCACAGTGGTGCAGAACAATGACTTTACCCCCACTG
AGGCTAGCACCCAGACCATTAACTTTGACGAGCGGTCGCGGTGGGCGGTCAGC
TGAAGACCATTATGCACACCAACATGCCCAACGTGAACGAGTACATGTTCAGCA
ACAAGTTTAAGGCGAGGGTGATGGTATCTAGGAAGGCTCCTGAAGGTGTTACAG
TAAATGATCATAAAGATGATATTTTGAAATATGAGTGGTTTGAGTTCACTTTACC
AGAAGGTAACTTCTCAGCTACCATGACCATCGACCTGATGAACAATGCCATCAT
TGACAACTACCTGAAAATTGGCAGACAGAATGGAGTGCTGGAAAGTGACATTGG
TGTTAAGTTTGACACTAGAAACTTCAGGCTCGGGTGGGACCCCGAAACTAAGTT
GATTATGCCAGGGGTCTACACTTATGAGGCATTCCATCCTGACATTGTTTTGTTG
CCTGGTTGCGGGGTAGACTTTACTGAAAGCCGACTTAGCAACTTGCTTGGCATCA
GGAAGAGACATCCATTCCAGGAGGGTTTCAAAATCATGTATGAAGATCTTGAAG
GGGGTAATATTCCTGCCCTTTTGGATGTCACTGCCTATGAGGAAAGCAAAAAGG
ATACCACTACTGAAACAGGCGAAAAGGCGGTGGTTAAAACAACCACAGTGGCT
GTTGCAGAGGAAACCAGTGAAGATGATAATATAACTAGAGGAGATACTTATATA
ACTGAAAAAAAAAAACGTGAAGCTGCAGCTGCAGAACTATTACTTATGTCTGAA
GTTAAAAAAGAGTTAAAGATCCAACCTTTAGAAAAAGACAGCAAGAATAGAAG
CTACAATGTCTTGGAAGACAAAATCAACACAGCCTACCGCAGCTGGTACCTGTC
CTACAATTATGGTAACCCTGAGAAAGGAATAAGGTCCTGGACACTGCTCACCAC
TTCGGATGTCACCTGTGGAGCCGAGCAGGTCTACTGGTCGCTCCCCGACATGATG
CAAGACCCCATCACCTTCCGCTCCTCGAGACAAGTCAACAACTACCCAGTAGTG
GGTGCAGAGCTTATGCCCGTCTTCTCAAAGAGTTTCTACAATGAGCAAGCCGTGT
ACTCTCAGCAGCTCCGACAGTCCACCTCGCTCACGCACGTCTTCAACCGCTTCCC
TGAGAACCAGATCCTCATCCGCCCGCCGGCGCCCACAATTACCACCATCAGTGA
AAACGTTCCTGCTCTCACAGATCACGGGACCCTGCCGTTACGCAGCAGTATCCG
GGGAGTCCAGCGCGTGACCGTTACTGACGCCAGACGTCGCACCTGTCCCTACGT
TTACAAGGCCCTGGGCATAGTCGCGCCGCGCGTTCTTTCAAGCCGCACTTTCTAA
AAAAAAAAAAATGTCCATTCTCATCTCGCCCAGTAATAATACCGGTTGGGGAC
TGCATGCGCCCACCAAGATGTACGGAGGCGCCCGCAAACGCTCTACCCAGCACC
CCGTGCGCGTTCGCGGTCATTTCCGCGCTCCCTGGGGCGCCCTCAAGGGCCGTAC
CCGCACTCGGACCACGGTCGATGATGTGATCGACCAGGTGGTTGCCGATGCTCG
TAATTATACTCCTACTGCGCCTACATCTACTGTGGATGCAGTTATTGACAGTGTG
GTGGCAGACGCCCGCGCCTATGCTCGCCGGAAAAGCCGAAGGAGGCGCATCGCC
AGGCGCCACAGGGCTACTCCCGCCATGCGAGCTGCAAAAGCTATTCTGCGGAGG
GCCAAACGTGTGGGGCGAAGAGCCATGCTTAGAGCGGCCAGACGCGCGGCTTCT
GGTGCTAGCAGCGGCAGGTCCCGCAGGCGCGCGGCCACGGCGGCAGCAGCGGC
CATTGCCAACATGGTCCAACCGCGAAGAGGCAATGTGTATTGGGTGCGCGATGC
CGCTACCGGCCAGCGCGTGCCCGTGCGCACCCGCCCCCCTCGCACTTAGAAGAT
ACTGAGCAGTCTCCGATGTTGTGTCCCAGCGGCAAGTATGTCCAAGCGCAAATA
CAAGGAAGAGATGCTCCAGGTCATCGCGCTGAAATCTACGGTCACCGATGAA
GGATGAAAAAAAGCCCCGCAAAATCAAGCGGGTCAAAAAGGACAAAAAAGAA
GAAGATGGCGATGATGGGCTGGTAGAGTTTGTGCGCGAGTTCGCCCCAAGACGG
CGCGTGCAGTGGCGCGGTCGAAAAGTGCGCCAAGTGCTTAGACCCGGGACCACT |

TABLE 7-continued

Nucleic Acid Sequences of Vectors

SEQ ID NO Sequence

GTGGTCTTTACACCTGGCGAGCGTTCCAGCACTACTTTTAAACGGTCCTATGATG
AGGTGTATGGGGATGACGATATTCTTGAGCAGGCGGCAGACCGCCTTGGCGAGT
TTGCTTATGGCAAGCGCACAAGATCCAGTCCCAAAGAGGAGGCGGTGTCTATTC
CCTTGGATCATGGAAATCCCACCCCCAGCCTCAAACCAGTCACCCTGCAGCAAG
TGCTGCCCGTACCCGCGAGCAGAGGCGTAAAGCGCGAGGGTGAGGACCTATATC
CCACCATGCAGCTAATGGTGCCCAAGCGCCAAAGATTAGAAGATGTACTGGAGA
AAATGAAAGTGGATGCCGATATCCAGCCTGAGGTCAAAGTGAGACCCATCAAGG
AAGTGGCGCCAGGTTTGGGAGTACAAACCTTTGACATCAAGATTCCCACTGAGT
CCATGGAAGTGCAGACCGAACCTGCAAAACCCACAACCACCTCAATTGAGGTGC
AGACGGAACCCTGGATGCACGCGCCCGTTGCCGCCCCCAGCACCACTAGAAGAT
CACGTCGAAAGTATGGCCCAGCAAGTCTGATAATGCCCAACTATGCTCTGCACC
CATCCATCATTCCCACCCCGGGTTACAGAGGCACTCGCTACTATCGAAGTCGGA
GCAACACCTCACGCCGCCGCAAACTACCTGCAAGTCGCACTCGCCGTCGCCGCC
GCCGCACCACTGCCAGCAAATTAACTCCCACCGCCCTGGTGCGGAGAGTGTACC
GCGATGGTCGCGCTGAACCTCTGACGCTGCCGCGCGCGCGCTACCATCCAAGCA
TCACCACTTAATGACTGTTGACGCTGCCTCCTTGCAGATATGGCCCTCACTTGCC
GCCTTCGCGTCCCCATTACTGGCTACCGAGGAAGAAACTCGCGCCGTAGAAGGA
TGTTGGGGCGAGGGATGCGCCGCCACAGACGAAGGCGCGCTATCAGCAAGCGA
TTAGGGGGTGGCTTTCTGCCAGCTCTTATACCCATCATCGCCGCGGCGATCGGGG
CGATACCAGGCATAGCTTCCGTGGCGGTTCAGGCCTCGCAGCGCCACTAACAAT
GGAAAAACTTATAAATAAAAAATAGAATGGACTCTGACGCTCCTGGTCCTGTGA
CTATGTTTTTGTAGAGATGGAAGACATCAATTTTTCATCCCTGGCTCCGCGACAC
GGCACGAGGCCGTACATGGGCACCTGGAGCGACATCGGCACGAGCCAACTGAA
CGGGGGCGCCTTCAATTGGAACAGTATCTGGAGCGGGCTTAAAAATTTTGGCTC
GACCATAAAAACCTATGGGAATAAAGCTTGGAACAGCAGCACAGGGCAGGCTC
TGAGAAATAAGCTTAAGGAGCAGAACTTCCAACAGAAGGTGGTTGATGGTATCG
CCTCTGGTATTAACGGCGTAGTGGATCTGGCCAACCAGGCTGTGCAGAAACAGA
TAAACAGCCGCCTGGACCCGCCGCCCGCAACCGCTGGTGAAATGGAAGTGGAGG
AAGAGCTTCCTCCGCTGGAAAAGCGGGGCGACAAGCGACCGCGTCCCGAGCTGG
AGCAGACGTTGGTGACGCGCGCAGACGAGCCCCCTTCATACGAGGAGGCAGTAA
AGCTCGGAATGCCCACTACCAGGCCTGTAGCTCACATGGCTACCGGGGTGATGA
AACCTTCTCAGTCGCATCGGCCCGTCACCTTGGACTTGCCTCCTCCCCCTGCTTCT
GCGGCGCCTGTTCCCAAACCTGTCGCTACCAGAAAGCCCACCGCCATACAGCCC
GTCGCCGTAGCCAGACCGCGTCCTGGGGGCACACCGCGCCCGAAAGCAAACTGG
CAGAGTACTCTGAACAGCATCGTGGGTCTGGGCGTGCAAAGTGTAAAGCGCCGT
CGCTGCTATTAATTAAATATGGAGTAGCGCTTAACTTGCTTGTCTGTGTATGT
ATCATCACCACGCCGCCGCAGCAGAGGAGAAAGGAAGAGGTCGCGCGCCGAGG
CTGAGTTGCTTTCAAGATGGCCACCCCATCGATGATGCCCCAATGGGCTTACATG
CACATCGCCGGACAGGATGCTTCGGAGTACCTGAGTCCGGGTCTGGTGCAGTTC
GCCCGTGCAACAGACACCTACTTCAGTATGGGGAACAAGTTTAGAAACCCCACA
GTGGCGCCCACCCACGATGTGACCACCGACCGTAGCCAGCGCCTGATGCTGCGC
TTTGTGCCCGTTGACCGGGAAGACAATACCTACTCTTACAAAGTTCGCTACACGC
TGGCTGTAGGCGACAACAGAGTGCTTGACATGGCCAGCACATTCTTTGACATTC
GGGGGGTGCTCGATAGAGGTCCTAGCTTCAAGCCATATTCCGGCACAGCTTACA
ATTCACTGGCTCCTAAGGGCGCGCCCAATACATCTCAGTGGATAGTTACAACAA
ATGCGGACCAAACTACCACCACCACCACAAACACATTCGGCATTGCTGCCATGA
AGGGAGACAATATTACTAAAGAAGGTTTACAAATTGGGAAAGACATTACCACTA
CCGAAGGAGAAGAAAGCCCATTTATGCCGATAAAACATATCAGCCAGAGCCTC
AAGTTGGAGAAGAATCATGGACTGATACTGATGGAACAAATGAAAAGTTTGGTG
GTAGAGCCCTTAAACCAGCTACCAACATGAAGCCGTGCTACGGGTCTTTTGCAA
GACCTACAAACATAAAAGGGGGTCAGGCTAAAAACAGAAAAGTAAAACCAACA
ACCGAAGGAGGGGTTGAAACTGAAGAACCAGATATTGATATGGAATTTTTCGAT
GGTAGAGATGCTGTTGCAGGAGCTTTAGCGCCTGAAATTGTGCTTTATACGGAA
AATGTAAATTTGGAAACTCCAGACAGTCATGTGGTATATAAGCCAGGAACTTCT
GATAACTCTCATGCAAATTTGGGTCAACAAGCCATGCCTAACAGACCCAATTAC
ATTGGCTTCAGGGATAACTTTGTGGGCCTAATGTACTACAACAGTACTGGAAAT
ATGGGAGTTTTGGCTGGCCAAGCATCACAACTGAATGCAGTGGTTGACTTGCAG
GACAGAAATACTGAACTGTCATATCAGCTTTTGCTTGATTCTCTGGGAGACAGAA
CCAGATACTTCAGCATGTGGAATCAGGCTGTGGACAGTTATGATCCCGATGTTCA
CATTATTGAAAATCATGGCATCGAGGATGAACTGCCTAATTACTGTTTTCCTCTG
GATGGCATAGGACCAGGGCACACATATCAAGGCATTAAAGTTAAAACCGATGAC
ACTAATGGATGGGAAAAAGATGCTAATGTTGCTACAGCTAATGAAATAGCCATA
GGCAACAACCTGGCTATGGAAATTAATATTCAAGCTAACCTTTGGAGAAATTTTC
TCTACTCCAATGTGGCTTTGTACCTTCCAGATGTTTACAAGTACACGCCACCTAA
CATTACTCTGCCCGCTAACACCAACACCTATGAGTACATGAACGGGCGAGTGGT
ATCCCCATCTCTGGTTGATTCATACATCAACATTGGCGCCAGATGGTCTCTTGAC
CCAATGGACAATGTAAATCCATTCAACCACCACCGCAATGCTGGTTTGCGCTAC
AGGTCCATGCTTCTGGGAAATGGTCGTTATGTGCCTTTCCACATACAAGTGCCTC
AGAAATTCTTTGCTGTTAAAAACCTGCTGCTTCTCCCAGGCTCCTACACTTATGA
GTGGAACTTCAGAAAGGATGTGAACATGGTCCTGCAAAGTTCCCTTGGAAATGA
CCTCAGAACAGATGGTGCTACCATAAGTTTTACCAGCATCAACCTCTATGCCACC
TTCTTCCCCATGGCTCACAACACCGCTTCAACCCTTGAAGCCATGCTGCGCAACG
ATACCAATGATCAGTCATTCAACGACTACCTCTCTGCAGCTAACATGCTTTACCC
CATCCCTGCCAATGCAACCAATATTCCCATTTCCATTCCTTCTCGCAACTGGGCA
GCCTTCAGGGGCTGGTCCTTCACCAGACTCAAAACCAAGGAGACTCCATCTCTTG
GATCAGGGTTCGATCCCTACTTCGTATATTCTGGATCTATTCCCTACCTGGATGG

TABLE 7-continued

Nucleic Acid Sequences of Vectors

SEQ ID NO Sequence

CACCTTTTACCTTAACCACACTTTCAAGAAGGTCTCCATCATGTTTGACTCCTCA
GTCAGCTGGCCTGGCAATGACAGGCTGTTGAGCCCAAATGAGTTTGAAATCAAG
CGCACTGTGGACGGGGAAGGATACAATGTGGCCCAATGCAACATGACCAAAGA
CTGGTTCCTGGTTCAGATGCTTGCCAACTACAACATTGGCTACCAGGGCTTTTAC
ATCCCTGAGGGATACAAGGATCGCATGTACTCCTTTTTCAGAAACTTCCAGCCTA
TGAGCAGGCAGGTGGTTGATGAGGTTAATTACACTGACTACAAAGCCGTCACCT
TACCATACCAACACAACAACTCTGGCTTTGTAGGGTACCTTGCACCTACTATGAG
ACAAGGGGAACCTTACCCAGCCAATTATCCATACCCGCTCATCGGAACTACTGC
CGTTAAGAGTGTCACCCAGAAAAAGTTCCTGTGCGACAGGACCATGTGGCGCAT
TCCCTTCTCCAGCAACTTCATGTCCATGGGGCCCTTACAGACCTGGGACAGAAC
CTGCTCTATGCCAACTCGGCCCATGCGCTGGACATGACTTTTGAGGTGGATCCCA
TGGATGAGCCCACCCTGCTTTATCTTCTTTTCGAAGTCTTCGACGTGGTCAGAGT
GCACCAGCCACACCGCGGCGTCATCGAGGCCGTCTACCTGCGCACACCGTTCTC
GGCCGGCAACGCCACCACATAAGAAGCCTCTTGCTTCTTGCAAGCAGCAGCTGC
AGCCATGTCATGCGGGTCCGGAAACGGCTCCAGCGAGCAAGAGCTCAAAGCCAT
CGTCCGAGACCTGGGTTGCGGACCCTATTTCCTGGGAACCTTTGACAAGCGTTTC
CCGGGGTTCATGGCCCCCGACAAGCTCGCCTGCGCCATAGTCAACACTGCCGGA
CGCGAGACGGGGGGAGAGCACTGGCTGGCTTTTGGTTGGAACCCGCGCTCCAAC
ACCTGCTACCTTTTGATCCTTTTGGGTTCTCGGATGAGCGACTCAAACAGATTT
ACCAGTTTGAGTACGAGGGGCTCCTGCGCCGCAGTGCCCTTGCTACCAAAGACC
GCTGCATCACCCTGGAAAAGTCCACCCAGAGCGTGCAGGGCCCACGCTCAGCCG
CCTGTGGACTTTTTTGCTGTATGTTCCTTCATGCCTTTGTGCACTGGCCCGACCGC
CCCATGAACGGAAACCCCACCATGAAGTTGCTGACTGGGGTGTCCAACAGCATG
CTCCAATCTCCCCAAGTCCAGCCCACCCTGCGCCGCAACCAGGAGGCGCTATAT
CGCTTCCTAAACACCCATTCATCTTACTTTCGTTCTCACCGCGCACGCATCGAAA
GGGCCACCGCGTTTGACCGTATGGATATGCAATAAGTCATGTAAAACCGTGTTC
AATAAAAAGCACTTTATTTTTACATGCACTAAGGCTCTGGTTTTTTGCTCATTCGT
TTTCATCATTCACTCAGAAATCAAATGGGTTCTGGCGGGAGTCAGAGTGGCCCG
CGGGCAGGGATACGTTGCGGAACTGTAACCTGTTCTGCCACTTGAACTCGGGGA
TCACCAGCTTGGGAACTGGAATCTCGGGAAATGTGTCTTGCCACAACTTTCTGGT
CAGTTGCATGGCGCAAGCAGGTCAGGAGCAGAGATCTTGAAATCACAGTTGGG
GCCGGCATTCTGAACACGGGAGTTGCGGTACACTGGATTGCAACACTGGAACAC
CATCAAGGCTGGGTGTCTCACGCTTGCCAGCACGGTCGGGTCACTGATGGTAGT
CACATCCAAGTCTTCAGCATTGGCCATCCCAAAGGGGGTCATCTTACAGGTCTGC
CTGCCCATCACGGGAGCGCAGCCTGGCTTGTGGTTGCAATCGCAATGAATGGGG
ATCAACATCATCCTGGCTTGGTCGGGGGTTATCCCTGGATACACGGCCTTCATGA
AGGCTTCGTACTGCTTGAAAGCTTCCTGAGCCTTACTTCCCTCGGTGTAGAACAT
CCCACAGGACTTGCTGGAAAATTGGTTAGTAGCACAGTTGGCATCATTCACACA
GCAGCGGGCATCGTTGTTGGCCAACTGGACCACATTTCTGCCCCAGCGGTTCTGG
GTGATCTTGGCTCTGTCTGGGTTCTCCTTCATAGCGCGCTGCCCGTTCTCGCTCGC
CACATCCATCTCGATAATGTGGTCCTTCTGGATCATGATAGTGCCATGCAGGCAT
TTCACCTTGCCTTCGTAATCGGTGCATCCATGAGCCCACAGACGCGCACCCGGTGC
ACTCCCAATTATTGTGGGCGATCTCAGAATAAGAATGCACCAATCCCTGCATGA
ATCTTCCCATCATCGCTGTCAGGGTCTTCATGCTACTAAATGTCAGCGGGATGCC
ACGGTGCTCCTCGTTCACATACTGGTGGCAGATACGCTTGTACTGCTCGTGCTGC
TCTGGCATCAGCTTAAAAGAGGTTCTCAGGTCATTATCCAGCCTATACCTTTCCA
TTAGCACAGCCATCACTTCCATGCCTTTCTCCCAGGCAGATACCAGGGGCAAGCT
CAAAGGATTCCTAACAGCAATAGAAGTAGCTCCTTTAGCTATAGGGTCATTCTTG
TCGATCTTCTCAACACTTCTTTTGCCATCCTTCTCAATGATGCGCACCGGGGGGT
AGCTGAAGCCCACGGCCACCAACTGAGCCTGTTCTCTTTCTTCTTCGCTGTCCTG
GCTGATGTCTTGCAGAGGGACATGCTTGGTCTTCCTGGGCTTCTTCTTGGGAGGG
ATCGGGGGAGGACTGTTGCTCCGTTCCGGAGACAGGGATGACCGCGAAGTTTCG
CTTACCAGTACCACCTGGCTCTCGATAGAAGAATCGGACCCCACGCGACGGTAG
GTGTTCCTCTTCGGGGGCAGAGGTGGAGGCGACTGAGATGGGCTGCGGTCCGGC
CTTGGAGGCTGATGGCTGGCAGAGCCCATTCCGCGTTCGGGGGTGTGCTCCCGTT
GGCGGTCGCTTGACTGATTTCCTCCGCGGCTGGCCATTGTGTTCTCCTAGGCAGA
GAAACAACAGACATGGAAACTCAGCCATCACTGCCAACATCGCTGCAAGCGCCA
TCACACCTCGCCCCCAGCAGCGACGAGGAGGAGAGCTTAACCACCCCACCACCC
AGTCCCGCTACCACCACCTCTACCCTCGATGATGAGGAGGAGGTCGACGCAGCC
CAGGAGATGCAGGCGCAGGATAATGTGAAAGCGGAAGAGATTGAGGCAGATGT
CGAGCAGGACCCGGGCTATGTGACACCGGCGGAGCACGAGGAGGAGCTGAAAC
GTTTTCTAGACAGAGAGGATGACGACCGCCCAGAGCATCAAGCAGATGGCAATC
ACCAGGAGGCTGGCCTCGGGGATCATGTTGCCGACTACCTCACCGGGCTTGGGG
GGGAGGACGTGCTCCTCAAACATCTAGCAAGGCAGTCGATCATAGTTAAAGACG
CACTACTCAACCTCACCGAAGTGCCCATCAGTGTGGAAGAGCTTAGCCGCGCCT
ACGAGCTGAACCTCTTTTCGCCTCAGATACCCCCAAGCGGCAGCCAAACGGCA
CCTGCGAGGCCAACCCTCGACTCAACTTCTATCCAGCTTTTACTGTCCCCGAAGT
ACTGGCCACCTACCACATCTTTTTTAAGAACCAAAAGATTCCAGTCTCCTGCCGC
GCCAACCGCACCCGCGCAGATGCCCTTCTCAACTTGGGTCCGGGAGCTCGCTTAC
CTGATATAGCTGCCTTGGAAGAGGTTCCAAAGATCTTTGAGGGTTTGGGAAGTG
ATGAGACTCGGGCCGCAAATGCTCTGCAACAGGGAGAATGCATGATGAA
CATCACAGCGCTCTAGTGAACTGGAGGGTGACAATGCCCGGCTTGCAGTGCTC
AAGCGCAGTATCGTGGTCACCCATTTTGCCTACCCCGCTGTTAACCTGCCGCCCA
AAGTCATGAGCGCTGTCATGGACCATCTGCTCATCAAACGAGCAAGTCCACTTTC
AGAAAACCAGAACATGCAGGATCCAGACGCCTCGGACGAGGGCAAGCCGGTAG
TCAGTGACGAGCAGCTATCTCGCTGGCTGGGTACCAACTCCCCCCGAGATTTGG

TABLE 7-continued

Nucleic Acid Sequences of Vectors

SEQ ID NO Sequence

AAGAAAGGCGCAAGCTTATGATGGCTGTAGTGCTAGTAACTGTTGAGCTGGAGT
GTCTGCGCCGCTTTTTTACCGACCCCGAGACCCTGCGCAAGCTAGAGGAGAACC
TGCACTATACCTTCAGACATGGCTTCGTGCGCCAGGCATGCAAGATCTCCAACGT
GGAGCTCACCAACCTGGTTTCATACATGGGCATTTTGCATGAGAACCGGCTAGG
GCAGAGCGTTCTGCACACCACCCTGAAGGGGGAGGCCCGCCGCGACTACATCCG
AGACTGTGTCTACCTCTACCTCTGCCATACCTGGCAGACTGGTATGGGTGTGTGG
CAACAGTGTTTGGAAGAGCAGAACCTCAAAGAGCTGGACAAGCTCTTGCAGAGA
TCCCTGAAAGCCCTGTGGACAGGTTTTGACGAGCGCACCGTCGCCTCGGACCTG
GCGGACATCATCTTCCCCGAGCGTCTTAGGGTTACTCTGCGAAACGGCCTGCCAG
ACTTCATGAGCCAGAGCATGCTTAACAACTTTCGCTCTTTCATCCTGGAACGCTC
CGGTATCCTGCCTGTCACCTGCTGTGCGCTGCCCTCCGACTTTGTGCCTCTCACCT
ACCGCGAGTGCCCACCGCCATTATGGAGCCACTGCTACCTGTTCCGCCTGGCCAA
CTACCTCTCCTACCACTCGGATGTGATAGAGGATGTGAGCGGAGACGGCCTGCT
GGAATGCCACTGCCGATGCAATTTATGCACACCCCACCGCTCCCTCGCCTGCAAC
CCCCAGTTGCTAAGCGAGACCCAGATCATCGGCACCTTCGAGTTGCAGGGTCCC
AACAGTGAAGGCGAGGGGTCTTCTCCAGGGCAGAGTCTGAAACTGACACCGGG
GCTGTGGACCTCCGCATACCTGCGCAAGTTTCATCCCGAGGACTATCACCCCTAT
GAGATCAGGTTCTATGAGGACCAGTCACATCCTCCCAAAGTCGAGCTCTCAGCC
TGCGTCATCACCCAGGGGGCAATTCTGGCCCAATTGCAAGCCATCCAAAAATCC
CGCCAAGAATTTCTGTTGAAAAAGGGAAGCGGGGTCTACCTTGACCCCCAGACC
GGTGAGGAGCTCAACACAAAGTTCCCCCAGGATGTCCCATCGCCGAGGAAGCAA
GAAGCTGAAGGTGCAGCTGTCGCCCCCAGAGGATATGGAGGAAGACTGGGACA
GTCAGGCAGAGGAGGAGATGGAAGATTGGGACAGCCAGGCAGAGGAGGTGGAC
AGCCTGGAGGAAGACAGTTTGGAGGAGGAAGACGAGGAGGCAGAGGAGGTGG
AAGAAGCAACCGCCGCCAAACAGTTGTCATCGGCGGCGGAGACAAGCAAGTCC
CCAGACAGCAGCACGGCTACCATCTCCGCTCCGGGTCGGGGGCCCAGCGGCGG
CCCAACAGTAGATGGGACGAGACCGGGCGATTCCCAAACCCGACCACCGCTTCC
AAGAACGGTAAGAAGGAGCGACAGGGATACAAGTCCTGGCGTGGACATAAAAA
CGCTATCATCTCCTGCTTGCATGAATGCGGGGGCAACATATCCTTCACCCGGCGA
TACCTGCTCTTCCACCACGGTGTGAACTTCCCCCGCAATATCTTGCATTACTACC
GTCACCTCCACAGCCCCTACTGCAGTCAGCAAGTCCCGGCAACCCCGACAGAAA
AAGACAGCAGCGACAACGGTGACCAGAAACCAGCAGTTAGAAAATCCACAAC
AAGTGCAACAGGAGGAGGACTGAGGATCACAGCGAACGAGCCAGCGCAGACCA
GAGAGCTGAGGAACCGGATCTTTCCAACCCTCTATGCCATCTTCCAGCAGAGTC
GGGGGCAAGAGCAGGAATTGAAAGTAAAAAACCGATCTCTGCGCTCGCTCACCA
GAAGTTGTTTGTATCACAAGAGCGAAGACCAACTTCAGCGCACTCTCGAGGACG
CCGAGGCTCTCTTCAACAAGTACTGCGCGCTGACTCTTAAAGAGTAGCCCTTGCC
CGCGCTCATTCGAAAACGGCGGGAATCACGTCACCCTTGGCACCTGTCCTTTGCC
CTCGTCATGAGTAAAGAGATTCCCACGCCTTACATGTGGAGCTATCAGCCCCAA
ATGGGGTTGGCAGCAGGTGCTTCCCAGGACTACTCCACCCGCATGAATTGGCTT
AGCGCCGGGCCCTCAATGATATCACGGGTTAATGATATACGAGCTTATCGAAAC
CAGTTACTCCTAGAACAGTCAGCTCTCACCACCACACCCCGCCAACACCTTAATC
CCCGAAATTGGCCCGCCGCCCTGGTGTACCAGGAAAATCCCGCTCCCACCACCG
TACTACTTCCTCGAGACGCCCAGGCCGAAGTTCAGATGACTAACGCAGGTGTAC
AGCTGGCGGGCGGTTCCGCCCTATGTCGTCACCGACCTCAACAGAGTATAAAAC
GCCTGGTGATCAGAGGCCGAGGTATCCAGCTCAACGACGAATCGGTTAGCTCTT
CGCTTGGTCTGCGACCAGACGGAGTCTTCCAGATCGCCGGCTGTGGGAGATCTTC
CTTCACTCCTCGTCAGGCTGTGCTGACTTTGGAGAGTTCGTCCTCGCAGCCCCGC
TCGGGCGGCATCGGAACTCTCCAGTTTGTGGAGGAGTTTACTCCCTCTGTCTACT
TCAACCCCTTCTCCGGCTCTCCTGGCCAGTACCCGGACGAGTTCATACCGAACTT
CGACGCAATCAGCGAGTCAGTGGATGGCTATGATTGATGTCTAATGGTGGCGCG
GCTGAGCTAGCTCGACTGCGACACCTAGACCACTGCCGCCGCTTTCGCTGTTTCG
CCCGGGAACTCACCGAGTTCATCTACTTCGAACTCTCCGAGGAGCACCCTCAGG
GTCCGGCCCACGGAGTGCGGATTACCATCGAAGGGGGAATAGACTCTCGCCTGC
ATCGAATCTTCTCCCAGCGACCCGTGCTGATTGAGCGCGACCAGGGAAATACAA
CCATCTCCATCTACTGCATCTGTAACCACCCCGGATTGCATGAAAGCCTTTGCTG
TCTTGTTTGTGCTGAGTTTAATAAAAACTGAGTTAAGACCCTCCTACGGACTACC
GCTTCTTCAATCAGGACTTTACAACACCAACCAGATCTTCCAGAAGACCCAGAC
CCTTCCTCCTCTGATCCAGGACTCTAACTCTACCTTACCAGCACCATCCACTACT
AACCTTCCCGAAACTAACAAGCTTGGATCTCATCTGCAACACCGCCTTTCACGAA
GCCTTCTTTCTGCCAATACTACCACTCCCAAAACCGGAGGTGAGCTCCGCGGTCT
CCCTACTGACGACCCCTGGGTGGTAGCGGGTTTTGTAACATTAGGAGTAGTTGCG
GGTGGGCTTGTGCTGATCCTTTGCTACCTATACACACCTTGCTGTGCATATTTAGT
CATATTGCGCTGTTGGTTTAAAAAATGGGGGCCATACTAGTCGTGCTTGCTTTAC
TTTCGCTTTTGGGTCTGGGCTCTGCTAATCTCAATCCTCTTGATCACGATCCATGT
CTAGACTTCGACCCAGAAAACTGCACACTTACTTTTGCACCCGACACAAGCCGTC
TCTGTGGAGTTCTTATTAAGTGCGGATGGGACTGCAGATCCGTTGAAATTACACA
TAATAACAAAACATGGAACAATACCTTATCCACCACATGGGAGCCAGGAGTTCC
CGAGTGGTATACTGTCTCTGTCCGAGGTCCTGACGGTTCCATCCGCATTAGTAAC
AACACTTTTATTTTTTCTGAAATGTGCGATCTGGCCATGTTCATGAGCAGACAGT
ATGACCTATGGCCTCCCAGCAAAGAGAACATTGTGGCATTTTCCATTGCTTATTG
CTTGGTAACATGCATCATCACTGCTATCATTTGTGTGTGCATACACTTGCTTATA
GTTATTCGCCCTAGACAAAGCAATAAGGAAAAAGAGAAATGCCTTAACCTTTT
TACTCATACCTTTTCTTTACAGCATGGCTTCTGTTACAGCTCTAATTATTGCCAGC
ATTGTCACTGTCGCTCACGGGCAAACAATTGTCCATATTACCTTAGGACATAATC
ACACCCTTGTAGGGCCCCCAATTACTTCAGAGGTTATTTGGACCAAACTTGGAAG

TABLE 7-continued

Nucleic Acid Sequences of Vectors

| SEQ ID NO | Sequence |
|---|---|
| | TGTTGATTATTTTGATATAATTTGCAACAAAACTAAACCAATATTTGTAATCTGC<br>AACAGACAAAATCTCACGTTAATTAATGTCAGCAAAATTTATAACGGTTACTATT<br>ATGGTTATGACAGATCCAGTAGTCAATATAAAAATTACTTAGTTCGCATAACTCA<br>GCCCAAATCAACAGTGCCAACTATGACAATAATTAAAATGGCTAATAAAGCATT<br>AGAAAATTTTACATTACCAACAACGCCCAATGAAAAAAACATTCCAAATTCAAT<br>GATTGCAATTATTGTGGCGGTGGCATTGGGAATGGCACTAATAATAATATGCAT<br>GTTCCTATATGCTTGTTGCTATAAAAAGTTTCAACATAAACAGGATCCACTACTA<br>AATTTTAACATTTAATTTTTTATACAGATGATTTCCACTACAATTTTTATCATTAC<br>TAGCCTTGCAGCTGTAACTTATGGCCGTTCACACCTAACTGTACCTGTTGGCTCA<br>ACATGTACACTACAAGGACCCCAACAAGGCTATGTCACTTGGTGGAGAATATAT<br>GATAATGGAGGGTTCGCTAGACCATGTGATCAGCCTGGTACAAAATTTTCATGC<br>AACGGAAAAGACTTGACCATAATTAACATAACATCAAATGAGCAAGGCTTCTAT<br>TATGGAACCAACTATAAAGATAGTTTAGATTACAACATTATTGTAGTGCCAGCC<br>ACCACTTCTGCTCCCCGCAAATCCACTTTCTCTAGCAGCAGTGCCAAAGCAAGCA<br>CAATTCCTAAAACAGCTTCTGCTATGTTAAAGCTTCAAAAAATCGCTTTAAGTAA<br>TTCCACAGCCGCTCCCAATACAATTCCTAAATCAACAATTGGCATCATTACTGCT<br>GTGGTAGTGGGATTAATTATTATGTTTTTGTGCATAATGTACTACGTCTGCTGCT<br>ATAGAAAACATGAACAAAAAGGTGATGCATTACTAAATTTTGACATTTAATTTTT<br>TATAGAATTATGATATTGTTTCAATCAAATACCACTAACACTATCAATGTGCAGA<br>CTACTTTAAATCATGACATGGAAAACCACACTACCTCCTATGCATACACAAACAT<br>TCAGCCTAAATACGCTATGCAACTAGAAATCACCATACTAATTGTAATTGGAATT<br>CTTATACTATCTGTTATTCTTTATTTTATATTCTGCCGTCAAATACCCAATGTTCA<br>TAGAAATTCTAAAAGACGTCCCATCTATTCTCCTATGATTAGTCGTCCCCATATG<br>GCTCTGAATGAAATCTAAGATCTTTTTTTTTCTCTTACAGTATGGTGAACACCAA<br>TCATGATCCCTAGAAATTTCTTCTTCACCATACTCATCTGTGCTTTCAATGTCTGT<br>GCTACTTTCACAGCAGTAGCCACTGCAAGCCCAGACTGTATAGGACCATTTGCTT<br>CCTATGCACTTTTTGCCTTCGTTACTTGCATCTGCGTGTGTAGCATAGTCTGTCTG<br>GTTATTAATTTTTTCCAACTGGTAGACTGGATCTTTGTACGAATTGCCTACCTACG<br>TCACCATCCCGAATACCGCAATCAAAATGTTGCGGCACTTCTTAGGCTTATTTAA<br>AACCATGCAGGCTATGCTACCAGTCATTTTAATTCTGCTACTACCCTGCATTGCC<br>CTAGCTTCCACCGCCACTCGCGCTACACCTGAACAACTTAGAAAATGCAAATTTC<br>AACAACCATGGTCATTTCTTGATTGCTACCATGAAAAATCTGATTTTCCCACATA<br>CTGGATAGTGATTGTTGGAATAATTAACATACTTTCATGTACCTTTTTCTCAATCA<br>CAATATACCCCACATTTAATTTTGGGTGGAATTCTCCCAATGCACTGGGTTACCC<br>ACAAGAACCAGATGAACATATCCCACTACACCACATACAACAACCACTAGCACT<br>GGTAGAGTATGAAAATGAGCCACAACCTTCACTGCCTCCTGCCATTAGTTACTTC<br>AACCTAACCGGCGGAGATGACTGAAATACTCACCACCTCCAATTCCGCCGAGGA<br>TCTGCTTGATATGGACGGCCGCGCCTCAGAACAGCGACTCGCCAACTACGCAT<br>ACGCCAGCAGCAGGAACGTGCCGCCAAGGAGCTCAGGGATGCTATTGAAATTCA<br>CCAATGCAAAAAAGGCATATTTTGTTTGGTAAAACAAGCCAAGATATCCTACGA<br>GATTACCAATACTGACCATCGCCTCTCATACGAGCTCGGACCGCAGCGGCAAAA<br>ATTCACTTGTATGGTGGGAATCAACCCCATAATCATCACCCAGCAAGCTGGAGA<br>TACCAAGGGTTGCATCCACTGTTCCTGCAGTTCCACCGAGTGCATCTACACCCTG<br>CTGAAGACCCTCTGCGGCCTTCGAGACCTCCTACCCATGAACTAATCAACCCAGC<br>CCCTCACTTACCAATTACATAAAGCCAATAAAAACACTTACTTGAAATCAGAAA<br>TAAGGTTTCTGTCTACGTTGTTTCCAAGCAGCACCTCACTTCCCTCTTCCCAACTC<br>TGGTACTCTAAGCCTCGGCGGGTGGCATACTTCCTCCACACTTTGAAAGGGATGT<br>CAAATTTTAGTTCCTCTTCTTTGCCCACAATCTTCATTTCTTTATCCCCAGATGGC<br>CAAACGAGCTCGGCTAAGCAGCTCCTTCAATCCGGTCTACCCCTATGAAGATGA<br>AAGCAGCTCACAACACCCCTTTATAAACCCTGGTTTCATTTCCTCAAATGGTTTT<br>GCACAAAGCCCAGATGGAGTTCTAACTCTTAAATGTGTTAATCCGCTCACTACCG<br>CCAGCGGACCCCTCCAACTTAAAGTTGGAAGCAGTCTTACAGTAGATACTATCG<br>ATGGGTCTTTGGAGGAAAATATAACTGCCGCAGCGCCACTCACTAAAACTAACC<br>ACTCCATAGGTTTATCAATAGGATCTGGCTTACAAACAAAGGATGATAAACTTT<br>GTTTATCGCTGGGAGATGGGTTGGTAACAAAGGATGATAAACTATGTTTATCGCT<br>GGGAGATGGGTTAATAACAAAAAATGATGTACTATGTGCCAAACTAGGACATGG<br>TCTTGTGTTTGACTCTTCCAATGCTATCACCATAGAAAACAACACCTTGTGGACA<br>GGCGCAAAACCAAGCGCCAACTGTGTAATTAAAGAGGGAGAAGATTCCCCAGA<br>CTGTAAGCTCACTTTAGTTCTAGTTAAGAATGGAGGACTGATAAATGGATACAT<br>AACATTAATGGGAGCCTCAGAATATACTAACACCTTGTTTAAAAACAATCAAGT<br>TACAATCGATGTAAACCTCGCATTTGATAATACTGGCCAAATTATCACTTACCTA<br>TCATCCCTTAAAAGTAACCTGAACTTTAAAGACAACCAAAACATGACTACTGGA<br>ACCATAACCAGTGCCAAAGGCTTCATGCCCAGCACCACCGCCTATCCATTTATAA<br>CATACGCCACTGAGACCCTAAATGAAGATTACATTTATGGAGAGTGTTACTACA<br>AATCTACCAATGGAACTCTCTTTCCACTAAAAGTTACTGTCACACTAAACAGACG<br>TATGTCAGCTTCTGGAATGGCCTATGCTATGAATTTTTCATGGTCTCTAAATGCA<br>GAGGAAGCCCCGGAAACTACCGAAGTCACTCTCATTACCTCCCCCTTCTTTTTTT<br>CTTATATCAGAGAAGATGACTGACAACAAAAAAAAATAAAGATCAACTTTTTT<br>ATTGAAAATCAGTTTACAAGATTCGAGTAGTTATTTTGCCCCCCTCTTCCCATTTT<br>ATAGAATACACAATTCTCTCCCCACGCACAGCTTTGAACATTTGAATTCCATTAG<br>AGATAGACATAGTTTTAGATTCCACATTCCACACAGTTTCAGAGCGGGCCAATCT<br>TGGATCAGTGATAGATATAAATCCATCGGAACAGTCTTTCAAGGTGG |
| SEQ ID<br>NO: 1437 | CATCATCAATAATATACCCCACAAAGTAAACAAAAGTTAATATGCAAATGAGCT<br>TTTGAATTTAGGGCGGGGCCGTCGCTGATTGGACGAGAGAAGACGATGCAAATG<br>ACGTCACGACGCACGGCTAACGGTCGCCGCGGAGGCGTGGCCTAGGCCGGAAG |

TABLE 7-continued

Nucleic Acid Sequences of Vectors

SEQ ID NO Sequence

CAAGTCGCGGGGCTGATGACGTATAAAAAAGCGGACTTTAGACCCGGAAACGG
CCGATTTTCCCGCGGCCACGCCCGGATATGAGGTAATTCTGGGCGGATGCAAGT
GAAATTAGGCCATTTTGGCGCGAAAACTGAATGAGGAAGTGAAAAGTGAAAAA
TACCGGGCCCGCCCAGGGCGGAATATTTACCGAGGGCCGAGAGACTTTGACCGA
TTACGTGGGGGTTTCGATTGCGGTGTTTTTTCGCGAATATCCGCGTCCGTGTCAA
AGTCCGGTGTTTATGTCACAGATCAGCTGATCCACAGGGTATTTAAACCAGTCGA
GCCCGTCAAGAGGCCACTCTTGAGTGCCAGCGAGTAGAGATTTCTCTGAGCTCC
GCTCCCAGAGTCTGAGAAAAATGAGACACCTGCGCCTTCTACCTTCAACTGTGCC
CGGTGAGCTGGCTGTGCTTATGCTGGAGGACTTTGTGGATACAGTATTGGAGGA
TGAACTGCATCCAAGTCCGTTCGAGCTGGGACCCACACTTCAGGACCTCTATGAT
CTGGAGGTAGATGCCCATGATGACGACCCTAACGAAGAGGCTGTGAATTTAATA
TTTCCAGAATCTATGATTCTCCAGGCTGACATAGCCAGCGAAGCTATAGTTACTC
CACTTCATACCCCGACTCTGCCACCAATACCTGAATTGGAAGAGGAGGACGAGA
TAGACCTCCGGTGCTACGAGGAAGGTTTTCCTCCCAGCGATTCAGAGGACGAAC
AGGGTGAGCGAGAGATGGCTATTCTATCGGACTTTGCTTGTGTGATTGTGGAGG
AGCAAGATGTGATTGAAAAATCTACCGAGCCAGTACAAGGCTGTAGAAACTGCC
AATACCACCGGGATAAGTCCGGAGATCCAAACGCCTCCTGCGCTCTGTGCTATA
TGAAACAGACTTTCAGCTTTATTTACAGTAAGTGGAGTGAATGTGAGAGAGGTT
GAGTGCTTAACACATAACTGTGTAATGCTTGAACAGCTGTGCTAAGTGTGGTTTA
TTTTGTTACTAGGTCCGGTGTCAGAGGATGAGTCATCGCCCTCAGAAGAAGACC
ACCCGTCTCCCCCTGAGCTGTCAGGCGAAACGCCCCTGCAAGTGCACAGACCCA
CCCCAGTCAGACCCAGTGGCGAGAGGCGAGCAGCTGTTGAAAAAATTGAGGACT
TGTTGCATGACATGGGTGGGGATGAACCTTTGGACCTGAGCTTGAAACGCCCCA
GGAACTAGGCGCAGATGCGCTTAGTCATGTGTAAATAAAGTTGTACAATAAAAG
TATATGTGACGCATGCAAGGTGTGGTTTATGACTCATGGGCGGGGCTTAGTCCTA
TATAAGTGGTAACACCTGGGCACTCAGGCACAGACCTTCAGGGAGCTCCTGATG
GAGGTGTGGACTATCCTTGCGGACTTTAACAAGACACGCCGGCTTGTAGAGGAT
AGTTCAGACGGGTGCTCCGGTTTCTGGAGACACTGGTTTGGAACTCCTCTAGCTC
GCCTGGTGTACACTGTTAAGAAGGATTATCAGGACGAATTTGAAAATCTTTTTGC
TGACTGTTCTGGCCTTCTTGATTCACTGAATCTCGGCCACCAGGCTCTATTCCAG
GAAAGGGTCCTCCACAGCCTTGATTTTTCCAGCCCAGGGCGCACTACAGCCGGT
GTTGCTTTTGTGGTGTTTCTGGTTGACAAATGGAGCCAGCAAACCCACCTAACCA
GGGATTACATCCTGGACTTCACGGCCATGCACCTGTGGAAGGCCTGGGTCAGGC
AGCGGGGACAGAGAATCTTGAACTACTGGCTTCTACAGCCAGCAGCTCCGGGTC
TTCTTCGTCTACACAGACAAACATCCATGTTGGAGGAAGAAATGAGGCAGGCCA
TGGACGAGAACCCGAGGAGCGGTCTGGACCCTCCGTCGGAAGAGGAGCTGGATT
GAATCAGGTATCCAGCCTCTATCCAGAGCTTAGCAAGGTGCTGACATCCATGGC
CAGGGGAGTGAAGAGGGAGAGGAGCGATGGGGGCAATACCGGGATGATGACCG
AGCTGACGCCAGCCTGATGAATCGCAAGCGTCCAGAGCGCATTACCTGGCACG
AGCTACAGATGGAGTGCAGGGATGAGGTGGGCCTGATGCAGGATAAATATGGC
CTGGAGCAGATAAAAACCCATTGGTTGAACCCAGATGAGGATTGGGAGGAGGC
CATTAAGAAATATGCCAAGATAGCCCTGCGCCCAGATTGCAAGTACAGGGTGAC
CAAGACGGTGAATATCAGACATGCCTGCTACATCTCGGGTAACGGGGCAGAGGT
GGTCATCGATACCCTGGACAAGGCCGCCTTCAGGTGTTGCATGATGGGAATGAG
AGCAGGAGTGATGAATATGAATTCCATGATCTTCATGAACATGAAGTTCAATGG
AGAGAAGTTTAATGGGGTGATGTTCATGGCCAACAGCCACATGACCCTGCATGG
CTGCAGTTTCTTTGGCTTCAACAATATGTGCGCAGAGGTCTGGGGCGCTGCTAAG
ATCAGGGGATGTAAGTTTTATGGCTGCTGGATGGGCGTGGTCGGAAGACCCAAG
AGCGAGATGTCTGTGAAGCAGTGTGTGTTTGAGAAATGCTACCTGGGAGTCTCT
ACCGAGGGCAATGCTAGAGTAAGACACTGCTCTTCCCTGGAGACGGGCTGCTTC
TGCCTGGTGAAGGGCACAGCCTCTCTGAAGCATAATATGGTGAAGGGCTGCACG
GATGAGCGCATGTACAACATGCTGACCTGCGACTCGGGGGTCTGCCATATCCTG
AAGAACATCCATGTGACCTCCCACCCCAGAAAGAAGTGGCCAGTGTTTGAGAAT
AACCTGCTGATCAAGTGCCATATGCACCTGGGCGCCAGAAGGGGCACCTTCCAG
CCGTACCAGTGCAACCTTAGCCAGACCAAGCTGCTGTTGGAGAACGATGCCTTC
TCCAGGGTGAACCTGAACGGCATCTTTGACATGGATGTCTCGGTGTACAAGATC
CTGAGATACGATGAGACCAAGTCCAGGGTGCGCGCTTGCGAGTGCGGGGCAG
ACACACCAGGATGCAGCCAGTGGCCCTGGATGTGACCGAGGAGCTGAGACCAG
ACCACCTGGTGATGGCCTGTACCGGGACCGAGTTCAGCTCCAGTGGGGAGGACA
CAGATTAGAGGTAGGTTGAGTGAGTAGTGGGCGTGGCTAAGGTGACTATAAAGG
CGGGTGTCTTACGAGGGTCTTTTTGCTTTTCTGCAGACATCATGAACGGGACCGG
CGGGGCCTTCGAAGGGGGCTTTTCAGCCCTTATTTGACAACCCGCCTGCCGGG
ATGGGCCGGAGTTCGTCAGAATGTGATGGGATCGACGGTGGACGGGCGCCCAGT
GCTTCCAGCAAATTCCTCGACCATGACCTATGCGACCGTGGGGAGCTCGTCGCTC
GACAGCACCGCCGCAGCCGCGGCAGCCGCAGCCGCCATGACAGCGACGAGACT
GGCCTCGAGCTACATGCCCAGCAGCAGCAGTAGCCCCTCTGTGCCCAGTTCCATC
ATCGCCGAGGAGAAACTGCTGGCCCTGCTGGCCGAGCTGGAAGCTCTGAGCCGC
CAGCTGGCCGCCCTGACCCAGCAGGTGTCCGAGCTCCGCGAACAGCAGCAGCAG
CAAAATAAATGATTCAATAAACACAGATTCTGATTCAAACAGCAAAGCATCTTT
ATTATTTATTTTTTCGCGCGCGGTAGGCCCTGGTCCACCTCTCCCGATCATTGAG
AGTGCGGTGGATTTTTTCCAGGACCCGGTAGAGGTGGGATTGGATGTTGAGGTA
CATGGGCATGAGCCCGTCCCGGGGGTGGAGGTAGCACCACTGCATGGCCTCGTG
CTCTGGGGTCGTGTTGTAGATGATCCAGTCATAGCAGGGGCGCTGGGCGTGGTG
CTGGATGATGTCCTTGAGGAGGAGACTGATGGCCACGGGAGCCCCTTGGTGTA
GGTGTTGGCGAAGCGGTTGAGCTGGGAGGGATGCATGCGGGGGGAGATGATGT
GTAGTTTGGCCTGGATCTTGAGGTTGGCGATGTTGCCACCCAGATCCCGCCGTGG

TABLE 7-continued

Nucleic Acid Sequences of Vectors

SEQ ID NO Sequence

GTTCATGTTGTGCAGGACCACCAGAACGGTGTAGCCCGTGCACTTGGGGAACTT
GTCATGCAACTTGGAAGGGAATGCGTGGAAGAATTTGGAGACGCCCTTGTGCCC
ACCCAGGTTTTCCATGCACTCATCCATGATGATGGCGATGGGCCCGTGGGCTGCG
GCTTTGGCAAAGACGTTTCTGGGGTCAGAGACATCGTAATTATGCTCCTGGGTGA
GATCATCATAAGACATTTTAATGAACTTGGGGCGGAGGGTGCCAGATTGTGGGA
CGATGGTTCCCTCGGGCCCCGGGGCAAAGTTCCCCTCGCAGATCTGCATCTCCCA
GGCTTTCATCTCGGAGGGGGGATCATGTCCACCTGCGGGGCGATGAAAAAAAC
GGTTTCCGGGGCGGGGGTGATGAGCTGCGAGGAGAGCAGGTTTCTCAACAGCTG
GGACTTGCCGCACCCGGTCGGGCCGTAGATGACCCCGATGACGGGTTGCAGGTG
GTAGTTCAAGGAGATGCAGCTGCCGTCGTCCCGGAGGAGGGGGGCCACCTCGTT
GAGCATGTCCCTGACTTGGAGGTTTTCCCGGACGAGCTCGCCGAGGAGGCGGTC
CCCGCCCAGCGAGAGCAGCTCTTGCAGGGAAGCAAAGTTTTTCAGGGGCTTGAG
CCCGTCGGCCATGGGCATCTTGGCGAGGGTCTGCGAGAGGAGCTGGAGGCGGTC
CCATAGCTCGGTGACGTGCTCTACGGCATCTCGATCCAGCAGACTTCCTCGTTTC
GGGGGTTGGGACGACTGCGACTGTAGGGCACGAGACGATGGGCGTCCAGCGCT
GCCAGCGTCATGTCCTTCCAGGGTCTCAGGGTCCGCGTGAGCGTGGTCTCCGTCA
CGGTGAAGGGGTGGGCCCCGGGCTGGGCGCTTGCAAGGGTGCGCTTGAGACTCA
TCCTGCTGGTGCTGAAACGGGCACGGTCTTCGCCCTGCGCGTCGGCGAGATAGC
AGTTGACCATGAGCTCGTAGTTGAGGGCCTCGGCGGCGTGGCCCTTGGCACGGA
GCTTGCCCTTGGAAGAGCGCCCGCAGGCGGGACAGAGGAGGGATTGCAGGGCG
TAGAGCTTGGGTGCGAGAAAGACGGACTCGGGGGCGAAAGCATCCGCTCCGCA
GTGGGCGCAGACGGTCTCGCACTCCACGAGCCAGGTGAGCTCGGGCTGCTCGGG
GTCAAAAACCAGTTTTCCCCCGTTCTTTTTGATGCGCTTCTTACCTCGCGTCTCCA
TGAGTCTGTGTCCGCGCTCGGTGACAAACAGGCTGTCTGTGTCCCCGTAGACGGG
ACTTGATGGGCCTGTCCTGCAGGGGCGTCCCGCGGTCCTCCTCGTAGAGAAACTC
GGACCACTCTGAGACGAAGGCGCGCGTCCACGCCAAGACAAAGGAGGCCACGT
GCGAGGGGTAGCGGTCGTTGTCCACCAGGGGGTCCACCTTTTCCACCGTGTGCA
GACACATGTCCCCCTCCTCCGCATCCAAGAAGGTGATTGGCTTGTAGGTGTAGGC
CACGTGACCGGGGGTCCCCGACGGGGGGGTATAAAAGGGGGCGGGTCTGTGTTC
GTCCTCACTCTCTTCCGCGTCGCTGTCCACGAGCGCCAGCTGTTGGGGTAGGTAT
TCCCTCTCAAGAGCGGGCATGACCTCGGCACTCAGGTTGTCAGTTTCTAGAAACG
AGGAGGATTTGATATTGGCCTGCCCTGCCGCGATGCTTTTTAGGAGACTTTCATC
CATCTGGTCAGAAAAGACTATTTTTTTATTGTCAAGCTTGGTGGCGAAGGAGCCA
TAGAGGGCGTTTGAGAGAAGCTTGGCGATGGATCTCATGGTCTGATTTTTGTCAC
GGTCGGCGCGCTCCTTGGCCGCGATGTTGAGCTGGACATACTCGCGCGCGACGC
ACTTCCATTCGGGGAAGACGGTGGTGCGCTCGTCGGGCACGATCCTGACGCGCC
AGCCGCGGTTATGCAGGGTGACCAGGTCCACACTGGTGGCCACCTCGCCGCGCA
GGGGCTCGTTGGTCCAGCAGAGTCTGCCGCCCTTGCGCGAGCAGAAAGGGGGCA
GCACATCCAGGAGGTGCTCGTCAGGGGGGTCCGCATCGATGGTGAAGATGCCCG
GACAGAGTTCCTTGTCAAAATAGTCTATTTTTGAGGATGCATCATCCAAGGCCAT
CTGCCACTCGCGGGCGGCCATTGCTCGCTCGTAGGGGTTGAGTGGCGGACCCCA
GGGCATGGGATGCGTGAGCGCGGAGGCGTACATGCCGCAGATGTCATAGACATA
GATGGGCTCCGAGAGGATGCCGATGTAGGTGGGATAACAGCGCCCCCCGCGGAT
GCTGGCGCGCACATAGTCATACAACTCGTGCGAGGGGCCAAGAATGCGGGACC
GAGATTGGTGCGCTGGGGCTGCTCGGCGCGGAAGACGATCTGGCGAAAGATGGC
ATGCGAGTTTGAGGAGATGGTGGGCCGTTGGAAGATGTTAAAGTGGGCGTGCGG
CAGTCGGACCGAGTCGCGGATGAAGTGCGCGTAGGAGTCTTGCAGCTTGGCGAC
GAGCTCGGCGGTGACAAGGACGTCCATGGCGCAGTAGTCCAGCGTTTCGCGGAT
GATGTCATAACCCGTCTCTCCTTTCTTCTCCCACAGCTCGCGGTTGAGGGCGTAC
TCCTCGTCATCCTTCCAGTACTCCCGGAGCGGAAATCCTCGATCGTCCGCACGGT
AAGAGCCCAGCATGTAGAAATGGTTCACGGCCTTGTAGGGACAGCAGCCCTTCT
CCACGGGGAGGGCGTAAGCTTGAGCGGCCTTGCGGAGCGAGGTGTGCGTCAGG
GCGAAGGTGTCCCTGACCATGACTTTCAAGAACTGGTACTTGAAGTCCGAGTCG
TCGCAGCCGCCGTGCTCCCAGAGCTCGAAATCGGTGCGCTTCTTCGAGAGGGGG
TTAGGCAGAGCGAAAGTGACGTCATTGAAGAGAATCTTGCCTGCTCGCGGCATG
AAATTGCGGGTGATGCGGAAAGGGCCCGGGACGGAGGCTCGGTTGTTGATGACC
TGGGCGGCGAGGACGATCTCGTCGAAGCCGTTGATGTTGTGCCCGACGATGTAG
AGTTCCATGAATCGCGGGCGGCCTTTGATGTGCGGCAGCTTTTTGAGCTCCTCGT
AGGTGAGGTCCTCGGGGCATTGCAGGCCGTGCTGCTCTAGCGCCCACTCCTGGA
GATGTGGGTTGACCTGCATGAAGGAAGCCCAGAGCTCGCGGGCCATGAGGGTCT
GGAGCTCGTCGCGAAAGAGGCGGAACTGCTGGCCCACGGCCATCTTTTCAGGGG
TGACGCAGTAGAAGGTGAGGGGGTCCCGCTCCCAGCGATCCCAGCGTAAGCGCA
CGGCTAGATCGCGAGCGAGGGCGACCAGCTCGGGGTCCCCCGAGAATTTCATGA
CCAGCATGAAGGGGACGAGCTGCTTGCCGAAGGACCCCATCCAGGTGTAGGTTT
CTACATCGTAGGTGACAAAGAGCCGCTCCGTGCGAGGATGAGAGCCGATTGGGA
AGAACTGGATTTCCTGCCACCAGTTGGACGAGTGGCTGTTGATGTGATGAAAGT
AGAAATCCCGCCGGCGAACCGAGCACTCGTGCTGATGCTTGTAAAAGCGTCCGC
AGTACTCGCAGCGCTGCACGGGCTGTACCTCATCCACGAGATACACAGCGCGTC
CCTTGAGGAGGAACTTCAGGAGTGGCGGCCCTGGCTGGTGGTTTTCATGTTCGCC
TGCGTGGGACTCACCCTGGGCTCCTCGAGGACGGAGAGGCTGACGAGCCCGCG
CGGGAGCCAGGTCCAGATATCGGCGCGGCGGGGCGGAGAGCGAAGACGGGCA
GCGCAGTTGGGAGCTGTCCATGGTGTCGCGGAGATCCAGGTCCGGGGGCAGGG
TTCTGAGGTTGACCTCGTAGAGGCGGGTGAGGGCGTGCTTGAGATGCAGATGGT
ACTTGATTTCTACGGGTGAGTTGGTGGCCGTGTCCACGCATTGCATGAGCCCGTA
GCTGCGCGGGGCCACGACCGTGCCGCGGTGCGTTTTAGAAGCGGTGTCGCGGA
CGCGCTCCCGGCGGCAGCGGCGGTTCCGGCCCCGCGGGCAGGGGCGGCAGAGG

TABLE 7-continued

Nucleic Acid Sequences of Vectors

SEQ ID NO Sequence

CACGTCGGCGTGGCGCTCGGGCAGGTCCCGGTGCTGCGCCCTGAGAGCGCTGGC
GTGCGCGACGACGCGGCGGTTGACATCCTGGATCTGCCGCCTCTGTGTGAAGAC
CACTGGCCCCGTGACTTTGAACCTGAAAGACAGTTCAACAGAATCAATCTCGGC
GTCATTGACGGCGGCCTGACGCAGGATCTCTTGCACGTCGCCCGAGTTGTCCTGG
TAGGCGATCTCGGACATGAACTGCTCGATCTCCTCCTCCTGGAGATCGCCGCGGC
CTGCGCGCTCGACGGTGGCGGCGAGGTCATTGGAGATGCGACCCATGAGCTGCG
AGAAGGCGCCCAGGCCGCTTTCGTTCCAGACGCGGCTGTAGACCACGTCCCCGT
CGGCGTCGCGTGCGCGCATGACCACCTGCGCGAGGTTGAGCTCCACGTGCCGCG
CGAAGACGCGTAGTTGCGCAGGCGCTGGAAGAGGTAGTTGAGGGTGGTGGCG
ATGTGCTCGGTGACGAAGAAGTACATGATCCAGCGGCGCAGGGGCATCTCGCTG
ATGTCGCCGATGGCCTCCAGCCTTTCCATGGCCTCGTAGAAATCCACGGCGAAGT
TGAAAAACTGGGCGTTGCGGGCCGAGACCGTGAGCTCGTCTTCCAGGAGCCGGA
TGAGCTCGGCGATGGTGGCGCGCACCTCGCGCTCGAAATCCCCGGGGGCCTCCT
CCTCTTCCTCTTCTTCCATGACGACCTCTTCTTCTATTTCTTCCTCTGGGGCGGT
GGTGGTGGCGGGCCCGACGACGACGGCGACGCACCGGGAGACGGTCGACGAA
GCGCTCGATCATCTCCCCGCGGCGGCGACGCATGGTTTCGGTGACGGCGCGACC
CCGTTCGCGAGGACGCAGCGTGAAGACGCCGCCGGTCATCTCCCGGTAATGGGG
CGGGTCCCCGTTGGGCAGCGAGAGGGCGCTGACGATGCATCTTATCAATTGCGG
TGTAGGGGACGTGAGCGCGTCGAGATCGACCGGATCGGAGAATCTTTCGAGGAA
AGCGTCTAGCCAATCGCAGTCGCAAGGTAAGCTCAAACACGTAGCAGCCCTGTG
GACGCTGTTAGAATTGCGGTTGCTGATGATGTAATTGAAGTAGGCGTTTTTGAGG
CGGCGGATGGTGGCGAGGAGGACCAGGTCCTTGGGTCCCGCTTGCTGGATGCGG
AGCCGCTCGGCCATGCCCCAGGCCTGGCCCTGACACCGGCTCAGGTTCTTGTAGT
AGTCATGCATGAGTCTCTCAATGTCATCACTGGCGGAGGCGGAGTCTTCCATGCG
GGTGACCCCGACGCCCTGAGCGGCTGCACGAGCGCCAGGTCGGCGACGACGCG
CTCGGCGAGGATGGCCTGTTGCACGCGGGTGAGGGTGTCCTGGAAGTCGTCCAT
GTCGACGAAGCGGTGGTAGGCCCCTGTGTTGATGGTGTAAGTGCAGTTGGCCAT
GAGCGACCAGTTGACGGTCTGCAGGCCGGGTTGCACGACCTCCGAGTACCTGAG
CCGCGAGAAGGCGCGCGAGTCGAAGACGTAGTCGTTGCAGGTGCGCACGAGGT
ACTGGTATCCGACTAGGAAGTGCGGCGGCGGCTGGCGATAGAGCGGCCAGCGCT
GGGTGGCCGGCGCGCCCGGCGCCAGGTCCTCCAGCATGAGGCGGTGGTAGCCGT
AGAGGTAGCGGGACATCCAGGTGATGCCGGCGGCGGTGGTGGAGGCGCGCGGG
AACTCGCGGACGCGGTTCCAGATGTTGCGCAGCGGCAGGAAATAATCCATGGTC
GGCACGGTCTGGCCGGTGAGACGCGCGCAGTCATTGACGCTCTAGAGGCAAAAA
CGAAAGCGGTTGAGCGGGCTCTTCCTCCGTAGCCTGGCGGAACGCAAACGGGTT
AGGCCGCGTGTGTACCCCGGTTCGAGTCCCCTCGAATCAGGCTGGAGCCGCGAC
TAACGTGGTATTGGCACTCCCGTCTCGACCCGAGCCCGATAGCCGCCAGGATAC
GGCCGGAGAGCCCTTTTTGCCGGCCGAGGGGGGTCGCTAGACTTGAAAGCGGCCG
AAAACCCCGCCGGGTAGTGGCTCGCGCCCGTAGTCTGGAGAAGCATCGCCAGGG
TTGAGTCGCGGCAGAACCCGGTTCGAGGACGGCCGCGGCGAGCGGGACTTGGTC
ACCCCGCCGATTTAAAGACCCACAGCCAGCCGACTTCTCCAGTTACGGGAGCGA
GCCCCCTTTTTCTTTTTGCCAGATGCATCCCGTCCTGCGCCAAATGCGTCCCACC
CCCCCGGCGACCACCGCGACCGCGGCCGTAGCAGGCACCGGCGCTAGCCAGCCA
CAGCCACAGACAGAGATGGACTTGGAAGAGGGCGAAGGGCTGGCGAGACTGGG
GGCGCCGTCCCCGGAGCGACACCCCCGCGTGCAGCTGCAGAAGGACGTGCGCCC
GGCGTACGTGCCTCCGCAGAACCTGTTCAGGGACCGCAGCGGGGAGGAGCCCGA
GGAGATGCGCGACTGCCGGTTTCGGGCGGGCAGGGAGCTGCGCGAGGGCCTGG
ACCGCCAGCGAGTGCTGCGCGACGAGGATTTCGAGCCGAACGAGCATACGGGG
ATCAGCCCCGCGCGCGCACGTGGCGGCGGCCAACCTGGTGACGGCCTACGAG
CAGACGGTGAAGCAGGAGCGCAACTTCCAAAAGAGTTTCAACAACCATGTGCGC
ACGCTGATCGCGCGCGAGGAGGTGGCCCTGGGCCTGATGCACCTGTGGGACCTG
GCGGAGGCCATCGTGCAGAACCCGGACAGCAAGCCTCTGACGGCGCAGCTGTTC
CTGGTGGTGCAGCACAGCAGGGACAACGAGGCGTTCAGGGAGGCGCTGCTGAA
CATCGCCGAGCCCGAGGGTCGCTGGCTGCTGGAGCTGATTAACATCTTGCAAAG
CATCGTAGTGCAGGAGCGCAGCCTGAGCCTGGCCGAGAAGGTGGCGGCGATCA
ACTACTCGGTGCTTAGCCTGGGCAAGTTTTACGCGCGCAAGATTTACAAGACGC
CGTACGTGCCCATAGACAAGGAGGTGAAGATAGACAGCTTTTACATGCGCATGG
CGCTCAAGGTGCTGACGCTGAGCGACGACCTGGGCGTGTACCGCAACGACCGCA
TCCACAAGGCCGTGAGCACGAGCCGGCGGCGCGAGCTGAGCGACCGCGAGCTG
ATGCTGAGCCTGCGCCGGGCGCTGGTAGGGGGCGCCTCTGGCGGCGAGGAGTCC
TACTTCGACATGGGGCGGACCTGCATTGGCAGCCGAGCCGGCGCGCCTTGGAG
GCCGCCTACGGTCCAGAGGACTTGGATGAGGAAGAGGAAGAGGAGGAGGATGC
ACCCGTTGCGGGGTACTGACGCCTCCGTGATGTGTTTTTAGATGTCCCAGCAGCA
AGCCCCGGACCCCGCCATAAGGGCGGCGCTGCAAAGCCAGCCGTCCGGTCTAGC
ATCGGACGACTGGGAGGCCGCGATGCAACGCATCATGGCCCTGACGACCCGCAA
CCCCGAGTCCTTTAGACAACAGCCGCAGGCCAACAGACTCTCGGCCATTCTGGA
GGCGGTGGTCCCCTCTCGGACCAACCCCACGCACGAGAAGGTGTGGGCGATCGT
GAACGCGCTGGCGGAGAACAAGGCCATCCGTCCCGACGAGGCCGGGCTGGTGT
ACAACGCCCTGCTGGAGCGCGTGGGCGCTACAACAGCACGAACGTGCAGTCCA
ACCTGGACCGGCTCGTGACGGACGTGCGCGAGGCCGTGGCTCAGCGCGAGCGGT
TCAAGAACGAGGGCCTGGGCTCGCTGGTGGCGCTGAACGCCTTCCTGGCGACGC
AGCCGGCGAACGTGCCGCGCGGGCAGGACGATTATACCAACTTTATCAGTGCGC
TGCGGCTGATGGTGACCGAGGTTCCCCAGAGCGAGGTGTACCAGTCGGGCCCGG
ACTACTTTTTCCAGACTAGCAGACAGGGCCTGCAGACGGTGAACCTGAGCCAGG
CTTTCAAGAATCTGCGCGGGCTGTGGGGCGTGCAGGCGCCCGTGGGCGACCGGT
CGACGGTGAGCAGCTTGCTGACGCCCAACTCGCGGCTGTTGCTCCTGCTGATCGC

TABLE 7-continued

Nucleic Acid Sequences of Vectors

SEQ ID NO Sequence

GCCCTTCACAGACAGCGGCAGCGTGAACCGCAACTCGTACCTGGGTCACCTGCT
GACGCTGTACCGCGAGGCCATAGGCCAGGCGCAGGTGGACGAGCAGACCTTCCA
GGAAATCACGAGCGTGAGCCGCGCGCTGGGGCAGAACGACACCGACAGTCTGA
GGGCCACCCTGAACTTCTTGCTGACCAATAGACAGCAGAAGATCCCGGCGCAGT
ACGCGCTATCGGCCGAGGAGGAGCGCATCCTGAGATATGTGCAACAGAGCGTAG
GGCTGTTCCTAATGCAGGAGGGGGCCACCCCCAGCGCCGCGCTGGACATGACCG
CGCGCAACATGGAACCTAGCATGTACGCCGCCAACCGGCCGTTCATCAATAAGC
TGATGGACTACTTGCACCGCGCGGCGGCCATGAACTCGGACTACTTTACAAACG
CCATTCTGAACCCGCACTGGCTCCCGCCGCCGGGGTTCTACACGGGCGAGTACG
ACATGCCCGACCCCAACGACGGGTTCCTGTGGGACGACGTGGACAGCGCGGTGT
TCTCACCGACCTTGCAAAAGCGCCAGGAGGCGGTGCGCACGCCCGCGAGCGAGG
GCGCGGTGGGTCGGAGCCCCTTTCCTAGCTTAGGGAGTTTGCATAGCTTGCCGGG
CTCGGTGAACAGCGGCAGGGTGAGCCGGCCGCGCTTGCTGGGCGAGGACGAGT
ACCTGAACGACTCGCTGCTGCAGCCGCCGCGGGTCAAGAACGCCATGGCCAATA
ACGGGATAGAAAGTCTGGTGGACAAACTGAACCGCTGGAAGACCTACGCTCAG
GACCATAGGGAGCCTGCGCCCGCGCCGCGGCGACAGCGCCACGACCGGCAGCG
GGGCCTGGTGTGGGACGACGAGGACTCGGCCGACGATAGCAGCGTGTTGGACTT
GGGCGGGAGCGGTGGGGCCAACCCGTTCGCGCATCTGCAGCCCAAACTGGGGA
GGCGGATGTTTTGAAATGCAAAATAAAACTCACCAAGGCCATAGCGTGCGTTCT
CTTCCTTGTTAGAGATGAGGCGTGCGGTGGTGTCTTCCTCTCCTCCTCCCTCGTAC
GAGAGCGTGATGGCGCAGGCGACCCTGGAGGTTCCGTTTGTGCCTCCGCGGTAT
ATGGCTCCTACGGAGGGCAGAAACAGCATTCGTTACTCGGAGCTGGCTCCGCTG
TACGACACCACTCGCGTGTATTTGGTGGACAACAAGTCGGCGGACATCGCTTCC
CTGAACTACCAAAACGACCACAGCAACTTCCTGACCACGGTGGTGCAGAACAAC
GATTTCACCCCCGCCGAGGCCAGCACGCAGACGATAAATTTTGACGAGCGGTCG
CGGTGGGGCGGTGATCTGAAGACCATTCTGCACACCAACATGCCCAATGTGAAC
GAGTACATGTTCACCAGCAAGTTTAAGGCGCGGGTGATGGTGGCTAGGAAGCAC
CCAGAGAATGTAGCTAAAGAGGATTTGAGTCAGGATATCTTAGAATATAAGTGG
TTTGAGTTTACCCTGCCCGAGGGCAACTTTTCCGAGACCATGACCATAGACCTGA
TGAACAACGCCATCTTGGAAAACTACTTGCAAGTGGGGCGGCAAAATGGCGTGC
TGGAGAGCGATATCGGAGTCAAGTTTGACAGCAGGAATTTCAAGCTGGGCTGGG
ACCCGGTGACCAAGCTGGTGATGCCAGGGGTCTACACCTACGAGGCCTTCCATC
CGGACGTGGTGCTGCTGCCGGGCTGCGGGGTGGACTTTACCGAGAGCCGCCTGA
GCAACCTCCTGGGCATTCGCAAGAAGCAACCTTTCCAAGAGGGCTTCAGGATCA
TGTATGAGGATCTAGAAGGGGGCAACATCCCCGCACTCCTTGATGTGGCCAAGT
ACTTGGAAAGCAAGAAGAAGGTAGAGGAAGCAATTAAGAAGGCCGCTGAAACC
AATGGAACCCCTAGAGGAGACAGTGATGTTGCAAGAGAGGTGGAAAAGGCAGC
TCAAACTCAGCTTGTCATTGAGCCCATCAAGCAAGATGATAGCAAGAGAAGTTA
CAACCTCATCGAGGGAACCATGGACACGCTGTACCGCAGCTGGTACCTGTCCTA
TACCTACGGGGACCCCGAGAAGGGGGTGCAGTCGTGGACGCTGCTCACCACCCC
GGACGTCACCTGCGGCGCGGAGCAAGTCTACTGGTCGCTGCCGGATCTCATGCA
AGACCCCGTCACCTTCCGCTCACCCAGCAAGTCAGCAACTACCCCGTGGTCGG
CGCCGAGCTCATGCCCTTCCGCGCCAAGAGCTTTTACAACGACCTCGCCGTCTAC
TCCCAGCTCATCCGCAGCTACACCTCCCTCACCCACGTCTTCAACCGCTTCCCCG
ACAACCAGATCCTATGCCGCCCGCCCGCGCCCACCATCACCACCGTCAGTGAAA
ACGTGCCTGCTCTCACAGATCACGGGACGCTACCGCTGCGCAGCAGTATCCGCG
GAGTCCAGCGAGTGACCGTCACTGACGCCCGTCGCCGCACCTGTCCCTACGTCTA
CAAGGCCCTGGGCATAGTCGCGCCGCGCGTGCTTTCCAGTCGCACCTTCTAAAA
AATGTCTATTCTCATCTCGCCCAGCAATAACACCGGCTGGGGTCTTACTAGGCCC
AGCACCATGTACGGAGGAGCCAAGAAGCGCTCCCAGCAGCACCCCGTCCGCGTC
CGCGGCCACTTCCGCGCTCCCTGGGGCGCTTACAAGCGCGGGCGGACTTCCACC
GCCGCCGCCGTGCGCACCACCGTCGACGACGTCATCGACTCGGTGGTCGCCGAC
GCGCGCAACTACACCCCCGCCCCTCCACCGTGGACGCGGTCATCGACAGCGTG
GTGGCCGACGCGCGCGACTATGCCAGACGCAAGAGCCGGCGGCGACGGATAGC
CAGGCGCCACCGGAGTACGCCCGCCATGCGCGCCGCCCGGGCTCTGCTGCGCCG
CGCCAGACGCACGGGCCGCCGGGCCATGATGCGAGCCGCGCGCCGCGCCGCCAC
TGCACCCCCGCAGGCAGGACTCGCAGACGAGCGGCCGCCGCCGCCGCCGCGGC
CATCTCTAGCATGACCAGACCCAGGCGCGGAAACGTGTACTGGGTGCGCGACTC
CGTCACGGGCGTGCGCGTGCCCGTGCGCACCCGTCCTCCTCGTCCCTGATCTAAT
GCTTGTGTCCTCCCCCGCAAGCGACGATGTCAAAGCGCAAAATCAAGGAGGAGA
TGCTCCAGGTCGTCGCCCCGGAGATTTACGGACCACCCCAGGCGGACCAGAAAC
CCCGCAAAATCAAGCGGGTTAAAAAAAAGGATGAGGTGGACGAGGGGGCAGTA
GAGTTTGTGCGCGAGTTCGCTCCGCGGCGGCGCGTAAATTGGAAGGGGCGCAGG
GTGCAGCGCGTGTTGCGGCCCGGCACGGCGGTGGTGTTCACGCCCGGCGAGCGG
TCCTCGGTCAGGAGCAAGCGTAGCTATGACGAGGTGTACGGCGACGACGACATC
CTGGACCAGGCGGCGGAGCGGGCGGGCGAGTTCGCCTACGGGAAGCGGTCGCG
CGAAGAGGAGCTGATCTCGCTGCCGCTGGACGAAAGCAACCCCACGCCGAGCCT
GAAGCCCGTGACCCTGCAGCAGGTGCTGTCCCAGGCGGTTCTGCTCCCGAGCCG
CGGGGTCAAGCGCGAGGGCGAAAGCATGTACCCCACCATGCAGATCATGGTGCC
CAAGCGCCGGCGCGTGGAGGACGTGCTGGACACCGTGAAAATGGATGTGGAGC
CCGAGGTCAAGGTGCGCCCCATCAAGCAGGTGGCGCCGGGCCTGGGCGTGCAAA
CCGTGGACATTCAGATCCCCACCGACATGGATGTCGACAAAAAACCCTCGACCA
GCATCGAGGTGCAGACCGACCCCTGGCTCCCAGCCTCCACCGCTACCGCCTCCA
ATTCTACCGAGCCTCCCAGGAGGCGAAGATGGGGCGCCGCCAGCCGGCTGATGC
CCAACTACGTGTTGCATCCTTCCATCATCCCGACGCCGGGCTACCGCGGCACCCG
GTACTACGCCAGCCGCAGGCGCCCAGCCAGCAAACGCCGCCGCCGCACCGCCAC

TABLE 7-continued

Nucleic Acid Sequences of Vectors

SEQ ID NO Sequence

```
CCGCCGCCGTCTGGCCCCCGCCCGCGTGCGCCGCGTAACCACGCGCCGGGGCCG
CTCGCTCGTTCTGCCCACCGTGCGCTACCACCCCAGCATCCTTTAATCCGTGTGC
TGTGATACTGTTGCAGAGAGATGGCTCTCACTTGCCGCCTGCGCATCCCCGTCCC
GAATTACCGAGGAAGATCCCGCCGCAGGAGAGGCATGGCAGGCAGTGGCCTGA
ACCGCCGCCGGCGGCGGGCCATGCGCAGGCGCCTGAGTGGCGGCTTTCTGCCCG
CGCTCATCCCCATAATCGCGGCGGCCATCGGCACGATCCCGGGCATAGCTTCCGT
TGCGCTGCAGGCGTCGCAGCGCCGTTGATGTGCGAATAAAGCCTCTTTAGACTCT
GACACACCTGGTCCTGTATATTTTTAGAATGGAAGACATCAATTTTGCGTCCCTG
GCTCCGCGGCACGGCACGCGGCCGTTCATGGGCACCTGGAACGAGATCGGCACC
AGCCAGCTGAACGGGGGCGCCTTCAATTGGAGCAGTGTCTGGAGCGGGCTTAAA
AATTTCGGCTCGACGCTCCGGAACTATGGGAACAAGGCCTGGAATAGTAGCACG
GGGCAGTTGTTAAGGGAAAAGCTCAAAGACCATAACTTCCAGCAGAAGGTGGTG
GACGGGCTGGCCTCGGGCATTAACGGGGTGGTGGACATCGCGAACCAGGCCGTG
CAGCGCGAGATAAACAGCCGCCTGGACCCGCGGCCGCCCACGGTGGTTGAGATG
GAAGATGCAACTCTTCCGCCGCCCAAGGGCGAGAAGCGGCCGCGGCCCGACGC
GGAGGAGACGATCCTGCAGGTTGACGAGCCGCCCTCGTACGAGGAGGCCGTGA
AGGCCGGCATGCCCACCACGCGCATCATCGCGCCGCTGGCCACGGGTGTAATGA
AACCCGCCACCCTTGATCTGCCTCCACCACCCACGCCCGCTCCACCGAAGGCAG
CTCCGGTTGTGCAGGCCCCCCGGTGGCGACCGCCGTGCGCCGCGTCCCCGCCC
GCCGCCAGGCCCAGAACTGGCAGAGCACGCTGCACAGTATCGTGGGCCTGGGAG
TGAAAAGTCTGAAGCGCCGCCGATGCTATTGAGAGAGAGGAAAGAGGACACTA
AAGGGAGAGCTTAACTTGTATGTGCCTTACCGCCAGAGAACGCGCGAAGATGGC
CACCCCCTCGATGATGCCGCAGTGGGCGTACATGCACATCGCCGGGCAGGACGC
CTCGGAGTACCTGAGCCCGGGTCTGGTGCAGTTTGCCCGCGCCACCGACACGTA
CTTCAGCCTGGGCAACAAGTTTAGGAACCCCACGGTGGCTCCCACCCACGATGT
GACCACGGACCGGTCCCAGCGTCTGACGCTGCGCTTCGTGCCCGTGGATCGCGA
GGACACCACGTACTCGTACAAGGCGCGCTTCACTCTGGCCGTGGGCGACAACCG
GGTGCTAGACATGGCCAGCACTTACTTTGACATCCGCGGCGTCCTGGACCGCGG
TCCCAGCTTCAAACCCTACTCGGGCACAGCTTACAACAGTCTGGCCCCCAAGGG
TGCCCCCAACTCCAGCCAGTGGCTTGCAAAAGACACCAATGCTGGCGATCAAGC
ATTAAAAACCCACACACATGGCGTAGCTGCTATGGGGGGAACAGATATCACAGC
AAAGGGTTTGCAAATTGGTGTTGATACGACTGAAAACAAGAATGAGCCTATTTA
TGCAAATGAAATATACCAGCCAGAACCTCAGGTAGGAGAGGAAAACTTGCAAG
ATGTTGAAAACTTTTATGGAGGCAGAGCTCTTAAAAAAGAAACCAAAATGAAAC
CTTGCTATGGCTCGTTTGCCAGACCCACAAATGAAAAAGGCGGTCAAGCCAAAT
TTTTAACTGACGGCGATGGTCAGCTAACTAAAAATCATGATATCACAATGAATTT
CTTTGACACTCCTGGAGGAACAGTTGGTCAGGATACTGAACTTGAAGCAGACAT
TGTTATGTATGCTGAGAATGTGCATCTGGAAACTCCAGACACGCATGTGGTGTAC
AAACCAGGAACTTCTGATGAGAGTTCAGAAGCAAATTTGGTTCAGCAGTCCATG
CCAAACAGGCCCAACTACATCGGCTTCAGGGACAACTTTGTGGGTCTCATGTACT
ATAACAGCACTGGCAACATGGGTGTGCTGGCTGGTCAAGCATCTCAGTTGAATG
CTGTGGTCGACTTGCAAGACAGAAACACAGAGCTGTCTTACCAGCTCTTGCTAG
ATTCTCTGGGTGACAGAACCAGATACTTTAGCATGTGGAACTCTGCAGTGGACA
GTTATGATCCTGATGTCAGGATTATTGAAAATCACGGTGTGGAAGATGAACTTCC
AAACTATTGCTTCCCATTGGATGGAGCTGGCACTAATGCTACCTACCAAGGTGTA
AAAGTTAAAAATGGCCAAGATGGAGATGTAAACGCAGATTGGGAAAAAGATCC
AAATCTTGCTTCACGAAACCAAATATGCAAGGGTAACATCTTCGCCATGGAGAT
CAACCTCCAGGCCAACCTGTGGAAGAGTTTTCTGTACTCGAATGTGGCCCTGTAC
CTGCCCGACTCCTACAAGTACACGCCGGCCAACATCACGCTGCCCACCAACACC
AACACCTACGAGTACATGAACGGCCGCGTGGTGGCACCCTCGCTGGTGGATGCC
TATGTCAACATCGGTGCCCGCTGGTCGCTGGACCCCATGGACAATGTCAACCCCT
TCAACCACCACCGCAACGCGGGTCTGCGCTACCGCTCCATGCTGCTGGGCAACG
GCCGCTACGTGCCCTTCCACATCCAAGTGCCCCAAAAGTTCTTTGCCATCAAGAA
CCTGCTCCTGCTCCCCGGCTCCTACACCTACGAGTGGAACTTCCGCAAGGACGTC
AACATGATCCTGCAGAGTTCCCTCGGAAACGATCTGCGCGTCGACGGCGCCTCC
GTCCGCTTCGACAGCGTCAACCTCTACGCCACCTTCTTCCCCATGGCGCACAACA
CCGCCTCCACCCTGGAAGCCATGCTGCGCAACGACACCAACGACCAGTCCTTCA
ACGACTACCTCTCGGCCGCCAACATGCTCTACCCCATCCCGGCCAAGGCCACCA
ACGTGCCCATCTCCATCCCCTCGCGCAACTGGGCCGCTTCCGCGGCTGGAGTTT
CACCAGGCTCAAGACCAAGGAAACTCCCTCCCTCGGCTCGGGTTTCGACCCCTA
CTTTGTCTACTCGGGCTCCATCCCCTACCTCGACGGGACCTTCTACCTCAACCAC
ACCTTCAAGAAGGTTTCCATCATGTTCGACTCCTCGGTCAGCTGGCCCGGCAACG
ACCGGCTGCTCACGCCGAACGAGTTCGAGATCAAGCGCAGCGTCGACGGGGAA
GGCTACAACGTGGCCCAATGCAACATGACCAAGGACTGGTTCCTCGTCCAGATG
CTCTCCCACTACAACATCGGCTACCAGGGCTTCCACGTGCCCGAGGGCTACAAG
GACCGCATGTACTCCTTCTTCCGCAACTTCCAGCCCATGAGCAGGCAGGTGGTCG
ATGAGATCAACTACAAGGACTACAAGGCCGTCACCCTGCCCCTTCCAGCACAACA
ACTCGGGTTTCACCGGCTACCTCGCACCCACCATGCGTCAGGGGCAGCCCTACCC
CGCCAACTTCCCCTACCCGCTCATCGGTCAGACAGCCGTGCCCTCCGTCACCCAG
AAAAAGTTCCTCTGCGACAGGGTCATGTGGCGCATCCCCTTCTCCAGCAACTTCA
TGTCCATGGGCGCCCTCACCGACCTGGGTCAGAACATGCTCTACGCCAACTCGG
CCCATGCGCTCGACATGACCTTCGAGGTGGACCCCATGGATGAGCCCACCCTCCT
CTATCTTCTCTTCGAAGTTTTCGACGTGGTCAGAGTGCACCAGCCGCACCGCGGC
GTCATCGAGGCCGTCTACCTGCGCACGCCCTTCTCCGCCGGAAACGCCACCCACAT
AAGCATGAGCGGCTCCAGCGAAAGAGAGCTCGCGGCCATCGTGCGCGACCTGG
GCTGCGGGCCCTACTTTTTGGGCACCCACGACAAGCGCTTCCCGGGCTTCCTCGC
```

TABLE 7-continued

Nucleic Acid Sequences of Vectors

| SEQ ID NO | Sequence |
|---|---|
| | CGGCGACAAGCTGGCCTGCGCCATCGTCAACACGGCCGGCCGCGAGACCGGAG
GCGTGCACTGGCTCGCATTCGGCTGGAACCCGCGCTCGCGCACCTGCTACATGTT
CGACCCCTTCGGGTTCTCGGACCGCCGGCTCAAGCAGATTTACAGCTTCGAGTAC
GAGGCCATGCTGCGCCGCAGCGCCCTGGCCTCCTCGCCCGATCGCTGTCTCAGTC
TCGAGCAGTCCACCCAGACCGTGCAGGGGCCCGACTCCGCCGCCTGCGGACTTT
TTTGTTGCATGTTCTTGCATGCCTTCGTGCACTGGCCCGACCGACCCATGGACGG
AAACCCCACCATGAACTTGCTGACGGGGGTGCCCAACGGCATGCTACAATCGCC
ACAGGTGCTGCCCACCCTCAGGCGCAACCAGGAGGAGCTCTACCGCTTCCTCGC
GCGCCACTCCCCTTACTTTCGCTCCCACCGCGCCGCCATCGAACATGCCACCGCT
TTTGATAAAATGAAACAACTGCGTGTATCTCAATAAACAGCACTTTATTTTACAT
GCACTGGAGTATATGCAAGTTATTTAAAAGTCGAAGGGGTTCTCGCGCTCGTCGT
TGTGCGCCGCGCTGGGGAGGGCCACGTTGCGGTACTGGTACTTGGGATGCCACT
TGAACTCGGGGATCACCAGTTTGGGCACTGGGGTCTCGGGGAAGGTCTCGCTCC
ACATGCGCCGGCTCATCTGCAGGGCGCCCAGTATGTCAGGCGCGGAAATCTTGA
AATCGCAGTTGGGACCGGTGCTCTGCGCGCGCGAGTTGCGGTACACGGGGTTGC
AGCACTGGAACACCATCAGACTGGGGTGCTTCACGCTGGCCAGCACGCTCTTGT
CGCTGATCTGATCCTTGTCCAGGTCCTCGGCGTTGCTCAGGCCGAACGGGGTCAT
CTTGCACAGCTGGCGGCCCAGGAAGGGCACGCTCTGAGGCTTGTGGTTACACTC
GCAGTGCACGGGCATCAGCATCATCCCCGCGCCGCGCTGCATATTCGGGTAGAG
GGCCTTGACAAAGGCCAAGATCTGCTTGAAAGCTTGCTGGGCCTTGGCCCCCTC
GCTGAAGAACAGGCCGCAGCTCTTCCCGCTGAACTGGTTATTTCCACACCCGGC
ATCATGCACGCAGCAGCGCGCGTCATGGCTGGTCAGTTGCACCACGCTTCGGCC
CCAGCGGTTCTGGGTCACCTTGGCCTTGCTGGGCTGCTCCTTCAACGCGCGCTGG
CCGTTCTCGCTGGTCACATCCATCTCCACCACGTGGTCCTTGTGGATCATCACCG
TTCCATGCAGACACTTGAGCTGGCCCTCGACATCGGCGCAGCCGTGTTCCCACAG
GGCGCAGCCGGTGCACTCCCAATTCTTGTGCGCGATCCCGCTGTGGCTGAAGAT
GTAACCTTGCAACATGCGGCCCATCACGGTGCTAAATGATTTACTGGTGCTGAA
GGTCAGTTGCAGGCCGCGTGCCTCCTCGTTCATCCATGTCTGACACATCTTTTGG
AAGATCTCGGTCTGCTCGGGCATGAGCTTGTAAGCATCGCGCAGGCCGCTGTCG
ACGCGGTAGCGTTCCATCAGCACGTTCATGGTATCCATGCCCTTCTCCCATGACG
AGACCAGAGGCAAACTCAGGGGGTTGCGCACGTTCAGGATACCGGGGGTCGCG
GGCTCTACGATGCGTTTTCCGTCCTTTCCTTCCTTCAACAGGACCGGCGGCTGGC
TGAATCCCACTCCCACGATCACGGCGTCTTCCTGGGGCATCTCTTCGTCGGGGTC
TATCTTTGTCACATGCTTGGTCTTTCTGGCTTGCTTCTTTTTTGGAGGGCTGTCCA
CGGGGACCACGTCCTCTTCGGAAGACCCGGAGCCCACCCGCTGATACTTTCGGC
GCTTGGTGGGCAGAGGAGGTGGCGGCGAGGGGCTCCTCTCCTGCTCCGGCGGAT
AGCGCGCTGAACCGTGGCCCCGGGGCGGAGTGGCCTCTCGGTCCATGAACCGGC
GCACGTCCTGACTGCCGCCGGCCATTGTTTCCTAGGGGAAGATGGAGGAGCAGC
CGCGTAAGCAGGAGCAGGAGGAGGAGAACTTAACCACCCACGAACAAGCAAAA
ATCGAGCAGGACCTGGGCTTCGAAGAGCCGGCTCGTCTAGAACCCCCACAGGAT
GAACAGGAGCACGAGCAAGACGCAGGCCAGGAGGAGACCGACGCTGGGCTCGA
GCATGGCTACCTAGAGGAGGACATGCTGCTGAAACACTTGCAGCGCCAATCCCT
CATCCTCAGGGACGCCCTGGCCGACCGGAGCGAGATCCCCCTCAGCGTCGAGGA
GCTAAGTAGGGCCTACGAGCTCAACCTTTTCTCGCCGCGCGTGCCCCCCAAACGC
CAGCCCAACGGCACCTGCGAGCCCAACCCGCGCCTCAACTTTTACCCCGTTTTCG
CGGTCCCCGAGGCCCTGGCCACCTATCACATCTTTTTCAAGAACCAAAAGATCCC
CGTCTCCTGTCGCGCCAACCGCACCCGCGCCGACGCGCTCCTCGCTCTGGGGCCC
GGCGCGCGCATACCTGATATCGCTTCCTGGAAGAGGTGCCCAAGATCTTCGAA
GGGCTCGGTCGGGACGAGACGCGCGCGGCGAACGCTCTGAAAGAAACAGCAGA
GGAAGAGGGTCACACTAGCGCCCTTGTAGAGTTGGAAGGCGACAAGCGCCAGGCT
GGCCGTACTCAAGCGCAGCGTCGAGCTCACCCACTTCGCCTACCCCGCCGTCAA
CCTCCCGCCCAAGGTCATGCGTCGCATCATGGATCAGCTCATCATGCCCCACATC
GAGGCCCTCGATGAGACGCAAGAGCAGCGGCCCGAGGACGCCCAGCCCGTGGT
CAGCGACGAGCAGCTCGCGCGCTGGCTCGGGAACCGCGACCCCCAGGTCCTGGA
GCAGCGGCGCAAGCTCATGCTGGCCGTGGTCCTTGTCACCCTCGAGCTGGAATG
CATGCGCCGCTTCTTCAGCGACCCCGACACCCTGCGCAAGGTCGAGGAGACCCT
GCACTACACTTTCAGACACGGGTTCGTCAGGCAGGCCTGCAAGATCTCCAACGT
GGAGCTGACCAACCTGGTCTCCTGCCTGGGGATCCTGCACGAGAACCGCCTGGG
ACAGACCGTGCTCCACTCTACCCTGAAGGGCGAGGCGCGGAGTGACTACGTCCG
AGACTGCATCTTTCTCTTTCTGCCACACATGGCAGTCGGCCATGGGAGTGTGG
CAGCAGTGTCTAGAGGATGAGAACCTGAAGGAGCTGGACAAGCTTCTTGCTAGA
AACCTCAAAAAGCTGTGGACGGGCTTCGACGAGCGCACCGTCGCCTCGGACCTG
GCCGAAATAGTCTTCCCCGAGCGCCTGAGGCAGACGCTGAAAGGCGGGCTGCCC
GACTTCATGAGCCAGAGCATGTTGCAAAACTACCGCACTTTCATTCTCGAGCGAT
CGGGGATCCTGCCCGCCACCTGCAACGCCTTCCCCTCCGACTTTGTCCCGCTGAG
CTACCGCGAGTGTCCCCCGCCGCTGTGGAGCCACTGCTACCTCTTGCAGCTGGCC
AACTACATCGCCCACCACTCGGATGTGATCGAGGACGTGAGCGGCGAGGGGCTG
CTAGAGTGCCACTGCCGCTGCAACCTGTGCTCCCCGCACCGCTCTCTGGTCTGCA
ACCCCCAGCTCCTGAGCGAGACCCAGGTCATCGGTACCTTCGAGCTGCAAGGTC
CGCAGGAGTCCACCGCTCCGCTGAAACTCACGCCGGGGTTGTGGACTTCCGCGT
ACCTGCGCAAATTTGTACCCGCTGACTACCACGCCCATGAGATAAAGTTCTTCGA
GGACCAATCGCGTCCGCAGCACGCGGATCTCACGGCCTGCGTCATCACCCAGGG
CGCGATCCTCGCCCAATTGCACGCCATCCAAAAATCCCGCCAAGAGTTTCTTCTG
AAAAAGGGTAGAGGGGTCTACCTGGACCCCCAGACGGGCGAGGTGCTCAACCCC
GGGTCTCCCCCAGCATGCCGAGGAAGAAGCAGGAGCCGCTAGTGAGGAGATG
GAAGAAGAATGGGACAGCCAGGCAGAGGAGGACGAATGGGAGGAGGAGACAG |

TABLE 7-continued

Nucleic Acid Sequences of Vectors

SEQ ID NO Sequence

```
AGGAGGAAGAATTGGAAGAGGTGGAAGAGGAGCAGGCAACAGAGCAGCCCGTC
GCCGCACCATCCGCGCCGGCAGCCCCGCCGGTCACGGATACAACCTCCGCTCCG
GTCAAGCCTCCTCGTAGATGGGATCGAGTGAAGGGTGACGGTAAGCACGAGCGG
CAGGGCTACCGATCATGGAGGGCCCACAAAGCCGCGATCATCGCCTGCTTGCAA
GACTGCGGGGGGAACATCGCTTTCGCCCGCCGCTACCTGCTCTTCCACCGCGGG
GTGAACATCCCCCGCAACGTGTTGCATTACTACCGTCACCTTCACAGCTAAGAAA
AAATCAGAAGTAAGAGGAGTCGCCGGAGGAGGCCTGAGGATCGCGGCGAACGA
GCCCTCGACCACCAGGGAGCTGAGGAACCGGATCTTCCCCACTCTTTATGCCATT
TTTCAGCAGAGTCGAGGTCAGCAGCAAGAGCTCAAAGTAAAAAACCGGTCTCTG
CGCTCGCTCACCCGCAGTTGCTTGTACCACAAAAACGAAGATCAGCTGCAGCGC
ACTCTCGAAGACGCCGAGGCTCTGTTTCACAAGTACTGCGCGCTCACTCTTAAAG
ACTAAGGCGCGCCCACCCGGAAAAAAGGCGGGAATTACTTCATCGCCACCATGA
GCAAGGAGATTCCCACCCCTTACATGTGGAGCTATCAGCCCCAGATGGGCCTGG
CCGCGGGCGCCTCCCAGGACTACTCCACCCGCATGAACTGGCTCAGTGCCGGCC
CCTCGATGATCTCACGGGTCAACGGGTCCGTAACCATCGAAACCAGATATTGT
TGGAGCAGGCGGCGGTCACCTCCACGCCCAGGGCAAAGCTCAACCCGCGTAATT
GGCCCTCCACCCTGGTGTATCAGGAAATCCCCGGGCCGACTACCGTACTACTTCC
GCGTGACGCACTGGCCGAAGTCCGCATGACTAACTCAGGTGTCCAGCTGGCCGG
CGGCGCTTCCCGGTGCCCGCTCCGCCCACAATCGGGTATAAAAACCCTGGTGAT
CCGAGGCAGAGGCACACAGCTCAACGACGAGTTGGTGAGCTCTTCGATTGGTCT
GCGACCGGACGGAGTGTTCCAACTAGCCGGAGCCGGGAGATCGTCCTTCACTCC
CAACCAGGCCTACCTGACCTTGCAGAGCAGCTCTTCGGAGCCTCGCTCCGGAGG
CATCGGAACCCTCCAGTTCGTGGAGGAGTTTGTGCCCTCGGTCTACTTCAACCCC
TTCTCGGGATCGCCAGGCCTCTACCCGGACGAGTTCATACCGAACTTCGACGCA
GTGAGAGAAGCGGTGGACGGCTACGACTGAATGTCCCATGGTGACTCGGCTGAG
CTCGCTCGGTTGAGGCATCTGGACCACTGCCGCCGCCTGCGCTGCTTCGCCCGGG
AGAGCTGCGGCCTCATCTACTTTGAGTTTCCCGAGGAGCACCCCAACGGCCCTGC
ACACGGAGTGCGGATCACCGTAGAGGGCACCACCGAGTCTCACCTGGTCAGGTT
CTTCACCCAGCAACCCTTCCTGGTCGAGCGGGACCGGGGCGCCACCACCTACAC
CGTCTACTGCATCTGTCCTACCCCGAAGTTGCATGAGAATTTTTGCTGTACTCTTT
GTGGTGAGTTTAATAAAAGCTAAACTCTTGCAATACTCTGGACCTTGTCGTCGTC
AACTCAACGAGACCGTCTATCTCACCAACCAGACTGAGGTAAAACTCACCTGCA
GACCACACAAAACCTATATCATCTGGTTCTTCGAGAACACCTCATTTGCAGTTGC
CAACACTCACTGCAACGACGGTGTTGAACTTCCCAACAACCTTTCCAGTGGACTG
AGTTACGATACCAGAAGAGCTAAACTCGTCCTCTACAATCCTTTTGTAGAGGGA
ACCTATCATTGCCAGAGCGGACCTTGTACTCACACCTTCCATTTGGTGAACGTCA
CCAGCAGCAGCAACAGCTCAGAAACTAACCTCTCTTCTCGTACTAACAGACCTC
ATTTTGGAGGTGAGCTAAGGCTTCCCCCTTCTGAGGAGGGGGTTAGCCCATACG
AAGTGGTCGGGTATTTGATTTTAGGGGTGGTCCTGGGTGGGTGCATAGCGGTGCT
AGCTCAGCTGCCTTGCTGGGTGGAAATCAAATCTTTATCTGCTGGGTCAGACAT
TGTGGGGAGGAACCATGAATGGGCTCTTGCTGATTATCCTTTCCCTGGTGGGGGG
TGTACTGTCATGCCACGAACAGCCACGATGTAACATCACCACAGGCAATCATAT
GAGCAGAGAGTGCACTGTAGTCATCAAATGCGAGCACGACTGCCCACTAAACAT
TACATTCAAGAATAACACCATGGGAAATGTATGGGTGGGTTTCTGGGAACCAGG
AGATGAGCAGAACTACACGGTCACTGTCCATGGTAGCAATGGAAATCACACTTT
CGGTTTCAAATTCATTTTTGAAGTCATGTGTGATATCACACTGCATGTGGCTAGA
CTTCATGGCTTGTGGCCCCTACCAAGGAGAACATGGTTGGGTTTTCTTTGGCTT
TTGTGATCATGGCCTGCTTGATGTCAGGTCTACTGGTAGGGGCTTTAGTGTGGTT
CCTGAAGCGCAAGCCTAGGTACGGAAATGAAGAAAAGGAAAAATTGCTATAAT
CTTTTTCTTTTTCACAGAACCATGAATGCTTTGACCAGTGTCGTGCTGCTCTCTCT
TCTTGTAGCTTTTAGTAATGGGGAAGCTGAAACTGTAGTTGTAAATGTTAAATCT
GGTACAAACCACACCCTTGAAGGTCCTAGAAAAACTCCAGTTCAGTGGTATGGG
GGTGCTAACTTTGACATGTTTTGCAATGGCTCTAAAATACATCACAAGGAATTGA
ATCACACTTGCTCTATTCAGAACATAACTCTTACATTCATAAACAGAACACATCA
TGGAACATACTATGGTTTTGGCTATGACAATCAAAATTCAAAAGTGTATCATGTC
AGAGTAGATGTAGAGCCTCCTAGACCCCGTGCTACTTGGGCTCCTCCTCAGGAC
ATAACTATTAAGTATGGTTCAAATAGAACATTGCAGGGCCCAAGTGTTACTCCA
GTTAGTTGGTATGATGGTGAAGGAAATCGGTTTTGCGATGGAGATAAAATTGAT
CATACAGAAATTAATCACACTTGCAATGCTCAAAACCTTACTTTGCTATTTGTGA
ATGAAACACATGAAGAACATATTATGGAATTAGTGGTGATTGGAAACAGCGAA
ATGAGTATGATGTTACTGTTACAAAGACACATTTAAATATTAAAAATTTGGCCA
ACGCAAAACTGATGAAAACCATAAAAATGGAATGCAACAGAAAGTCGAACAAA
AGCCTTCAAAAAGGCCTAAACAAAAAACATTGCAAACTACAATTCAGGTTATGA
TTCCTATTGGAACTAATTATACTTTAGTGGGGCCTTCGCCACCAGTGAGCTGGCA
TACTACAAAAAATGGCTTAACAGAACTCTGTAATGGAAACCCTATTTTAAGACA
CACTTGTGATGGGCAAAATATTACACTTATTAATGTTAATGCTACATTTGAAGCT
GATTACTATGGCTCGAACAATAAGAGTGAATCAAAACACTACAGAGTCAAGGTT
TTCAAAGAAAGAAAAGATCAGGCACTATTATTCAGACCGCTTACTACCAAAGGA
AGCATGATCATTACTACTGAAAATCAAACTTTGAATTGCAAAAAGGTGACAAT
CAAGATGATGACAAAATTCCATCAACTACTGTGGCAATCGTGGTGGGTGTGATT
GCGGGCTTTGTGACTCTGATCATTGTCTTCATATGCTACATCTGCTGCCGCAAGC
GTCCCAGGACATACAATCATATGGTAGACCCACTACTCAGTTTCTCTTACTGAAA
CTCAGTCACTCTCATTTCAGAACCATGAAGGCTTTCACAGCTTGCGTTCTGATTA
GCATAGTCACACTTAGTGCAGCCGCAGCTAAATGCTTCCATACTTATAACTTAAC
TAGAGGGGAAAATATTACATTATCAGGTGCTGGTTTAAACACAACATGGGAAGC
GTATCACAATGGGTGGAAACAAGTTTGTCCATGGAATGACGGACGCTATGTGTG
```

TABLE 7-continued

Nucleic Acid Sequences of Vectors

| SEQ ID NO | Sequence |
|---|---|
| | CGTTGGAAACAGCAGTACCATAACTAACCTTACAGTTGTGGCTAATGCAAATTT<br>ATCATCAACTGTTAAATTTAGAGCTGAAAGTTTATACATTGGAACTGATGGATAT<br>GAAAGCAATCCATCATGCTTTTATACTGTCAATGTAATTGAGCTTCCAACCACCA<br>GATCGCCAACTACCACCACAGTCAGTACAACTGCTGAAACCACAACTCACACTA<br>CACAGTTAGACACTACAGAGCAGAATAGTACTGTATTGGTTAGGTATTTGTTAA<br>GGGAGGAGAGTACTACTGAACAGACAGAGGCTACCTCAAGTGCCTTCAGCAGCA<br>CTGCAAATTTAACTTCGCTTGCTTGGACTAATGAAACCGGAGTATCGTTGATGAA<br>TCGCCAGCCTTACTCAGGTTTGGATATTCAAATTACTTTTCTGGTTGTCTGTGGAA<br>TCTTTATTCTTGCGGTTCTTCTGTACTTTGTCTGCTGCAAAGCCAGAGAAAAATCT<br>AGGCGGCCCATCTACAGGCCAGTAATCGGGGAACCTCAGCCACTCCAAGTGGAT<br>GGAGGCTTAAGGAATCTTCTCTTCTCTTTTACAGTATGGTGATCAGCCATGATTC<br>CTAGGTTCTTCCTATTTAACATCCTGTTCTGTCTCTTCAACATCTGCGCTGCCTTC<br>GCGGCCGTCTCGCACGCCTCGCCCGACTGTCTCGGGCCCTTCCCCACCTACCTAC<br>TCTTTGCCCTACTCACCTGCACCTGCGTCTGCAGCATTGTCTGCGTGGTCATAAC<br>CTTCCTGCAGCTCATCGACTGGTGCTGCGCGCGCTACAATTACCTACACCACAGT<br>CCCGAATACAGGGACGAGAACGTAGCCAGAATCTTAAGGCTCATCTGACCATGC<br>AGACTCTGCTCATGCTGCTATCCCTCCTATCCCCTGCCCTCGCCACTTCTGCTGAT<br>TACTCTAAATGCAAATTCGCGGACATATGGAATTTCTTAGATTGCTATCAGGAGA<br>AAATTGATATGCCATCCTATTACTTGGTGATTGTGGGAATAGTCATGGTCTGCTC<br>CTGCACTTTCTTTGCCATCATGATCTACCCCTGTTTTGATCTCGGCTGGAACTCTG<br>TTGAGGCATTCACATACACACTAGAAAGCAGTTCACTAGCCTCCACGCCACCAC<br>CCACACCGCCTCCCCGCAGAAATCAGTTTCCCCTGATTCAGTACTTAGAAGAGCC<br>CCCTCCCCGGCCCCCTTCCACTGTTAGCTACTTTCACATAACCGGCGGCGATGAC<br>TGACCACCTGGACCTCGAGATGGACGGCCAGGCCTCCGAGCAGCGCATCCTGCA<br>ACTGCGCGTCCGTCAGCAGCAGGAGCGGGCCGCCAAGGAGCTCCTCGATGCCAT<br>CAACATCCACCAGTGCAAGAAGGGCATCTTCTGCCTGGTCAAACAGGCAAAGAT<br>CACCTACGAGCTCGTGTCCGGCGGCAAGCAGCATCGCCTCGCCTATGAGCTGCC<br>CCAGCAGAAGCAGAAGTTCACCTGCATGGTGGGCGTCAACCCCATAGTCATCAC<br>CCAGCAGTCGGGCGAGACCAACGGCTGCATCCACTGCTCCTGCGAAAGCCCCGA<br>GTGCATCTACTCCCTCCTCAAGACCCTTTGCGGACTACGCGACCTTCTCCCCATG<br>AACTGATGTTGATTAAAAGCCCAAAAACCAATCATACCCTTCCCCCATTTCCCCA<br>CCCCCAATCATAAGAATAAATCATTGGAACTAAACATTCAATAAAGATCACTTA<br>CTTGAAATCTGAAAGTATGTCTCTGGTGTAGTTGTTCAGCAACACCTCAGTACCC<br>TCCTCCCAGCTCTGGTACTCCAGTCCCCGGCGGGCGGCGAACTTCCTCCACACCT<br>TGAAAGGGATGTCAAATTCCTGGTCCACAATTTTCATTGTCTTCCCCCTCAGATG<br>ACAAAGAGGCTCCGGGTGGAAGATGACTTCAACCCCGTCTACCCCTATGGCTAC<br>GCGCGGAATCAGAATATCCCCTTCCTCACTCCTCCCTTTGTCTCCTCCGATGGATT<br>CCAAAACTTCCCCCCTGGTGTCCTGTCACTCAAATTGGCTGACCCAATCGCTATC<br>AGCAATGGTGATGTCTCACTCAAGGTGGGAGGGGGACTCACTGTGGAACAAGAT<br>AGTGGAAACCTAAGTGTGAATCCTAAGGCTCCATTGCAAGTTGGAACAGACAAA<br>AAACTGGAATTGGCTTTAGCACCTCCATTTAATGTTAAAGATAATAAGCTAGCTC<br>TGCTAGTAGGAGATGGATTAAAAGTAATAGATAGATCAATATCTGACTTGCCAG<br>GATTGTTAAATTATCTTGTAGTTTTGACTGGCAAAGGAATTGGAAATGAAGAATT<br>AAAAAATGACGATGGTAGCAATAAAGGAGTCGGTTTATGTGTAAGAACTGGAG<br>AAGGAGGTGGTTTAACTTTTGATGATAAAGGTTATTTAGTAGCATGGAACAAGA<br>AACATGACATCCGCACACTTTGGACAACTTTAGACCCTTCTCCAAATTGTAGAAT<br>CGATGTGGACAAGGACTCTAAACTAACATTGGTCCTTACAAAGTGCGGAAGTCA<br>GATATTGCTAATGTATCTCTTCTTGTTGTCAAAGGAAGGTTTCAAAACCTAAAT<br>TACAAAACAAACCCAAACCTTCCTAAAGCATTTGCAATAAAATTACTGTTTGATG<br>AAAATGGGATTCTTAAAGACTCATCAAATCTTGACAAGAACTATTGGAACTATA<br>GAAGCGGAAATTCTATTTTAGCAGAGCAATATAAAAATGCAGTTGGCTTTATGC<br>CAAATTTAGCAGCTTATCCCAAATCTACCACCACTCAGTCTAAACTTTATGCAAG<br>AAACACTATTTTTGGAAATATTTACCTGGATTCGCAAGCATATAATCCAGTGGTT<br>ATTAAAATTACTTTTAATCAAGAAGCAGATAGTGCTTATTCTATCACTTTTAAACT<br>ATTCATGGGGTAAGGATTATGAAAATATCCCTTTTGATTCTACTTCTTTTACCTTT<br>TCCTATATCGCCCAAGAATGAAAGACCAATAAACGTGTTTTTCATTTGAAAATTT<br>TCATGTATCTTTATTGATTTTTACACCAGCACGGGTAGTCAGTCTCCCACCACCA<br>GCCCATTTCACAGTGTAAACAACTCTCTCAGCACGGGTGGCCTTAAACAGGGAA<br>ATGTTCTGATTAGTGCGGGAACTGGACTTGGGGTCTATAATCCACACAGTTTCCT<br>GGCGAGCCAAGCGGGGGTCGGTGATTGAGATGAAGCCGTCCTCTGAAAAGTCAT<br>CCAAGCGGGCCTCACAGTCCAAGGTCACAGTCTGGTGGAATGAGAAGAACGCAC<br>AGATTCATACTCGGAAAACAGGATGGGTCTGTGCCTCTCCATCAGCGCCCTCAG<br>CAGTCTCTGCCGCCGGGGCTCGGTGCGGCTGCTGCAGATGGGATCGGGATCGCA<br>AGTCTCTCTGACTATGATCCCCACAGCCTTCAGCATCAGTCCTGGTGCGTCGG<br>GCACAGCACCGCATCCTGATCTCTGCCATGTTCTCACAGTAAGTGCAGCACATAA<br>TCACCATGTTATTCAGCAGCCCATAATTTAGGGCGCTCCAGCCAAAGCTCATGTT<br>GGGGATGATGGAACCCACGTGACCATCGTACCAGATGCGGCAGTATATCAGATG<br>CCTGCCCCTCATGAACACACTGCCCATATACATGATCTCTTTGGGCATGTTTCTG<br>TTCACAATCTGCCGGTACCATGGGAATCGCTGGTTGAACATGCACCCGTAAATG<br>ACTCTCCTGAACCACACGGCC |
| SEQ ID NO: 1438 | CATCATCAATAATATACCTTATAGATGGAATGGTGCCAATATGCAAATGAGGTA<br>ATTTAAAAAAGTGCGCGCTGTGTGGTGATTGGCTGTGGGGTGAACGGCTAAAAT<br>GGGCGGGGCGGCCGTGGGAAAATGACGTGACTTATGTGGGAGGAGCTATGTTGC<br>AAGTTATTGCGGTAAATGTGACGTAAAACGAGGTGTGGTTTGAACACGGAAGTA<br>GACAGTTTTCCCACGCTTACTGACAGGATATGAGAGTAGTTTTGGGCGGATGCA |

TABLE 7-continued

Nucleic Acid Sequences of Vectors

SEQ ID NO Sequence

AGTAAAAATTCTCCATTTTCGCGCGAAAACTGAATGAGAATATGAATTTCTGAGT
CATTTCGCGGTTATGACAGGGTGGAGTATTTGCCGAGGGCCGAGTTAGACTTTG
ACCGTTTACGTGGAGGTTTCGATTACCGTGGTTTTTACCTAAATTTCCGCGTACG
GTGTCAAAGTCCTGTGTTTTTACGTAGGTGTCAGCTGATCGCTAGGGTATTTAAA
CCTGACGAGTTCCGTCAAGAGGCCACTCTTGAGTGCCAGCGAGAAGAGTTTTCT
CCTCCGCCGCAAGTCAGTTCTGCGCTTTGAAAATGAGACACCTGCGTTTCCTG
CCACAGGAGATTATCTCCAGTGAAACCGGGATTGAAATACTGGAGTTTGTGGTA
AATACCCTAATGGGAGACGACCCGGAACCGCCAGTGCAGCCTTTTGATCCACCT
ACGCTGCACGATCTGTATGATTTAGAGGTAGACGGGCCGGAGGATCCCAATGAG
GAAGCTGTGAATGGGTTTTTTACTGATTCTATGCTGCTAGCTGCCGATGAAGGAT
TGGACATAAACCCTCCTCCTGAGACCCTTGATACCCCAGGGGTGGTTGTGGAAA
GCGGCAGAGGTGGGAAAAAATTGCCTGATCTGGGAGCAGCTGAAATGGACTTGC
GTTGTTATGAAGAGGGTTTTCCTCCGAGTGATGATGAAGATGGGGAAATTGAGC
AGTCCATCCATACCGCAGTGAATAAGGGAGTAAAAGCTGCCAGCGATGTTTTTA
AGTTGGACTGTCCGGAGCTGCCTGGACATGGCTGTAAGTCTTGTGAATTTCACAG
GAATAACACTGGAATGAAAGAACTATTGTGCTCGCTTTGCTATATGAGAATGCA
CTGCCACTTTATTTACAGTAAGTGTATTTAAGTGAAATTTAAAGGAATAGTGTAG
CTGTTTAATAATTTGAATGGTAGATTTATATTTTTACTTGCGATTTTTTTGTAGGT
CCTGTGTCTGATGATGAGTCACCTTCTCCTGATTCAACTACTTCACTTCCTGAAAT
TCAGGCGCCCGCACCTGCAAACGTATGCAAGCCCATTCCTGTGAAGCCTAAGCC
TGGGAAACGCCCTGCTGTGGATAAGCTTGAGGACTTGTTGGAGGGTGGGGATGG
ACCTTTGGACCTTAGTACCCGGAAACTGCCAAGGCAATGAGTGCCCTGCAGCTG
TGTTTATTTAATGTGACGTCATGTAATAAAATTATGTCAGCTGCTGAGTGTTTTAT
TACTTGTTGGGTGGGGACTTGGATATATAAGTAGGAGCAGATCTGTGTGGTTAG
CTCACAGCAACCTGCTGCCATCCATGGAGGTTTGGGCTATCTTGGAAGACCTCAG
ACAGACTAGGCTACTGCTAGAAAACGCCTCGGACGGAGTCTCTGGCCTTTGGAG
ATTCTGGTTCGGTGGTGATCTAGCTAGGCTAGTGTTTAGGATAAAACAGGACTAC
AGGGAAGAATTTGAAAAGTTATTGGACGACAGTCCAGGACTTTTTGAAGCTCTT
AACTTGGGTCATCAGGCTCATTTTAAGGAGAAGGTTTTATCAGTTTTAGATTTTT
CTACTCCTGGTAGAACTGCTGCTGCTGTAGCTTTTCTTACTTTTATATTGGATAAA
TGGATCCGCCAAACTCACTTCAGCAAGGGATACGTTTTGGATTTCATAGCAGCA
GCTTTGTGGAGAACATGGAAGGCTCGCAGGATGAGGACAATCTTAGATTACTGG
CCAGTGCAGCCTCTGGGAGTAGCAGGGATACTGAGACACCCACCGACCATGCCA
GCGGTTCTGCAGGAGGAGCAGCAGGAGGACAATCCGAGAGCCGGCCTGGACCC
TCCGGTGGAGGAGTAGCTGACCTGTTTCCTGAACTGCGACGGGTGCTTACTAGGT
CTACGACCAGTGGACAGAACAGGGGCATTAAGAGGGAGAGGAATCCTAGTGGG
AACAATTCAAGAACCGAGTTGGCTTTAAGTTTAATGAGCCGCAGGCGTCCTGAA
ACTGTTTGGTGGCATGAGGTTCAGAGCGAAGGCAGGGATGAAGTTTCAATATTG
CAGGAGAAATATTCACTAGAACAACTTAAGACCTGTTGGTTGGAACCTGAGGAT
GATTGGGAGGTGGCCATTAGGAATTATGCTAAGATATCTCTGAGGCCTGATAAA
CAATATAGAATTACTAAGAAGATTAATATTAGAAATGCATGCTACATATCAGGG
AATGGGGCAGAGGTTATAATAGATACACAAGATAAAGCAGCTTTTAGATGTTGT
ATGATGGGTATGTGGCCAGGGGTTGTCGGCATGGAAGCAGTAACACTTATGAAT
ATTAGGTTTAGAGGGGATGGGTATAATGGCATTGTATTTATGGCTAACACTAAG
CTGATTCTACATGGTTGTAGCTTTTTTGGGTTTAATAATACGTGTGTAGAAGCTT
GGGGGCAAGTTAGTGTGAGGGGTTGTAGTTTTTATGCATGCTGGATTGCAACATC
AGGTAGGGTGAAGAGTCAGTTGTCTGTAAAGAAATGCATGTTTGAGAGATGTAA
TCTTGGCATACTGAATGAAGGTGAAGCAAGGGTCCGCCACTGCGCGGCTACACA
AACTGGCTGCTTCATTCTAATAAAGGGAAATGCCAGTGTAAAGCATAATATGAT
CTGTGGACATTCGGATGAGAGGCCTTATCAGATGCTGACCTGCGCTGGTGGACA
TTGCAATATTCTTGCTACCGTGCATATCGTTTCACATGCACGCAAGAAATGGCCT
GTATTTGAACATAATGTGATTACCAAGTGCACCATGCACATAGGTGGTCGCAGA
GGAATGTTTATGCCTTACCAGTGTAACATGAATCATGTGAAGGTGATGTTGGAA
CCAGATGCCTTTTCCAGAGTGAGCTTAACAGGAATCTTTGATATGAATATTCAAC
TATGGAAGATCCTGAGATATGATGACACTAAACCGAGGGTGCGCGCATGCGAAT
GCGGAGGCAAGCATGCTAGATTCCAGCCGGTGTGCGTGGATGTGACTGAAGACC
TGAGACCCGATCATTTGGTGCTTGCCTGCACTGGAGCGGAGTTTGGTTCTAGTGG
TGAAGAAACTGACTAAAGTGAGTAGTGGGGCAAGATGTGGATGGGGACTTTCAG
GTTGGTAAGGTGGACAAATTGGGTAAATTTTGTTAATTTCTGTCTTGCAGCTGCC
ATGAGTGGAAGTGCTTCTTTTGAGGGGGGAGTATTTAGCCCTTATCTGACGGGCA
GACTCCCACCATGGGCAGGAGTTCGTCAGAATGTCATGGGATCTACTGTGGATG
GGAGACCCGTCCAGCCCGCCAATTCCTCAACGCTGACCTATGCCACTTTGAGTTC
GTCACCATTGGATGCAGCTGCAGCCGCCGCCGCTACTGCTGCCGCCAACACCAT
CCTTGGAATGGGCTATTACGGAAGCATCGTTGCCAATTCCAGTTCCTCTAATAAC
CCTTCAACCCTGGCTGAGGACAAGCTACTTGTTCTCTTGGCTCAGCTCGAAGCCT
TAACCCAACGCTTAGGCGAACTGTCTAAGCAGGTGGCCCAGTTGCGTGAGCAAA
CTGAGTCTGCTGTTGCCACAGCAAAGTCTAAATAAAGATCTCAAATCAATAAAT
AAAGAAATACTGATTATGAAACAAATGAATGTTTATTTGATTTTTCGCGCGCGGT
ATGCCCTGGACCATCGGTCTCGATCATTGAGAACTCGGTGGATCTTTTCCAGTAC
CCTGTAAAGGTGGGATTGAATGTTTAGATACATGGGCATTAGTCCGTCTCGGGG
GTGGAGATAGCTCCATTGAAGAGCCTCTTGCTCCGGGGTAGTGTTATAAATCACC
CAGTCATAGCAAGGTCGGAGTGCATGGTGTTGCACAATATCTTTTAGGAGCAGA
CTAATTGCAACGGGGAGGCCCTTAGTGTAGGTGTTTACAAATCTGTTAAGCTGG
GACGGGTGCATTCGGGGTGAAATTATATGCATTTTGGACTGGATCTTAAGGTTGG
CAATGTTGCCGCCTAGATCCCGTCTCGGGTTCATATTGTGCAGGACCACCAAGAC
AGTGTATCCTGTGCACTTGGGAAATTTATCATGCAGCTTAGAGGGAAAAGCATG

TABLE 7-continued

Nucleic Acid Sequences of Vectors

SEQ ID NO Sequence

AAAAAATTTGGAGACGCCTTTGTGACCCCCCAGATTCTCCATGCACTCATCCATA
ATGATAGCGATGGGGCCGTGGGCAGCGGCACGGGCGAACACGTTGCGGGGGTC
TGAAACATCATAGTTATGCTCCTGAGTCAGGTCATCATAAGCCATTTTAATAAAC
TTTGGGCGGAGGGTGCCAGATTGGGGAATGAAAGTTCCCTCTGGCCCGGGAGCA
TAGTTTCCCTCACATATTTGCATTTCCCAGGCTTTCAGTTCAGAGGGGGGGATCA
TGTCCACCTGCGGGGCTATAAAAAATACCGTTTCTGGAGCCGGGGTGATTAACT
GGGATGAGAGCAAATTCCTAAGCAGCTGAGACTTGCCGCACCCAGTGGGACCGT
AAATGACCCCAATTACGGGTTGCAGATGGTAGTTTAGGGAGCGACAGCTGCCGT
CCTCCCGGAGCAGGGGGGCCACTTCGTTCATCATTTGCCTTACATGGATATTTTC
CCGCACCAAGTCCGTTAGGAGGCGCTCTCCCCCAAGGGATAGAAGCTCCTGGAG
CGAGGAGAAGTTTTTCAGCGGCTTTAGCCCGTCAGCCATGGGCATTTTGGAAAG
AGTCTGTTGCAAAAGCTCGAGCCGGTCCCAGAGCTCGGCGATGTGCTCTATGGC
ATCTCGATCCAGCAGACCTCCTCGTTTCGCGGGTTGGGACGGCTCCTGGAGTAGG
GAATCAGACGATGGGCGTCCAGCGCTGCCAGGGTCCGATCCTTCCATGGTCGCA
GCGTCCGAGTTAGGGTTGTTTCCGTCACGGTGAAGGGGTGCGCGCCTGGTTGGG
CGCTTGCGAGGGTGCGCTTCAGACTCATCCTGCTGGTCGAGAACCGCTGCCGATC
GGCGCCCTGCATGTCGGCCAGGTAGCAGTTTACCATAAGTTCGTAGTTAAGCGC
CTCGGCCGCGTGGCCTTTGGCACGGAGCTTACCTTTGGAAGTTTTATGGCAGGCG
GGGCAGTAGATACATTTGAGGGCATACAGCTTGGGCGCGAGGAAAATGGATTCG
GGGGAGTATGCATCCGCACCGCAGGAGGCGCAGACGGTTTCGCACTCTACGAGC
CAGGTCAGATCCGGCTCATCGGGGTCAAAAACAAGTTTTCCGCCATGTTTTTTGA
TGCGTTTCTTACCTTTGGTTTCCATGAGTTCGTGTCCCCGCTGGGTGACAAAGAG
GCTGTCCGTGTCCCCGTAGACCGACTTTATGGGTCTGTCCTCGAGCGGAGTGCCT
CGGTCCTCTTCGTAGAGGAACCCAGCCCACTCTGATACAAAAGCGCGTGTCCAG
GCCAGCACAAAGGAGGCCACGTGGGAGGGGTAGCGGTCGTTGTCAACCAGGGG
GTCCACCTTCTCTACGGTATGTAAACACATGTCCCCCTCCTCCACATCCAAGAAT
GTGATTGGCTTGTAAGTGTAGGCCACGTGACCAGGGGTCCCCGCCGGGGGGGTA
TAAAAGGGGGCGGGCCTCTGTTCGTCCTCACTGTCTTCCGGATCGCTGTCCAGGA
GCGCCAGCTGTTGGGGTAGGTATTCCCTCTCGAAGGCGGGCATGACCTCTGCACT
CAGGTTGTCAGTTTCTAGGAACGAGGAGGATTTGATATTGACAGTACCAGCAGA
GATGCCTTTCATAAGACTCTCGTCCATTTGGTCAGAAAACACAATCTTCTTGTTG
TCCAGCTTGGTAGCAAATGATCCATAGAGGGCATTGGATAGAAGCTTGGCGATG
GAGCGCATGGTTTGGTTCTTTTCCTTGTCCGCGCGCTCCTTGGCGGCGATGTTAA
GCTGGACGTACTCGCGCGCCACACATTTCCATTCAGGGAAGATGGTTGTCAGTTC
ATCCGGAACTATTCTGACTCGCCATCCCCTATTGTGCAGGGTTATCAGATCCACA
CTGGTGGCCACCTCGCCTCGGAGGGGCTCATTGGTCCAGCAGAGTCGACCTCCTT
TTCTTGAACAGAAAGGGGGAGGGGGTCTAGCATGAGCTCATCAGGGGGGTCCG
CATCTATGGTAAATATTCCCGGTAACAAATCTTTGTCAAAATAGCTAATGGTGGT
GGGATCATCCAAGGTCATCTGCCATTCTCGAACTGCCAGCGCGCGCTCATAGGG
GTTAAGAGGGGTGCCCCAGGGCATGGGGTGGGTGAGCGCGGAGGCATACATGC
CACAGATATCGTATACATAGAGGGGCTCTTCGAGGATGCCGATGTAAGTGGGAT
AACAGCGCCCCCTCTGATGCTTGCTCGCACATAGTCATAGAGTTCATGTGAGGG
GGCGAGAAGACCCGGGCCCAGATTGGTGCGGTTGGGTTTTTCCGCCCTGTAAAC
GATCTGGCGAAAGATGGCATGGGAATTTGAAGAGATAGTAGGTCTCTGGAATAT
GTTAAAATGGGCATGAGGTAGGCCTACAGAGTCCCTTATGAAGTGGGCATATGA
CTCTTGCAGCTTGGCTACCAGCTCGGCGGTGACGAGTACATCCAGGGCACAGTA
GTCGAGAGTTTCCTGGATGATGTCATAACGCGGTTGGCTTTTCTTTTCCCACAGC
TCGCGGTTGAGAAGGTATTCTTCGCGATCCTTCCAGTACTCTTCGAGGGGAAACC
CGTCTTTTTCTGCACGGTAAGAGCCCAACATGTAGAACTGATTGACTGCCTTGTA
GGGACAGCATCCCTTCTCCACTGGGAGAGAGTATGCTTGGGCTGCATTGCGCAG
CGAGGTATGAGTGAGGGCAAAAGTGTCCCTGACCATGACTTTGAGGAATTGATA
CTTGAAGTCCATGTCATCACAGGCCCCCTGTTCCCAGAGTTGGAAGTCCACCCGC
TTCTTGTAGGCGGGGTTGGGCAAAGCGAAAGTAACATCATTGAAGAGGATCTTG
CCGGCCCTGGGCATGAAATTTCGGGTGATTCTGAAAGGCTGAGGGACCTCTGCT
CGGTTATTGATAACCTGAGCGGCCAAGACGATCTCATCAAAGCCATTGATGTTGT
GCCCCACTATGTACAGTTCTAAGAATCGAGGGGTGCCCCTGACATGAGGCAGCT
TCTTGAGTTCTTCAAAAGTGAGATCTGTAGGGTCAGTGAGAGCATAGTGTTCGA
GGGCCCATTCGTGCACGTGAGGGTTCGCTTTGAGGAAGGAGGACCAGAGGTCCA
CTGCGAGTGCTGTTTGTAACTGGTCCCGGTATTGACGAAAATGCTGCCCGACTGC
CATTTTTTCTGGGGTGACGCAATAGAAGGTTTGGGGGTCCTGCCGCCAGCGATCC
CACTTAAGTTTCATGGCGAGGTCATAGGCGATGTTGACGAGCCGCTGGTCTCCA
GAGAGTTTCATGACCAGCATGAAGGGGATTAGCTGCTTGCCAAAGGACCCCATC
CAGGTGTAGGTTTCCACATCGTAGGTGAGGAAGAGCCTTTCTGTGCGAGGATGA
GAGCCAATCGGGAAGAACTGGATCTCCTGCCACCAGTTGGAGGAATGGCTGTTG
ATGTGATGGAAGTAGAACTCCTGCGACGCGCCGAGCATTCATGCTTGTGCTTGT
ACAAACGGCCGCAGTACTCGCAGCGATTCACGGGATGCACCTCATGAATGAGTT
GTACCTGACTTCCTTTGACGAAAATTTCAGTGGAAAATTGAGGCCTGGCGTTTG
TACCTGGCGCTCTACTATGTTGTCTGCATCGGCATGACCATCTTCTGTCTCGATG
GTGGTCATGCTGACGAGCCCTCGCGGGAGGCAAGTCCAGACCTCGGCGCGGCAG
GGGCGGAGCTCGAGGACGAGAGCGCGCAGGCCGGAGCTGTCCAGGGTCCTGAG
ACGCTGCGGAGTCAGGTTAGTAGGCAGTGTCAGGAGATTGACTTGCATGATCTT
TTGGAGGGCGTGAGGGAGGTTCAGATGGTACTTGATCTCCACGGGTCCGTTGGT
GGAGATGTCAATGGCTTGCAGGGTTCCGTGCCCCTTGGGCGCTACCACCGTGCCC
TTGTTTTTCCTTTTGGGCGGCGGTGGCTCTGTTGCTTCTTGCATGTTTAGGAGCGG
TGTCGAGGGCGCGCACCGGGCGGCAGGGGCGGCTCGGACCCGGCGGCATGGC
TGGCAGTGGTACGTCGGCGCCGCGCGCGGGTAGGGTTCTGGTACTGCGCCCTGAG

TABLE 7-continued

Nucleic Acid Sequences of Vectors

SEQ ID NO Sequence

```
AAGACTCGCATGTGCGACGACGCGGCGGTTGACATCCTGGATCTGACGCCTCTG
GGTGAAAGCTACCGGCCCCGTGAGCTTGAACCTGAAAGAGAGTTCAACAGAATC
AATCTCGGTATCGTTGACGGCGGCTTGCCTAAGGATTTCTTGCACGTCGCCAGAG
TTATCCTGGTAGGCGATCTCGACCATGAACTGCTGGATCTCTTCCTCTTGAAGAT
CTCCGCGGCCCGCTCTCTCGACGGTGGCCGCGAGGTCGTTGGAGATGCGCCCAA
TGAGTTGAGAGAATGCATTCATGCCCGCCTCGTTCCAGACGCGGCTGTAGACCA
CAGCCCCCACGGGATCTCTCGCGCGCATAACCACCTGGGCGAGGTTAAGCTCTA
CGTGGCGGGTGAAGACCGCATAGTTGCATAGGCGCTGGAAAAGGTAGTTGAGTG
TGGTGGCGATGTGCTCGGTGACGAAGAAATACATGATCCATCGTCTCAGCGGCA
TCTCGCTGACATCGCCCAGCGCTTCCAAGCGCTCCATGGCCTCGTAGAAGTCCAC
GGCAAAGTTGAAAAACTGGGAGTTACGCGCGGACACGGTCAACTCCTCTTCCAG
AAGACGGATGAGTTCGGCAATGGTGGTGCGCACCTCGCGCTCGAAATCCCCCGG
GATTTCTTCCTCAATCTCTTCTTCTTCCACTAACATCTCTTCCTCTTCAGGTGGGG
CTGCAGGAGGAGGGGGAACGCGGCGACGCCGGCGGCGCACGGGCAGACGGTCG
ATGAATCTTTCAATGACCTCTCCGCGGCGGCGGCGCATGGTCTCGGTGACGGCA
CGACCGTTCTCCCTGGGTCTCAGAGTGAAGACACCTCCGCGCATCTCCCTGAAGT
GGTGACTGGGAGGCTCTCCGTTGGGCAGGGACACCGCGCTGATTATGCATTTTAT
CAATTGCCCCGTAGGTACTCCGCGCAAGGACCTGATCGTTTCAAGATCCACGGG
ATCTGAAAACCTTTCGACGAAAGCGTCTAACCAGTCGCAATCGCAAGGTAGGCT
GAGCACTGTTTCTTGCGGGCGGGGGCGGCTAGACGCTCGGTCGGGGTTCTCTCTT
TCTTTTCCTTCCTCCTCTTGGGAGGATGAGACGATGCTGCTGGTGATGAAATTAA
AATAGGCAGTTTTGAGACGGCGGATGGTGGCGAGGAGCACCAGGTCTTTGGGTC
CGGCTTGTTGGATGCGCAGGCGATGGGCCATTCCCCAAGCATTATCCTGACATCT
GGCCAGATCTTTATAGTAGTCTTGCATGAGTCGTTCCACGGGCACTTCTTCTTCG
CCCGCTCTGCCATGCATGCGAGTGATCCCGAACCCGCGCATGGGCTGGACAAGT
GCCAGGTCCGCTACAACCCTTTCGGCGAGGATGGCTTGCTGCACCTGGGTGAGG
GTGGCTTGGAAGTCGTCAAAGTCTACAAAGCGGTGGTAGGCCCCGGTGTTGATT
GTGTAGGAGCAGTTGGCCATGACTGACCAGTTGACTGTCTGGTGCCCAGGGCGC
ACGAGCTCGGTGTACTTGAGGCGCGAGTATGCGCGGGTGTCAAAGATGTAATCG
TTGCAGGTGCGCACCAGGTACTGGTAGCCGATGAGAAAGTGTGGCGGTGGCTGG
CGGTACAGGGGCCATCGCTCTGTAGCCGGGGCTCCGGGGGCAAGGTCTTCCAGC
ATGAGGCGGTGGTAACCGTAGATGTACCTGGACATCCAGGTGATACCGGAGGCG
GTGGTGGATGCCCGCGGGAACTCGCGTACGCGGTTCCAGATGTTGCGCAGCGGC
ATGAAGTAGTTCATGGTAGGCACGGTTTGGCCCGTGAGACGTGCACAGTCGTTG
ATGCTCTAGACATACGGGCAAAAACGAAAGCGGTCAGCGGCTCGTCTCCGTGGC
CTGGAGGCTAAGCGAACGGGTTGGGCTGCGCGTGTACCCCGGTTCGAATCTCGG
ATCAGGCTGGAGCCGCAGCTAACGTGGTACTGGCACTCCCGTCTCGACCCAGGC
CTGCACAAAACCTCCAGGATACGGAGGCGGGTCGTTTTTTTGCTTTTTCCTGGAT
GGGAGCCAGTGCTGCGTCAAGCTTTAGAACACTCAGTTCTCGGGGCTGGGAGTG
GCTCGCGCCCGTAGTCTGGAGAATTAATCGCCAGGGTTGCGTTGCGGTGTGCCCC
GGTTCGAGTCTTAGCGCGCCGGATCGGCCGGTTTCCGCGACGTTTCTAAGACCCC
GCCAGCCGACTTCTCCAGTTTACGGGAGCGAGCCCTTCTTTTTTTTTTTGTTTTT
TTTGTTTGCCCAGATGCATCCCGTGCTGCGACAGATGCGCCCCCAGCAACAGCCC
CCTTCTCAGCAGCAGCTACAACGACAGCCACAAAAGGCTCTTCCTGCTCCTGTAA
CTACTGCGGCTGCAGCCGTCAGCGGCGCGGGACAGCCCGCCTATGATCTGGAAT
TGGAAGAGGGCGAGGGACTGGCGCGCCTGGGCGCACCATCGCCCGAGCGGCAC
CCGCGGGTGCAACTGAAAAAGGACTCTAGCGAGGCGTACGTGCCCCAGCAGAA
CCTGTTCAGGGACAGGAGCGGTGAGGAGCCAGAGGAGATGCGAGCATCTCGATT
TAACGCGGGTCGCGAGCTGCGCCACGGTCTGGATCGAAGACGGGTGCTGCAAGA
CGAGGATTTTGAGGTCGATGAAGTGACAGGGATCAGCCCAGCTAGGGCACATGT
GGCCGCGGCCAACCTAGTCTCAGCCTACGAGCAGACCGTGAAGGAGGAGCGCA
ACTTCCAAAAATCTTTTAACAACCATGTGCGCACCCTGATCGCCCGCGAGGAAG
TGACCCTGGGTCTGATGCATCTGTGGGACCTGATGGAGGCTATCACCCAGAACC
CCACTAGCAAACCCCTGACAGCTCAGCTGTTTCTGGTGGTTCAACATAGCAGGG
ACAACGAGGCATTCAGGGAGGCGTTGTTGAACATCACCGAGCCTGATGGGAGAT
GGCTGTATGATCTGATCAACATCCTGCAAAGTATTATAGTGCAGGAACGTAGCC
TGGGTTTGGCTGAGAAAGTGGCAGCTATCAACTACTCGGTCTTGAGCCTGGGCA
AATACTACGCTCGCAAGATCTACAAGACCCCCTACGTACCCATAGACAAGGAGG
TAAAGATAGATGGGTTTTACATGCGCATGACTCTCAAGGTGCTGACTTTGAGCG
ACGATCTGGGGGTGTATCGCAATGACAGGATGCACCGTGCGGTGAGCGCCAGCA
GGAGGCGCGAGCTGAGCGACAGAGAACTTATGCACACGTTGCAAAGAGCTCTA
ACGGGGGCTGGGACCGATGGGGAGAACTACTTTGACATGGGAGCGGACTTGCA
ATGGCAACCCAGTCGCAGGGCCATGGAGGCTGCAGGGTGTGAGCTTCCTTACAT
AGAAGAGGTGGATGAAGTCGAGGACGAGGAGGGCGAGTACTTGGAAGACTGAT
GGCGCGACCCGTATTTTTGCTAGATGGAACAGCAGCAGGCACCGGACCCCGCAA
TGCGGGCGGCGCTGCAGAGCCAGCCGTCCGGCATTAACTCCTCGGACGATTGGA
CCCAGGCCATGCAACGCATAATGCGCTGACGACCCGCAACCCCGAAGCCTTTA
GACAGCAACCCCAGGCCAACCGCCTTTCGGCTATACTGGAGGCCGTAGTGCCCT
CCCGCTCCAACCCCACCCACGAGAAGGTCCTGGCTATCGTGAACGCGCTGGTGG
AGAACAAGGCCATCCGTCCCGATGAGGCCGGGCTGGTATACAATGCTCTCTTGG
AGCGCGTGGCCCGTTACAACAGCAGCAACGTGCAGACCAACCCTGACCGGCATG
TGACCGATGTGCGCGAGGCCGTGTCTCAGCGCGAGCGGTTCCAGCGCGACGCCA
ACTTGGGATCGTTGGTAGCGCTAAACGCTTTCCTCAGCACCCAGCCCGCTAACGT
GCCCCGTGGTCAGCAAGACTATACAAACTTTTTGAGTGCATTGAGACTCATGGTA
GCTGAGGTGCCTCGAGCGAGGTGTACCAGTCCGGGCCAGATTACTTCTTCCAG
ACCAGCAGACAGGGCTTGCAGACAGTGAACCTGACTCAGGCTTTCAAGAACCTG
```

TABLE 7-continued

Nucleic Acid Sequences of Vectors

SEQ ID NO Sequence

AAGGGTCTCTGGGGAGTGCACGCCCCAGTAGGGGATCGCGCGACCGTGTCTAGC
TTGCTGACTCCCAACTCCCGCCTGCTGCTGCTGCTGGTATCCCCCTTTACTGACA
GCGGTAGCATCGACCGCAACTCGTACTTGGGCTACCTGCTTAACCTGTATCGCGA
GGCCATAGGGCAGAGCCAGGTGGACGAGCAGACCTATCAAGAAATCACCCAAG
TGAGCCGCGCCCTGGGTCAGGAAGACACGGGCAGTTTGGAAGCCACCCTGAACT
TCTTGCTAACCAACCGGTCGCAGAAGATCCCTCCTCAGTATGCGCTTACCGCTGA
GGAGGAGCGGATCCTCAGATACGTGCAACAGAGCGTTGGACTGTTTCTGATGCA
GGAGGGGGCGACACCTACCGCCGCGCTGGACATGACAGCTCGAAACATGGAGC
CCAGCATGTATGCTAGTAACAGGCCTTTCATTAACAAACTGCTGGACTACCTGCA
CAGGGCGGCCGCCATGAACTCTGATTATTTCACCAATGCTATCCTGAACCCACAC
TGGCTGCCCCCACCTGGTTTCTACACTGGCGAGTACGACATGCCCGACCCCAATG
ACGGGTTCCTGTGGGACGATGTGGACAGCAGCATATTCTCCCCGCCTCCCGGTTA
TACAGTTTGGAAGAAGGAAGGGGGCGATAGAAGACACTCTTCCGTGTCGCTGTC
CAGAACGGCTGGTGCTGCCGCCACCGTGCCCGAAGCTGCAAGTCCTTTCCCTAG
CTTGCCCTTTTCACTAAACAGCGTTCGCAGCAGTGAACTGGGGAGAATAACCCG
CCCCGCGCTTGATGGGCGAGGATGAGTACTTGAATGACTCTTTGTTGAGGCCAGA
GAGGGAAAAGAACTTCCCCAACAATGGAATAGAGAGCCTGGTGGATAAGATGA
GTAGATGGAAGACCTATGCGCAGGATCACAGAGACGAGCCCAAAATCTTGGGG
GCTACAAGCAGACCGACCCGTAGACGCCAGCGCCACGACAGACAGATGGGTCTT
GTGTGGGACGATGAGGACTCTGCCGATGATAGCAGCGTGTTGGACTTGGGTGGA
AGAGGAGGGGGCAACCCGTTCGCTCATCTGCGTCCCAGATTCGGGCGCATGTTG
TAAAAGTGAAAGTAAAATAAAAATGCAACTCACCAAGGCCATGGCGACCGAGC
GTGCGTTCGTTCTTTTTTGTATCTGTGTTTAGTACGATGAGGAGACGAGCCGTGC
TAGGCGGAGCGGTGGTGTATCCGGAGGGTCCTCCTCCTTCTTACGAGAGCGTGA
TGCAGCAACAGGCGGCGATGCTACAGCCCCCACTGGAGGCTCCCTTCGTACCCC
CGCGGTACCTGGCGCCTACGGAAGGGAGAAACAGCATTCGTTACTCGGAGCTGT
CGCCTCTGTACGATACCACCAAGTTGTATCGGTGGACAACAAGTCGGCGGACA
TTGCCTCCCTGAACTATCAGAACGACCACAGCAACTTCCTGACCACGGTGGTGC
AGAACAATGACTTTACCCCCACGGAGGCTAGCACCCAGACCATCAACTTTGACG
AGCGGTCGCGATGGGGCGGTCAGCTGAAGACCATCATGCACACCAACATGCCCA
ACGTGAACGAGTACATGTTCAGCAACAAGTTCAAGGCGAGGGTGATGGTGTCCA
GAAAAGCTCCTGAAGGTGTTATAGTAAATGACACCTATGATCATAAAGAGGATA
TCTTAAAGTATGAGTGGTTTGAGTTCACTTTACCAGAAGGCAACTTCTCAGCCAC
CATGACCATTGACCTGATGAACAATGCCATCATTGACAACTACCTGGAAATTGG
CAGACAAAATGGAGTGCTGGAAAGTGACATTGGTGTTAAGTTTGACACTAGAAA
CTTTAGGCTCGGGTGGGACCCCGAAACTAAGTTGATTATGCCAGGAGTCTACAC
TTATGAGGCATTCCATCCTGACATTGTATTGCTGCCTGGTTGCGGGGTAGACTTT
ACTGAAAGCCGACTTAGCAACTTGCTTGGCATCAGGAAAAGACATCCATTCCAG
GAGGGTTTCAAAATCATGTATGAAGATCTTGAAGGGGGTAATATTCCTGCCCTTT
TGGATGTCACTGCCTATGAGGAAAGCAAAAAGGATACCACTACTGAAACAACCA
CACTGGCTGTTGCAGAGGAAACTAGTGAAGATGATAATATAACTAGAGGAGATA
CTTATATAACTGAAAAACAAAAACGTGAAGCTGCAGCTGCTGAAGTTAAAAAAG
AGTTAAAGATCCAACCTCTAGAAAAAGACAGCAAGAGTAGAAGCTACAATGTCT
TGGAAGACAAAATCAACACGGCCTACCGCAGCTGGTACCTGTCCTACAATTACG
GTAACCCCGAGAAAGGAATAAGGTCTTGGACACTGCTTACCACTTCAGATGTCA
CCTGTGGGGCAGAGCAGGTCTACTGGTCGCTCCCTGACATGATGCAAGACCCAG
TCACCTTCCGCTCCACAAGACAAGTCAACAACTACCCAGTGGTGGGTGCAGAGC
TTATGCCCGTCTTCTCAAAGAGTTTCTACAATGAGCAAGCCGTGTACTCTCAGCA
GCTCCGACAGGCCACTTCGCTCACGCACGTCTTCAACCGCTTCCCTGAGAACCAG
ATCCTCATCCGCCCGCCGGCGCCCACAATTACCACCGTCAGTGAAAACGTTCCTG
CTCTCACAGATCACGGGACCCTGCCGTTACGCAGCAGTATCCGGGGAGTCCAGC
GCGTGACCGTTACTGACGCCAGACGCCGCACCTGTCCCTACGTTTACAAGGCCCT
GGGCATAGTCGCGCCGCGCGTTCTTTCAAGCCGCACTTTCTAAAAAAAAAAAAAT
GTCCATTCTCATCTCGCCCAGTAATAATACCGGTTGGGGACTGTATGCGCCCACC
AAGATGTATGGAGGCGCCCGCATACGCTCTACCCAGCACCCTGTGCGCGTTCGC
GGTCATTTCCGCGCTCCATGGGGCGCACTCAAGGGTCGTACCCGCACTCGGACC
ACGGTCGATGATGTGATCGACCAGGTGGTCGCCGATGCTCGTAATTATACTCCTA
CTGCGCCTACATCTACTGTGGATGCAGTTATTGACAGTGTGGTGGCAGACGCCCG
CGCCTATGCTCGCCGGAAGAGCCGAAGGAGGCGCATTGCCAGGCGCCACAGGG
CTACTACCGCCATGCGAGCTGCAAAAGCTATTCTGCGGAGGGCAAACGTGTGG
GGCGAAGAGCCATGCTTAGAGCGGCCAGACGCGCGGCTTTAGGTGCCAGCAGCG
GCAGGTCCCGCAGGCGCGCGGCCACGGCGGCAGCAGCGGCCATTGCCAACATG
GCCCAACCGCGAAGAGGCAATGTGTACTGGGTGCGTGATGCCACTACCGGCCAG
CGCGTGCCTGTGCGCACCCGCCCCCTCGCACTTAGAAGATACTGAGCAGTCTCC
GATGTTGTGTCCCAGCGGCAAGTATGTCCAAGCGCAAATACAAGGAAGAGATGC
TCCAGGTCATCGCGCCTGAAATCTACGGTCCACCGGTGAAGGATGAAAAAAAGC
CCCGCAAAATCAAGCGGGTCAAAAATAACAAAAAGGAAGAAGATGACGATGAT
GGGCTGGTGGAGTTTGTGCGCGAGTTCGCCCCAAGACGGCGCGTGCAGTGGCGC
GGGCGCAAAGTGCGTCAAGTGCTCAGACCCGGAACCACTGTGGTTTTTACACCT
GGCGAGCGTTCCAGCACTACTTTTAAACGGTCCTATGATGAGGTGTACGGGGAT
GACGATATTCTTGAGCAGGCGGCAGACCGCCTTGATGAGTTTGCTTATGGCGAG
CGCACTAGATCCAGTCCCAAAGAGGAGGCTGTGTCCATTCCCTTGGATCATGGA
AATCCCACCCCCAGCCTCAAACCAGTCACCTTGCAGCAAGTGCTGCCCGTGCCTG
CGCGGAGAGGCGTAAAGCGCGAGGGTGAGGACCTATATCCTACCATGCAGCTAA
TGGTGCCCAAGCGCCAGAGGCTAGAAGACGTACTGGAGAAAATGAAAGTGGAT
CCCGATATCCAGCCTGAGGTCAAAGTAAGACCTATCAAGGAAGTGGCGCCAGGT

TABLE 7-continued

Nucleic Acid Sequences of Vectors

SEQ ID NO Sequence

TTGGGAGTACAAACCTTCGACATCAAGATTCCCACCGAGTCCATGGAAGTGCAG
ACCGAACCTGCAAAACCCACAACCACCTCAATTGAGGTGCAAACGGAACCCTGG
ACGCCCGCGCCCGTTGTCGCCCCCAGCACCACTCGAAGATCACGACGAAAGTAC
GGCCCAGCAAGTCTTCTAATGCCCAACTATGCTCTGCACCCATCCATCATTCCCA
CTCCGGGTTACAGAGGCACTCGCTACTATCGAAACCGGAGCAACACCTCTCGCC
GCCGCAAACCACCTGCAAGTCGCACTCGCAGTCGCCGCCGCCGCAACACTGCCA
GCAAAGTGACTCCCGCCGCCCTGGTGCGGAGAGTGTACCGCGATGGTCGCGCTG
AACCTCTGACGCTGCCGCGCGCGCGCTACCATCCAAGCATCACCACTTAATGACT
GTTGACGCTGCCTCCTTGCAGATATGGCCCTCACTTGCCGCCTTCGCGTCCCCAT
TACTGGCTACCGAGGAAGAAACTCGCGCCGTAGAAGGATGTTGGGGCGAGGGA
TGCGCCGCCACAGACGAAGGCGCGCTATCAGCAGACGATTAGGGGGTGGCTTTT
TGCCAGCTCTTATACCCATCATCGCCGCAGCGATCGGGGCGATACCAGGCATAG
CTTCCGTGGCGGTTCAGGCCTCGCAGCGCCACTAACATTGGAAAAAACTTATAA
ATAAAAAATAGAATGGACTCTGACGCTCCTGGTCCTGTGACTATGTTTTTGTAGA
GATGGAAGACATCAATTTTTCATCCCTGGCTCCGCGACACGGCACGAGGCCGTA
CATGGGCACCTGGAGCGACATCGGCACGAGCCAACTGAACGGGGCGCCTTCAA
TTGGAGCAGTATCTGGAGCGGGCTTAAAAATTTTGGCTCGACCGTAAAAACCTA
TGGGAACAAAGCTTGGAACAGCAGCACAGGGCAGGCTCTGAGAAATAAGCTTA
AGGAACAAAACTTCCAACAGAAGGTGGTCGATGGGATCGCCTCTGGTATTAACG
GCGTAGTGGATTTGGCCAACCAGGCTGTACAAAAACAGATAAACAGCCGCCTGG
ACCCGCCGCCCGCAACCCCTGGTGAAATGGAAGTGGAGGAAGAACTTCCTCCGC
TGGAAAAGCGGGGCGACAAGCGTCCGCGACCCGAGCTGGAGCAGACACTGGTG
ACGCGCGCAGACGAGCCCCCTTCATACGAGGAGGCAGTAAAGCTCGGAATGCCC
ACTACCAGGCCTGTAGCTCACATGGCTACCGGGGTAATGAAACCTTCTCAGACA
CATCGACCCGCCACCTTGGACTTGCCTCCTCCCCCTGCTTCTGCGGCACCTGTTCC
CAAACCTGTCGCTACCAGAAAGCCCACCGCCGTACAGCCCGTCGCCGTAGCCAG
ACCGCGTCCTGGGGCACACCGCGCCCGAAAGCAAACTGGCAAAGTACTCTGAA
CAGCATCGTGGGTCTGGGCGTGCAGAGTGTAAAGCGCCGTCGCTGCTATTAATT
AAATATGGAGTAGCGCTTAACTTGCTTGTCTGTGTGTATGTATCATCACCACGCC
GCCGCAGCAGAGGAGAAAGGAAGAGGTCGCGCGCCGAGGCTGAGTTGCTTTCA
AGATGGCCACCCCATCGATGATGCCCCAATGGGCATACATGCACATCGCCGGAC
AGGATGCTTCGGAGTACCTGAGTCCGGGTCTGGTGCAGTTCGCCCGTGCAACAG
ACACCTACTTCAGTATGGGGAACAAGTTTAGAAACCCCACAGTGGCGCCCACCC
ACGATGTGACCACCGACCGTAGCCAGCGACTGATGCTGCGCTTCGTGCCCGTTG
ACCGGGAGGACAATACATACTCTTACAAAGTGCGGTACACCCTCGCCGTGGGCG
ACAACAGAGTGCTTGACATGGCCAGCACATTCTTTGACATTAGGGGGTGCTTG
ATAGAGGTCCTAGCTTCAAGCCATATTCCGGCACAGCTTACAATTCACTGGCTCC
TAAGGGCGCGCCTAACACATCTCAGTGGATAGTTACAACGGGAGAAGACAATGC
CACCACATACACATTTGGCATTGCTTCCACGAAGGGAGACAATATTACTAAGGA
AGGTTTAGAAATTGGGAAAGACATTACTGCAGACAACAAGCCCATTTATGCCGA
TAAAACATATCAGCCAGAGCCTCAAGTTGGAGAAGAATCATGGACTGATATTGA
TGGAACAAATGAAAAATTTGGAGGTAGAGCTCTTAAACCAGCTACTAAAATGAA
GCCATGCTACGGGTCTTTTGCAAGACCTACAAACATAAAAGGGGCCAAGCTAA
AAACAGAAAAGTAACACCAACCGAAGGAGATGTTGAAGCTGAGGAGCCAGATA
TTGATATGGAATTTTTCGATGGTAGAGAAGCTGCTGACGCTTTTTCGCCTGAAAT
TGTGCTTTACACGGAAAATGTCAATTTGGAAACTCCAGACAGCCATGTGGTATA
CAAGCCAGGAACTTCTGATGGTAACTCTCATGCAAATTTGGGTCAACAAGCCAT
GCCTAACAGACCCAATTACATTGGCTTCAGGGATAACTTTGTAGGTCTTATGTAC
TACAACAGTACTGGAAATATGGGAGTTTTGGCCGGCCAAGCATCACAACTGAAT
GCAGTGGTTGACTTGCAGGACAGAAACACTGAACTGTCATATCAGCTTTTGCTTG
ATTCTCTGGGAGACAGAAGCAGATACTTCAGCATGTGGAATCAGGCTGTGGACA
GCTATGATCCCGATGTTCGTATTATTGAAAATCATGGCGTCGAGGATGAACTGCC
TAATTACTGTTTTCCTCTGGATGGCATAGGACCAGGGAACAAATATCAAGGCATT
AAACCTAGAGACACTGCATGGGAAAAAGATACTAAAGTTTCTACAGCTAATGAA
ATAGCCATAGGCAACAATCTGGCTATGGAAATTAATATCCAAGCTAATCTTTGG
AGAAGTTTTCTGTACTCCAATGTGGCTTTGTACCTTCCAGATGTTTACAAGTACA
CGCCAACTAACATTACTCTGCCCGCTAACACCAACACCTATGAGTACATGAACG
GGCGAGTGGTTTCCCCATCTCTGGTCGATTCATACATCAACATTGGCGCCAGGTG
GTCTCTTGACCCAATGGACAATGTGAATCCATTTAACCACCACCGCAATGCTGGC
CTACGCTACCGGTCCATGCTTCTGGGCAATGGCCGTTATGTGCCTTTCCACATAC
AAGTGCCTCAAAAATTCTTTGCTGTCAAGAACCTACTTCTTCTACCTGGCTCCTA
CACCTATGAGTGGAACTTCAGAAAGGATGTGAACATGGTCCTGCAAAGTTCCCT
TGGAAATGACCTCAGAACAGATGGTGCTACCATAAGTTTCACCAGCATCAACCT
CTATGCCACCTTCTTCCCCATGGCTCACAACACCGCTTCAACTCTTGAAGCCATG
CTGCGCAACGATACCAATGATCAGTCATTCAACGACTACCTCTCTGCAGCTAACA
TGCTTTACCCCATCCCTGCCAATGCAACCAACATTCCAATTTCCATCCCATCTCG
CAACTGGGCAGCCTTCAGGGGCTGGTCCTTCACCAGACTCAAAACCAAGGAGAC
TCCATCTCTTGGATCAGGGTTCGATCCCTACTTCGTTTATTCTGGATCTATTCCCT
ACCTGGATGGCACTTTTTACCTTAACCACACTTTCAAGAAGGTCTCCATCATGTT
TGACTCCTCAGTCAGCTGGCCTGGCAATGACAGGCTGTTGTCTCCAAATGAGTTT
GAAATCAAGCGCACTGTGGATGGGGAAGGATACAATGTGGCCCAATGCAACAT
GACCAAAGACTGGTTCCTGGTTCAGATGCTTGCCAACTACAACATTGGCTACCA
GGGCTTTTACATCCCTGAGGGATACAAGGATCGCATGTACTCCTTTTTCAGAAAC
TTCCAGCCTATGAGCAGGCAGGTGGTTGATGAGGTTAATTACACTGACTACAAA
GCCGTCACCTTACCATATCAACACAACAACTCTGGCTTTGTAGGATACCTTGCGC
CTACTATGAGACAAGGGGAACCTTACCCAGCCAATTATCCATACCCGCTCATCG

TABLE 7-continued

Nucleic Acid Sequences of Vectors

SEQ ID NO Sequence

```
GAACTACTGCCGTTAAAAGTGTTACCCAAAAAAAGTTCCTGTGCGACAGGACCA
TGTGGCGCATACCGTTCTCCAGCAACTTCATGTCCATGGGAGCCCTTACGGACCT
GGGACAGAACCTGCTCTATGCCAACTCGGCCCATGCGCTGGACATGACTTTTGA
GGTGGATCCCATGGATGAGCCCACCCTGCTTTATCTTCTTTTCGAAGTCTTCGAC
GTGGTCAGAGTGCACCAGCCACACCGCGGCGTCATCGAGGCCGTCTACCTGCGC
ACACCGTTCTCGGCCGGCAACGCCACCCACATAAGAAGCCTCTTGCTTCTTGCAAG
CAGCAGCTGCAGCCATGTCATGCGGGTCCGGAAACGGCTCCAGCGAGCAAGAGC
TCAAAGCCATCGTCCGAGACCTGGGTTGCGGACCCTATTTCCTGGGAACCTTTGA
CAAGCGTTTCCCGGGGTTCATGGCCCCCGACAAGCTCGCCTGCGCCATAGTCAA
CACTGCCGGACGCGAGACGGGGGGAGAGCACTGGCTGGCTTTTGGTTGGAACCC
GCGCTCCAACACCTGCTACCTTTTTGATCCTTTTGGGTTCTCGGATGAGCGACTC
AAACAGATTTACCAGTTTGAGTACGAGGGGCTCCTGCGCCGCAGTGCCCTTGCT
ACCAAAGACCGCTGCATCACCCTGGAAAAGTCCACCCAGAGCGTGCAGGGCCCA
CGCTCAGCCGCCTGTGACTTTTTTGCTGTATGTTCCTTCATGCCTTTGTGCACTG
GCCCGACCGCCCCATGAACGGAAACCCCACCATGAAGTTGCTGACTGGGGTGCC
CAACAGCATGCTCCAATCTCCCCAAGTGCAGCCCACCCTGCGCCGCAACCAGGA
GGCGCTATATCGCTTCCTAAACACCCACTCATCTTACTTTCGTTCTCACCGCGCA
CGCATCGAAAGGGCCACCGCGTTTGACCGTATGGATATGCAATAAGTCATGTAA
AACCGTGTTCAATAAAAAGCACTTTATTTTTACATGCACTAAGGCTCTCGTTTTTT
ACTCATTCGTTTTCATTATTCACTCAGAAATCAAATGGGTTCTGCGGGAGTCAA
AGTGACCCGCGGGCAGGGATACGTTGCGGAACTGTAACCTGTTCTGCCACTTGA
ACTCGGGGATCACCAACTTGGGAACTGGAATCTCGGGAAAGGTGTCTTGCCACA
ACTTTCTGGTCAGCTGCAGGGCGCCAAGTAGGTCAGGAGCAGAGATCTTGAAAT
CACAGTTGGGACCGGCATTCTGGACACGGGAGTTGCGGTACACTGGGTTGCAAC
ACTGGAACACCATCAAGGCTGGGTGTCTCACGCTTGCCAGCACGGTCGGGTCAC
TGATGGTAGTCACATCCAAGTCTTCAGCATTGGCCATCCCAAAGGGGGTCATCTT
ACAGGTCTGCCTGCCCATCACGGGAGCGCAGCCTGGCTTGTGGTTGCAATCGCA
ATGAATGGGGATCAGCATCATCCTGGCTTGGTCGGGGGTTATCCCTGGGTACAC
GGCCTTCATGAAGGCTTCGTACTGCTTGAAAGCTTCCTGAGCCTTACTTCCCTCG
GTATAGAACATCCCACAGGACTTGCTGGAAAATTGATTAGTAGCACAGTTGGCA
TCATTTACACAGCAGCGGGCATCGTTGTTGGCCAACTGGACCACATTTCTGCCCC
AGCGGTTCTGGGTGATCTTGGCTCTGTCTGGGTTCTCCTTCATAGCGCGCTGTCC
GTTCTCGCTCGCCACATCCATCTCGATAATGTGGTCCTTCTGAATCATGATAGTG
CCATGCAGGCATTTCACCTTGCCTTCATAATCGGTGCATCCATGAGCCCACAGAG
CGCACCCGGTGCACTCCCAACTATTGTGGGCGATCTCAGAATAAGAATGTACCA
ATCCCTGCATGAATCTTCCCATCATCGCTGTCAGGGTCTTCATGCTACTAAATGT
CAGCGGGATGCCACGGTGCTCCTCGTTCACATACTGGTGGCAGATACGCTTGTAC
TGCTCGTGCTGCTCTGGCATCAGCTTGAAAGAGGTTCTCAGGTCATTATCCAGCC
TGTACCTCTCCATTAGCACAGCCATCACTTCCATGCCCTTCTCCCAGGCAGATAC
CAGGGGCAAGCTCAAAGGATTCCTAACAGCAATAGAAGTAGCTCCTTTAGCTAT
AGGGTCATTCTTGTCGATCTTCTCAACACTTCTCTTGCCATCCTTCTCAATGATGC
GCACCGGGGGTAGCTGAAGCCCACGGCCACCAACTGAGCCTGTTCTCTTTCTTC
TTCGCTGTCGTGGCCGATGTCTTGCAGAGGGACATGCTTGGTCTTTCTGGGCTTC
TTCTTGGGAGGGATCGGGGGAGGACTGTTGCTCCGTTCCGGAGACAGGGATGAC
CGCGAAGTTTCGCTTACCAGTACCACCTGGCTCTCGATAGAAGAATCGGACCCC
ACGCGACGGTAGGTGTTCCTCTTCGGGGGCAGAGGTGGAGGCGACTGAGATGGG
CTGCGGTCTGGCCTTGGAAGCGGATGGCTGACAGAGCCCATTCCGCGTTCGGGG
GTGTGCTCCCGTTGGCGGTCGCTTGACTGATTTCCTCCGCGGCTGGCCATTGTGT
TCTCCTAGGCAGAGAAACAACAGACATGGAAACTCAGCCATCACTGCCAACATC
GCTGCAAGCGCCATCACACCTCGCCCCCAGCAGCGACGAGGAGGAGAGCTTAAC
CACCCCACCACCCAGTCCAGCTACCACCACCTCTACCCTCGATGATGAGGAGGA
GGAGGTCGACGCAGCCCAGGAGATGCAGGCGCAGGATAATGTGAAAGCGGAAG
AGATTGAGGCAGATGTCGAGCAGGACCCGGGCTATGTGACACCGGCGGAGCAC
GAGGAGGAGCTGAAACGTTTTCTAGACAGAGAGGATGACGACCGCCCAGAGCA
TCAAGCAGATGGCGATCACCAGGAGGCTGGCATCGGGGATCAAGTTGCCGACTA
CCTCACCGGGCTTGGGGGGAAGACGTGCTCCTCAAACATCTAGCAAGGCAGTC
GAACATAGTTAAAGACGCACTACTCGACCTCACCGAAGTGCCCATCAGTGTGGA
AGAGCTTAGCCGCGCCTACGAGCTGAACCTCTTTTCGCCTCACATACCCCCCAAG
CGGCAGCCAAACGGCACCTGCGAGGCCAACCCTCGACTGAACTTCTATCCAGCT
TTTACTGTCCCCGAAGTGCTGGCCACCTACCACATCTTTTTTAAGAACCAAAAGA
TTCCAGTCTCCTGCCGCGCCAACCGCACCCGCGCCGATGCCCTTCTCAACTTGGG
TCCGGGAGCTCGCTTACCTGATATAGCTTCCTTGGAAGAGGTTCCAAAAATCTTT
GAGGGTCTGGGAAGTGATGAGACTCGGGCCGCAAATGCTCTGCAACAGGGAGA
GAATGGCATGGATGAACATCACAGCGCTTTAGTGGAACTGGAGGGTGACAATGC
CCGGCTTGCAGTGCTCAAGCGCAGTATCGTGGTCACCCATTTTGCCTACCCCGCT
GTTAACCTGCCCCCCAAAGTTATGAGCGCTGTTATGGACCATCTGCTCATCAAAC
GAGCAAGACCCCTTTCAGAAAACCAGAACATGCAGGATCCAGACGCCTCGGACG
AGGGCAAGCCGGTAGTCAGTGACGAGCAGCTATCTCGCTGGCTGGGTACCAACT
CCCCCCGAGATTTGGAAGAGAGGCGCAAGCTTATGATGGCTGTAGTGCTAGTAA
CTGTGGAGCTGGAGTGTCTGCGCCGCTTTTTCACCGACCCTGAGACCCTGCGCAA
GCTAGAGGAGAACCTGCACTACACCTTTAGACATGGCTTCGTGCGGCAGGCATG
CAAGATCTCCAACGTGGAGCTTACCAACCTGGTTTCTTACATGGGCATTTTGCAT
GAGAACCGGCTAGGGCAGAGCGTCCTGCACACCACCCTTAAAGGGGAGGCCCG
CCGTGACTACATCCGAGACTGTGTCTACCTTTACCTCTGCCATACCTGGCAGACT
GGCATGGGTGTGTGGCAACAGTGTTTGGAAGAGCAGAACCTAAAAGAGCTGGA
CAAGCTCTTGCAAAGATCCCTCAAAGCCCGTGGACAGGTTTTGATGAGCGCAC
```

TABLE 7-continued

Nucleic Acid Sequences of Vectors

| SEQ ID NO | Sequence |
|---|---|
| | CGTCGCCTCGGACCTGGCAGACATCATCTTCCCCGAGCGTCTCAGGGTTACTCTG
CGAAACGGCCTGCCAGACTTTATGAGCCAGAGCATGCTTAACAACTTTCGCTCTT
TCATCCTGGAACGCTCCGGTATCCTGCCTGCCACCTGCTGTGCGCTGCCCTCCGA
CTTTGTGCCTCTCACCTACCGCGAGTGCCCACCGCCGCTATGGAGCCACTGCTAC
CTGTTCCGCCTGGCCAACTACCTCTCCTACCACTCGGATGTTATAGAGGATGTGA
GCGGAGACGGTCTGCTGGAATGCCACTGCCGCTGCAATCTTTGCACACCCCACC
GCTCCCTTGCCTGCAACCCCCAGTTGCTGAGCGAGACCCAGATCATCGGCACCTT
CGAGTTGCAGGGTCCCAGCAGTGAAGGCGAGGGGTCTTCTCCGGGGCAGAGTCT
GAAACTGACACCGGGGCTGTGGACCTCCGCCTACCTGCGCAAGTTTCATCCCGA
GGATTACCACCCCTATGAGATCAGGTTCTATGAGGACCAGTCACATCCTCCCAA
AGTCGAGCTCTCAGCCTGCGTCATCACCCAGGGAGCAATTCTGGCCCAATTGCA
AGCCATCCAAAAATCCCGCCAAGAATTTCTACTGAAAAAGGGAAGCGGGGTCTA
CCTTGACCCCCAGACCGGTGAGGAGCTCAACACAAGGTTCCCCCAGGATGTCCC
ATCGCCGAGGAAGCAAGAAGCTGAAGGTGCAGCTGACGCCCCCAGAGGATATG
GAGGAAGACTGGGACAGTCAGGCAGAGGAGGAGATGGAAGATTGGGACAGCCA
GGCAGAGGAGGTGGACAGCCTGGAGGAAGACAGTTTGGAGGAGGAAGACGAGG
AGGCAGAGGAGGTGGAAGAAGCAACCGCCGCCAAACAGTTGTCATCGGCGGCG
GAGACAAGCAAGTCCCCAGACAGCAGCACGGCTACCATCTCCGCTCCGGGTCGG
GGGGTCCAGCGGCGGCCCAACAGTAGATGGGACGAGACCGGGCGATTCCCAAA
CCCGACCACCGCTTCCAAGACCGGTAAGAAGGAGCGACAGGGATACAAGTCCTG
GCGTGGACACAAAAACGCTATCATCTCCTGCTTGCATGAATGCGGGGGCAACAT
ATCCTTCACCCGGCGATACCTGCTCTTCCACCACGGTGTGAACTTCCCCCGCAAT
ATCTTGCATTACTACCGTCACCTCCACAGCCCCTACTGCAGTCAGCAAGTCCCGG
CAACCCCGACAGAAAAAGACAGCAGCGACAACGGTGACCAGAAAACCAGCAGT
TAGAAAATCTACAACAAGTGCAGCAGGAGGAGGACTGAGGATCACAGCGAACG
AGCCAGCGCAGACCAGAGAGCTGAGGAACCGGATCTTTCCAACCCTCTATGCCA
TCTTCCAGCAGAGTCGGGGCAAGAGCAGGAACTGAAAGTAAAAAACCGATCT
CTGCGCTCGCTCACCAGAAGTTGTTTGTATCACAAGAGCGAAGACCAACTTCAG
CGCACTCTCGAGGACGCCGAGGCTCTCTTCAACAAGTACTGCGCGCTGACTCTTA
AAGAGTAGCCCTTGCCCGCGCTTATTCGAAAACGGCGGGAATCACGTCACCATT
GGCACCTGTCCTTTGCCCTAGTCATGAGTAAAGAGATTCCCACGCCTTACATGTG
GAGCTATCAGCCCCAAATGGGGTTGGCAGCAGGCGCCTCCCAGGACTACTCCAC
CCGCATGAATTGGCTTAGCGCCGGGCCCTCAATGATATCACGGGTTAATGATAT
ACGAGCTTATCGAAACCAGTTACTCCTAGAACAGTCAGCTCTCCACCACCACACC
CCGCCAACACCTTAATCCCCGAAATTGGCCCGCCGCCCTGGTGTACCAGGAAAC
TCCCGCTCCCACCACCGTACTACTTCCTCGAGACGCCCAGGCCGAAGTTCAGATG
ACTAACGCAGGTGTACAGCTGGCGGGCGGTTCCGCCCTATGTCGTCACCGACCT
CAACAGAGTATAAAACGCCTGGTGATCAGAGGCCGAGGTATCCAGCTCAACGAC
GAGTCGGTTAGCTCTTCGCTTGGTCTGCGACCAGACGGAGTCTTCCAGATCGCCG
GCTGTGGGAGATCTTCCTTCACCCCTCGTCAGGCTGTACTGACTTTGGAGAGTTC
GTCCTCGCAGCCACGCTCGGGCGGCATCGGAACTCTCCAGTTCGTGGAGGAGTT
TACTCCCTCTGTCTACTTCAACCCCTTCTCCGGCTCTCCTGGCCAGTACCCAGACG
AGTTCATACCGAACTTCGACGCAATCAGCGAGTCAGTGGATGGCTATGATTGAT
GTCTAATGGTGGCGCGGCTGAGCTAGCTCGACTGCGACACCTAGACCACTGCCG
CCGCTTTCGCTGCTTCGCCCGGGAACTCACCGAGTTCATCTACTTCGAACTCCCC
GAGGAGCACCCTCAGGGTCCGGCCCACGGAGTGCGGATTACCATCGAAGGGGG
AATAGACTCTCGCCTGCATCGAATCTTCTCCCAGCGACCCGTGCTGATTGAGCGC
GACCAGGGAAATACAACCATCTCCATTTACTGCATCTGTAACCACCCCGGATTGC
ATGAAAGCCTTTGCTGTCTTGTTTGTGCTGAGTTTAATAAAAACTGAGTTAAGAC
CCTCCTACGGACTACCGCTTCTTCAATCAGGACTTTACAACACCAACCAGATCTT
CCAGAAGACCCAGACCCTTCCTCCTCTGATCCAGGACTCTAACTCTACCTTACCA
GCACCATCCACTACTAACCTTCCCGAAACTAACAAGCTTGGATCTCATCTGCAAC
ACCGCCTTTCACGAAGCCTTCTTTCTGCCAATACTACCACTCCCAAAACCGGAGG
TGAGCTCCGCGGTCTCCCTACTGACGACCCCTGGGTGGTAGCGGGTTTTGTAACG
TTAGGAGTAGTTGCGGGTGGGCTTGTGCTAATCCTTTGCTACCTATACATACCTT
GCTGTGCATATTTAGTCATATTGCGCTGTTGGTTTAAAAAATGGGGGCCATATTA
GTCGTGCTTGCTTTACTTTCGCTTTTGGGTCTGGGCTCTGCTAATCTCAATCCTCT
TGATCACGATCCATGTCTAGACTTCGACCCAGAAAACTGCACACTTACTTTTGCA
CCCGACACAAGCCGTCTCTGTGGAGTTCTTATTAAGTGCGGATGGGACTGCAGG
TCCGTTGAAATTACACATAATAACAAAACATGGAACAATACCTTATCCACCACA
TGGGAGCCAGGAGTTCCCGAGTGGTATACTGTCTCTGTCCGAGGTCCTGACGGTT
CCATCCGCATTAGTAACAACACTTTCATTTTTTCTGAAATGTGCGATCTGGCCAT
GTTCATGAGCAGACAGTATGACCTATGGCCTCCCAGCAAAGAGAACATTGTGGC
ATTTTCCATTGTTTATTGCTTGGTAACATGCATCATCACTGCTATCATTTGTGTGT
GCATACACTTGCTTATAGTTATTCGCCCTAGACAAAGCAATGAGGAAAAAGAGA
AAATGCCTTAACCTTTTTCCTCATACCTTTTCTTTACAGCATGGCTTCTGTTACAG
CTCTAATTATTGCCAGCATTGTCACTGTCGTTCACGGGCAAACAATTGTCCATAT
TACCTTAGGACATAATCACACTCTTGTAGGGCCCCCAATTACTTCAGAGGTTATT
TGGACCAAACTTGGAAGTGTTGATTATTTTGATATAATTTGCAACAAACTAAAC
CAATATTTGTAATCTGTAACAGACAAAATCTCACGTTAATTAATGTTAGCAAAAT
TTATAACGGTTACTATTATGGTTATGACAGATCCAGTAGTCAATATAAAAATTAC
TTAGTTCGCATAACTCAGCCCAAATTAACAGTGCCAACTATGACAATAATTAAA
ATGGCTAATAAAGCATTAGAAAATTTTACATCACCAACAACGCCCAATGAAAAA
AACATTCCAAATTCAATGATTGCAATTATTGCGGCGGTGGCATTGGGAATGGCA
CTAATAATAATATGCATGTTCCTATATGCTTGTTGCTATAAAAGTTTCAACATA
AACAGGATCCACTACTAAATTTTAACATTTAATTTTTTATACAGATGATTTCCAC |

TABLE 7-continued

Nucleic Acid Sequences of Vectors

| SEQ ID NO | Sequence |
|---|---|
| | TACAATTTTTATCATTATTAGCCTTGCAGCTGTAACTTATGGCCGTTCACACCTAA |
| | CTGTACCTGTTGGCTCAACATGTACACTACAAGGACCCCAAGAAGGCTATGTCA |
| | CTTGGTGGAGAATATATGATAATGGAGGGTTCGCTAGACCATGTGATCAGCCTG |
| | GTATAAAATTTTCATGCAACGGAAGAGACTTGACCATTATTAACATAACATCAA |
| | ATGAGCAAGGCTTCTATTATGGAACCAACTATAAAAATAGTTTAGATTACAACA |
| | TTATTGTAGTGCCAGCCACCACGTCTGCTCCCCGCAAATCCACTTTCTCTAGCAG |
| | CAGTGCCAAAGCAAGCACAATTCCTAAAACAGCTTCTGCTATTTTAAAGCTTCCA |
| | AAAATCGCTTTAAGTAATTCCACAGCCGCTCCCAATACAATTCCTAAATCAACAA |
| | TTGGCATCATTACTGCCGTGGTAGTGGGATTAATGATTATATTTTTGTGCATAAT |
| | GTACTACGCCTGCTGCTATAGAAAACATGAACAAAAAGGTGATGCATTACTAAA |
| | TTTTGATGTTTAATTTTTTATTAGTATTATGATATTGTTTCAATCAAATACCACTA |
| | ACACTATCAATGTGCAGACTACTTTAAATCATGACATGGAAAACCACACTACCT |
| | CCTATGCATACAATGTTCATAGAAATTCTAAAAGACGTCCCATCTATTCTTCTAT |
| | GATTAGTCGTCCCCATATGGCTCTGAATGAAATCTAAGATCTTTTTTTTCTCTTA |
| | CAGTATGGTGAACATCAATCATGATCCCTAGAAATTTCTTCTTCACCATACTCAT |
| | CTGTGCTTTCAATGTCTGTGCTACTTTCACAGCAGTAGCCACTGCAAGCCCAGAC |
| | TGTATAGGACCATTTGCTTCCTATGCACTTTTTGCCTTCGTTACTTGCATCTGCGT |
| | GTGTAGCATAGTCTGCCTGGTTATTAATTTTTTCCAACTGGTAGACTGGATCTTTG |
| | TGCGAATTGCCTACCTACGTCACCATCCCGAATACCGCAATCAAATGTTGCGGC |
| | ACTTCTTAGGCTTATTTAAAACCATGCAGGCTATGCTACCAGTCATTTTAATTCT |
| | GCTACTACCCTGCATTGCCCTAGCTTCCACCGCCACTCGCGCTACACCTGAACAA |
| | CTTAGAAAATGCAAATTTCAACAACCATGGTCATTTCTTGATTGCTACCATGAAA |
| | AATCTGATTTTCCCACATACTGGATAGTGATTGTTGGAATAATTAACATACTTTC |
| | ATGTACCTTTTTCTCAATCACAATATACCCCACATTTAATTTTGGGTGGAATTCTC |
| | CCAATGCACTGGGTTACCCACAAGAACCAAATGAACATATCCCACTACAACACG |
| | TACAACAACCACTAGCACTGGTAGAGTATGAAAATGAGCCACAACCTTCACTGC |
| | CCCCTGCCATTAGTTACTTCAACCTAACCGGCGGAGATGACTGACCCAATCGCCA |
| | CATCATCCACCGCTGCCAAGGAGCTGCTGGACATGGACGACGTGCCTCAGAAC |
| | AGCGACTCATCCAACTACGCATTCGTCAGCAGCAGGAACGAGCAGTAAAAGAGC |
| | TAAGGGATGCCATTGGGATTCACCAGTGCAAAAAAGGCATATTCTGCTTAGTAA |
| | AACAATCCAAAATCTCCTACGAGATCACCGCTACTGACCATCGTCTCTCATACGA |
| | GCTCGGTCCGCAGCGACAAAAATTCACCTGCATGGTGGGAATCAACCCCATAGT |
| | TATCACCCAGCAGTCTGGAGATACTAAGGGTTGCATCCACTGTTCCTGTGATTCC |
| | ACCGAGTGCATCTACACACTGCTGAAGACCCTCTGCGGCCTTCGAGACCTCCTAC |
| | CCATGAACTAATCATTGCCCCCTCCCTTACCCAATCCAAATATTAATAAAGACAC |
| | TTACTTGAAATCAGCAATACAGTCTTTGTCAAAACTTTCTACCAGCAGCACCTCA |
| | CCCTCTTCCCAACTCTGGTACTCTAAACGTCGGAGGGTGGCATACTTTCTCCACA |
| | CTTTGAAAGGGATGTCAAATTTTATTTCCTCTTCTTTGCCCACAATCTTCATTTCT |
| | TTATCCCCAGATGGCCAAGCGAGCTCGGCTAAGCACTTCCTTCAACCCGGTGTAC |
| | CCTTATGAAGATGAAAGCAACTTACAACACCCATTTATAAATCCTGGTTTCATTT |
| | CCCCTGACGGGTTCACACAAAGTCCAAACGGGGTTTTAAGTCTTAAATGTGTTAA |
| | TCCACTTACCACTGCAAGCGGCTCCCTCCAACTTAAAGTGGGAAGTGGTCTTACA |
| | GTAGACACTACTGATGGATCCTTAGAAGAAAACATCAAAGTTAACACCCCCCTA |
| | ACAAAGTCAAACCATTCTATAAATTTACCAATAGGAAACGGTTTGCAAATAGAA |
| | CAAAACAAACTTTGCAGTAAGCTCGGAAATGGTCTTACATTTGACTCTTCCAATT |
| | CTATTGCACTCAAAAATAACACTTTATGGACAGGTCCAAAACCAGAAGCCAACT |
| | GCATAATTGAATACGGGAAAGAAAACCCAGATAGCAAACTAACTTTAATCCTTG |
| | TAAAAAATGGAGGAATTGTTAATGGATATGTAACGCTAATGGGAGCCTCAGACT |
| | ATGTTAACACCTTATTTAAAACAAAAATGTCTCCATTAATGTAGAATTATACTT |
| | TGATGCCACTGGTCATATATTACCAGACTTATCTTCTCTTAAAACAGATCTACAA |
| | CTAAAATACAAGCAAACCACTCACTTTAGTGCAAGAGGTTTTATGCCAAGTACT |
| | ACAGCGTATCCATTTGTCCTTCCTAATGCGGGAACAGATAATGAAAATTATATTT |
| | TTGGTCAATGCTACTACAAAGCAAGCGATGGCGCCCTTTTTCCGTTGGAAGTTAC |
| | TGTTACGCTTAATAAACGCCTGCCAGATAGTCGCACATCCTATGTTATGACTTTT |
| | TTATGGTCCTTGAATGCTGGTCTAGCTCCAGAAACTACTCAGGCAACCCTGATAA |
| | CCTCCCCATTTACCTTTTCCTATATTACAGAGGATGACTGACAACAAAAATAAAG |
| | TTCAACATTTTTTATTGAAATTCCTTTTACAGTATTCGAGTAGTTATTTTGCCTCC |
| | CCCTTCCCATTTAACAGAATACACCAATCTCTCCCCACGCACAGCTTTAAACATT |
| | TGGATACCATTAGAGATAGACATAGTTTTAGATTCCACATTCCAAACAGTTTCAG |
| | AGCGAGCCAATCTGGGGTCAGTGATACATAAAAATGCATCGGGATAGTCTTTTA |
| | AAGCGCTTTCACAGTCCAACTGTTGCGGATGCGACTCCGGAGTCTGAATCACGG |
| | TCATCTGGAAGAAGAACGATGGGAATCATAATCCGAAAACGGAATCGGGCGATT |
| | GTGTCTCATCAACCCCACAAGCAGCCGCTGTCTGCGTCGCTCCGTGCGACTGCTG |
| | TTTATAGGATCGGGATCCACAGTGTCCTGAAGCATGATTTTAATAGCCCTTAACA |
| | TTAACTTTCTGGTGCGATGCGCGCAGCAACGCATTCTTATTTCACTTAGATTACT |
| | ACAGTAGGTACAGCACATTATCACAATATTGTTTAATAAA |
| SEQ ID NO: 1439 | CATCATCAATAATATACCCCACAAAGTAAACAAAAGTTAATATGCAAATGAGCT |
| | TTTGAATTTGGGGCGTGGTCGTCGCTGATTGGCCGAGAAACGGTGATGCAAATG |
| | ACGTCACGACGCACGGCTAACGGTCGCCGCGGAGGCGTGGCCTAGCCCGGAAGC |
| | AAGTCGCGGGGCTGATGACGTATAAAAAAGCGGACTTTAGACCCGGAAATGCC |
| | GATTTTCCCGCGGCCACGCCCGGATATGAGGTAATTCTGGGCAGATGCAAGTGA |
| | AATTAGGTCATTTTGGCGCGAAAACTGAATGAGGAAGTGAAAAGCGAAAATA |
| | CCGATCCCGCCCAGGGCGGAATATTTACCGAGGGCCGAGAGACTTTGACCGATT |
| | ACGTGGGGGTTTCGATTGCGGTGTTTTTTTCGCGAATTTCCGCGTCCGTGTCAAA |
| | GTCCGGTGTTTATGTCACAGATCAGCTGATCCACAGGGTATTTAAACCAGTCGAG |

TABLE 7-continued

Nucleic Acid Sequences of Vectors

SEQ ID NO Sequence

```
CCCGTCAAGAGGCCACTCTTGAGTGCCAGCGAGTAGAGATTTCTCTGAGCTCCG
CTCCCAGAGTGTGAGAAAAATGAGACACCTGCGCCTCCTGCCTGCAACTGTGCC
CTTGGACATGGCCGCATTATTGCTGGATGACTTTGTGAGTACAGTATTGGAGGAT
GAACTGCAACCAACTCCGTTCGAGCTGGGGCCCACACTTCAGGACCTCTATGAT
CTGGAGGTAGATGCCCAGGAGGACGACCCGAACGAAGAGGCTGTGAATTTAAT
ATTTCCAGAATCTCTGATTCTTCAGGCTGACATAGCCAGCGAAGCTGTACCTACA
CCACTTCATACACCGACTCTGTCACCCATACCTGAATTGGAAGAGGAGGACGAA
CTAGACCTCCGGTGTTATGAGGAAGGTTTTCCTCCCAGCGATTCAGAGGACGAA
CGGGGTGAGCAGAGTATGGCTATAATCTCAGACTGTGCTTGTGTGGTTGTGGAA
GAGCATTTTGTGTTGGACAATCCTGAGGTGCCTGGGCAAGGCTGTAGATCCTGCC
AATATCACCGGGATCAGACCGGAGACCAAAATGCTTCCTGTGCTCTGTGTTACAT
GAAAATGAGCTTCAGCTTTATTTACAGTAAGTGGAGTGAATGTGAGAGAGGCTG
AGTGCTTAACACATCACTGTGTGATGCTTGAACAGCTGTGCTAAGTGTGGTTTAT
TTTTGTTACTAGGTCCGGTGTCAGAGGATGAGTCATCACCCTCAGAAGAAGACC
ACCCGTCTCCCCCTGATCTCACAGATGACACGCCCCTGCAAGTGATCAGACCCAC
CCCAGTCAGACTCAGTGGGGAGAGGCGAATGGCTGTTGACAAAATCGAGGACTT
GTTGCAGGACATGGGTGGGGATGAACCTTTGGACCTGAGCTTGAAACGCCCCAG
GAACTAGGCGCAGCTGTGCTGAGTCATGTGTAAATAAAGTTGTACAATAAAAGT
ATATGTGACGCATGCAAGGTGTGGTTTATGACTCATGGGCGGGGCATAGTCCTA
TATAAGTGGCAACACCTGGGCACTCGGGCACAGACCTTCAGGGAGTTCCTGATG
GATGTGTGGACTATCCTTGCAGACTTTAGCAAGACACGCCGGCTTGTAGAGGAT
AGTTCAGACGGGTGCTCCGGGTTCTGGAGACACTGGTTTGGAACTCCTCTATCTC
GCCTGGTGTACACAGTTAAGAAGGATTATAAAGAGGAATTTGAAAATATTTTTG
CTGACTGCTCTGGCCTGCTAGATTCTCTGAATCTTGGCCACCAGTCCCTTTTCCAG
GAAAGGGTACTCCACAGCCTTGATTTTTCCAGCCCAGGGCGCACTACAGCCGGG
GTTGCTTTTGTGGTTTTTCTGGTTGACAAATGGAGCCAGGACACCCAACTGAGCA
GGGGATACATCCTGGACTTCGCGGCCATGCACCTGTGGAGGGCCTGGATCAGGC
AGCGGGGACAGAGAATCTTGAACTACTGGCTTCTACAGCCAGCAGCTCCGGGTC
TTCTTCGTCTACACAGACAAACATCCATGTTGGAGGAAGAAATGAGGCAGGCCA
TGGACGAGAACCCGAGGAGCGGCCTGGACCCTCCGTCGGAAGAGGAGCTGGAT
TGAATCAGGTATCCAGCCTGTACCCAGAGCTTAGCAAGGTGCTGACATCCATGG
CCAGGGGAGTGAAGAGGGAGAGGAGCGATGGGGGCAATACCGGGATGATGACC
GAGCTGACGGCCAGCCTGATGAATCGCAAGCGCCCAGAGCGCATTACCTGGCAC
GAGCTACAGATGGAGTGCAGGGATGAGGTGGGCCTGATGCAGGATAAATATGG
CCTGGAGCAGATAAAAACCCACTGGTTGAACCCAGATGAGGATTGGGAGGAGG
CCATTAAGAAATATGCCAAGATAGCCCTGCGCCCAGATTGCAAGTACAGGGTGA
CCAAGACGGTGCATATCAGACATGCCTGCTACATCTCAGGGAACGGGGCAGAGG
TGGTCATCGATACCCTGGACAAGGCCGCCTTCAGGTGTTGCATGATGGGAATGA
GAGCCGGAGTGATGAATATGAATTCCATGATCTTTATGAACATGAAGTTCAATG
GAGAGAAGTTTAATGGGGTGCTGTTCATGGCCAACAGCCACATGACCCTGCATG
GCTGCGACTTTTTCGGCTTCAACAATATGTGCGCAGAGGTCTGGGGCGCTTCCAA
GATCAGGGGATGTAAGTTTTATGGCTGCTGGATGGGCGTGGTCGGAAGACCCAA
GAGCGAGATGTCTGTGAAGCAGTGTGTGTTTGAGAAATGCTACCTGGGAGTCTC
TACCGAGGGCAATGCTAGAGTGAGGCACTGCTCTTCCCTGGAGACGGGCTGCTT
CTGCCTGGTGAAGGGCACAGCCTCTTTGAAGCATAATATGGTGAAGGGCTGCAC
GGATGAGCGCATGTACAACATGCTGACCTGCGACTCGGGGGTCTGTCATATCCT
GAAGAACATCCATGTGACCTCCCACCCACGTAAGAAGTGGCCAGTGTTTGAGAA
TAACCTACTGATCAAGTGCCATGTGCACCTGGGCGCCAGAAGGGGTACCTTCCA
GCCGTACCAGTGCAACTTTAGCCAGACCAAGCTGCTGTTGGAGAACGATGCCTT
CTCCAGGGTGAACCTGAACGGCATCTTTGACATGGATGTCTCGGTGTACAAGAT
ACTGAGATACGATGAGACCAAGTCCAGGGTGCGCGCTTGCGAGTGCGGGGCA
GACACACCAGGATGCAGCCAGTGGCCCTGGATGTGACCGAGGAGCTGAGACCA
GACCACCTGGTGATGGCCTGTACCGGGACCGAGTTCAGCTCCAGTGGGGAGGAC
ACAGATTAGAGGTAGGTTTGAGTAGTGGGCGTGGCTAAGGTGACTATAAAGGCG
GGTGTCTTACGAGGGTCTTTTTGCTTTTCTGCAGACATCATGAACGGGACTGGCG
GGGCCTTCGAAGGGGGGCTTTTTAGCCCTTATTTGACAACCCGCCTGCCGGGATG
GGCCGGAGTTCGTCAGAATGTGATGGGATCGACGGTGGACGGGCGCCCAGTGCT
TCCAGCAAATTCCTCGACCATGACCTACGCGACCGTGGGGAACTCGTCGCTCGA
CAGCACCGCCGCAGCCGCGGCAGCCGCAGCCGCCATGACAGCGACGAGACTGG
CTTCAAGCTACATGCCCAGCAGCAGCAGTAGCCCCTCTGTGCCAAGTTCCATCAT
CGCCGAGGAGAAACTGCTGGCCCTGCTGGCCGAGTTGGAAGCTCTGAGCCGCCA
GCTGGCCGCCCTGACCCAGCAGGTGTCCGATCTCCGCGAACAGCAGCAGCAGCA
AAATAAATGATTCAATAAACACAGATTCTGATTCAAACAGCAAAGCATCTTTAT
TATTTATTTTTTCGCGCGCGGTAGGCCCTGGTCCACCTCTCCCGATCATTGAGAG
TGCGGTGGATTTTTTCCAGGACCCGGTAGAGGTGGGATTGGATGTTGAGGTACA
TGGGCATGAGCCCGTCCCGGGGGTGGAGGTAGCACCACTGCATGGCCTCGTGCT
CTGGGGTCGTGTTGTAGATGATCCAGTCATAGCAGGGGCGCTGGGCGTGGTGCT
GGATGATGTCCTTGAGGAGGAGACTGATGGCCACGGGGAGCCCCTTGGTGTAGG
TGTTGGCGAAGCGGTTGAGCTGGGAGGGATGCATGCGGGGGGAGATGATGTGTA
GTTTGGCCTGGATCTTGAGGTTGGCGATGTTGCCACCCAGATCCCGCCGTGGGTT
CATGTTGTGCAGCACCACCAGGACGGTGTAGCCCGTGCACTTGGGGAATTTGTC
ATGCAACTTGGAAGGGAATGCGTGGAAGAATTTGGAGACGCCCTTGTGCCCGCC
CAGGTTTTCCATGCACTCATCCATGATGATGGCGATGGGCCCGTGGGCTGCGGCT
TTGGCAAAGACGTTTCTGGGGTCAGAGACATCGTAATTATGCTCCTGGGTGAGA
TCATCATAAGACATTTTAATGAATTTGGGGCGGAGGGTGCCAGATTGGGGACG
ATGGTTCCCTCGGGCCCCGGGGCAAAGTTCCCCTCGCAGATCTGCATCTCCCAGG
```

TABLE 7-continued

Nucleic Acid Sequences of Vectors

SEQ ID NO Sequence

CTTTCATCTCGGAGGGGGGATCATGTCCACCTGCGGGGCGATGAAAAAAACGG
TTTCCGGGGCGGGGGTGATGAGCTGCGAGGAGAGCAGGTTTCTCAACAGCTGGG
ACTTGCCGCACCCGGTCGGGCCGTAGATGACCCCGATGACGGGTTGCAGGTGGT
AGTTCAAGGAGATGCAGCTGCCGTCGTCCCGAGGAGGGGGGCCACCTCGTTGA
GCATGTCCCTGACTTGGAGGTTTTCCCGGACGAGCTCGCCGAGGAGGCGGTCCC
CGCCCAGCGAGAGCAGCTCTTGCAGGGAAGCAAAGTTTTTCAGGGGCTTGAGCC
CGTCGGCCATGGGCATCTTGGCGAGGGTCTGCGAGAGGAGCTCGAGGCGGTCCC
AGAGCTCGGTGACGTGCTCTACGGCATCTCGATCCAGCAGACTTCCTCGTTTCGG
GGGTTGGGACGACTGCGACTGTAGGGCACGAGACGATGGGCGTCCAGCGCTGCC
AGCGTCATGTCCTTCCAGGGTCTCAGGGTCCGCGTGAGCGTGGTCTCCGTCACGG
TGAAGGGGTGGGCCCCGGGCTGGGCGCTTGCAAGGGTGCGCTTGAGACTCATCC
TGCTGGTGCTGAAACGGGCACGGTCTTCGCCCTGCGCGTCGGCGAGATAGCAAT
TGACCATGAGCTCGTAGTTGAGGGCCTCGGCGGCGTGGCCCTTGGCGCGGAGCT
TGCCCTTGGAAGAGCGCCCGCAGGCGGGACAGAGGAGGGATTGCAGGGCGTAA
AGCTTGGGTGCGAGAAAGACGGACTCGGGGGCGAATGCATCCGCTCCGCAGTGG
GCGCAGACGGTCTCGCACTCCACGAGCCAGGTGAGCTCTGGCTGCTCGGGGTCA
AAAACCAGTTTTCCCCCGTTCTTTTTGATGCGCTTCTTACCTCGCGTCTCCATTAG
TCTGTGTCCGCGCTCGGTGACAAACAGGCTGTCTGTGTCCCCGTAGACGGACTTG
ATGGGCCTGTCCTGCAGGGGCGTTCCGCGGTCCTCCTCGTAGAGAAACTCGGAC
CACTCTGAGACAAAGGCGCGCGTCCACGCCAAGACAAAGGAGGCCACGTGCGA
GGGGTAGCGGTCGTTGTCCACCAGGGGGTCCACTTTTTCCACGGTATGCAGGCA
CATGTCCCCCTCCTCCGCATCCAAGAAGGTGATTGGCTTGTAGGTGTAGGCCACG
TGACCCGGGGTCCCCGACGGGGGGTATAAAAGGGGGCGGGTCTGTGCTCGTCC
TCACTCTCTTCCGCGTCGCTGTCCACGAGCGCCAGCTGTTGGGGTAGGTATTCCC
TCTCGAGAGCGGGCATGACCTCGGCACTCAGGTTGTCAGTTTCTAGAAACGAGG
AGGATTTGATGTTGGCTTGCCCTGCCGCGATGCTTTTTAGGAGACTTTCATCCAT
CTGGTCAGAAAAGACTATTTTTTTATTGTCAAGCTTGGTGGCGAAGGAGCCATAG
AGGGCGTTTGAGAGAAGCTTGGCGATGGATCTCATGGTCTGATTTTTGTCACGGT
CGGCGCGCTCCTTGGCCGCGATGTTGAGCTGGACATACTCGCGCGCGACACACT
TCCATTCGGGAAAGACGGTGGTGCGCTCGTCGGGCACGATCCTGACGCGCCAGC
CGCGGTTATGCAGGGTGACCAGGTCCACGCTGGTGGCCACCTCGCCGCGCAGGG
GCTCGTTGGTCCAGCAGAGTCTGCCGCCCTTGCGCGAGCAGAACGGGGCAGCA
CATCAAGCAGATGCTCGTCAGGGGGGTCCGCATCGATGGTGAAGATGCCGGGAC
AGAGTTCCTTGTCAAAATAATCGATTTTTGAGGATGCATCATCCAAGGCCATCTG
CCACTCGCGGGCGGCCATTGCTCGCTCGTAGGGGTTGAGGGGCGGACCCCAGGG
CATGGGATGCGTGAGCGCGGAGGCGTACATGCCGCATATGTCATAGACATAGAT
GGGCTCCGAGAGGATGCCGATGTAGGTGGGATAACAGCGCCCCCCGCGGATGCT
GGCGCGCACATAGTCATACAACTCGTGCGAGGGGGCCAAGAAGGCGGGGCCGA
GATTGGTGCGCTGGGGCTGCTCGGCGCGGAAGACGATCTGGCGAAAGATGGCAT
GCGAGTTTGAGGAGATGGTGGGCCGTTGGAAGATGTTAAAGTGGGCGTGGGGCA
AGCGGACCGAGTCGCGGATGAAGTGCGCGTAGGAGTCTTGCAGCTTGGCGACGA
GCTCGGCGGTGACGAGGACGTCCATGGCGCAGTAGTCCAGCGTTTCGCGGATGA
TGTCATAACCCGTCTCTCCTTTCTTCTCCCACAGCTCGCGGTTGAGGGCGTACTCC
TCGTCATCCTTCCAGTACTCCCGGAGCGGGAATCCTCGATCGTCCGCACGGTAAG
AGCCCAGCATGTAGAAATGGTTCACGGCCTTGTAGGGACAGCAGCCCTTCTCCA
CGGGGAGGGCGTAAGCTTGAGCGGCCTTGCGGAGCGAGGTGTGCGTCAGGGCG
AAGGTGTCCCTGACCATGACTTTCAAGAACTGGTACTTGAAGTCCGAGTCGTCGC
AGCCGCCGTGCTCCCAGAGCTCGAAATCGGTGCGCTTTTTTGAGAGGGGGTTAG
GCAGAGCGAAAGTGACGTCATTGAAGAGAATCTTGCCTGCTCGCGGCATGAAAT
TGCGGGTGATGCGGAAAGGGCCAGGCACGGAGGCTCGGTTGTTGATGACCTGGG
CGGCGAGGACGATCTCGTCGAAGCCGTTGATGTTGTGCCCGACGATGTAGAGTT
CCATGAATCGCGGGCGGCCTTTGATGTGCGGCAGCTTTTTGAGCTCCTCGTAGGT
GAGGTCCTCGGGGCATTGCAGGCCGTGCTGCTCTAGCGCCCACTCCTGGAGATG
TGGGTTGGCCTGCATGAAGGAAGCCCAGAGCTCGCGGGCCATGAGGGTCTGGAG
CTCGTCGCGAAAGAGGCGGAACTGCTGGCCCACGGCCATCTTTTCTGGGGTGAC
GCAGTAGAAGGTGAGGGGGTCCCGCTCCCAGCGATCCCAGCGTAAGCGCACGGC
GAGATCGCGAGCGAGGGCGACCAGCTCGGGGTCCCCCGAGAATTTCATGACCAG
CATGAAGGGGACGAGCTGCTTGCCGAAGGACCCCATCCAGGTGTAGGTTTCTAC
ATCGTAGGTGACAAAGAGCCGCTCCGTGCGAGGATGAGAGCCGATTGGGAAGA
ACTGGATTTCCTGCCACCAGTTGGACGAGTGGCTGTTGATGTGATGAAAGTAGA
AATCCCGCCGGCGAACCGAGCACTCGTGCTGATGCTTGTAAAAGCGTCCGCAGT
ACTCGCAGCGCTGCACGGGCTGTACCTCATCCACGAGATACACAGCGCGTCCCT
TGAGGAGGAACTTCAGGAGTGGCGGCCCTGGCTGGTGGTTTTCATGTTCGCCTGC
GTGGGACTCACCCTGGGGCTCCTCGAGGACGGAGAGGCTGACGAGCCCGCGCGG
GAGCCAGGTCCAGATCTCGGCGCGGCGGGGCGGAGAGCGAAGACGAGGGCGC
GCAGTTGGGAGCTGTCCATGGTGTCGCGGAGATCCAGGTCCGGGGGCAGGGTTC
TGAGGTTGACCTCGTAGAGGCGGGTGAGGGCGTGCTTGAGATGCAGATGGTACT
TGATCTCCACGGGTGAGTTGGTGGCCGTGTCCACGCATTGCATGAGCCCGTAGCT
GCGCGGGGCCACGACCGTGCCGCGGTGCGCTTTTAGAAGCGGTGTCGCGGACGC
GCTCCCGGCGGCAGCGGCGGTTCCGGTCCCGGGCAGGGGCGGCAGAGGCAC
GTCGGCGTGGCGCTCGGGCACGTCCCGGTGCTGCGCCCTGAGAGCGTGGCGTG
CGCGACGACGCGGCGGTTGACATCCTGAATCTGCCGCCTCTGCGTGAAGACCAC
TGGCCCCGTGACTTTGAACCTGAAAGACAGTTCAACAGAATCAATCTCGGCGTC
ATTGACGGCGGCCTGACGCAGGATCTCTTGCACGTCGCCCGAGTTGTCCTGGTAG
GCGATCTCGGACATGAACTGCTCGATCTCCTCCTCCTGGAGATCGCGCGGCCCG
CGCGCTCGACGGTGGCGGCGAGGTCGTTGGAGATGCGACCCATGAGCTGCGAGA

TABLE 7-continued

Nucleic Acid Sequences of Vectors

SEQ ID NO Sequence

```
AGGCGCCCAGGCCGCTCTCGTTCCAGACGCGGCTATAGACCACGTCCCCGTCGG
CGTCGCGCGCGCGCATGACCACCTGCGCGAGGTTGAGCTCCACGTGCCGCGCGA
AGACGGCGTAGTTGCGCAGGCGCTGGAATAGGTAGTTGATGGTGGTGGCGATGT
GCTCGGTGACGAAGAAGTACATGATCCAGCGGCGCAGGGGCATCTCGCTGATGT
CGCCAATGGCCTCCAGCCTTTCCATGGCCTCGTAGAAATCCACGGCGAAGTTGA
AAAACTGGGCGTTGCGGGCCGAGACCGTGAGCTCGTCTTCTAGGAGCCTGATGA
GTTCGGCGATGGTGGCGCGCACCTCGCGCTCGAAATCCCCGGGAGCCTCCTCCTC
TTCCTCTTCTTCCATGACGACCTCTTCTTCTATTTCTTCCTCTGGGGCGGTGGTG
GTGGCGGGGCCCGACGACGACGGCGACGCACCGGGAGACGGTCGACGAAGCGC
TCGATCATCTCCCCGCGGCGGCGACGCATGGTTTCGGTGACGGCGCGACCCCGTT
CGCGAGGACGCAGCGTGAAGACGCCGCCGGTCATCTCCCGGTAATGGGGCGGGT
CCCCGTTGGGCAGCGAGAGGGCGCTGACGATGCATCTTATCAATTGCGGTGTAG
GGGACGTGAGCGCGTCGAGATCGACCGGATCGGAGAATCTTTCGAGGAAAGCGT
CTAGCCAATCGCAGTCGCAAGGTAAGCTCAAACACGTAGCAGCCCTGTGGACGC
TGTTAGAATTGCGGTTGCTGATGATGTAATTAAAGTAGGCGTTTTTGAGGCGGCG
GATGGTGGCGAGCAGGACCAGGTCCTTGGGTCCCGCTTGCTGGATGCGGAGCCG
CTCGGCCATGCCCCAGGCCTGGCCCTGACACCGGCTCAGGTTCTTGTAGTAGTCA
TGCATGAGCCTCTCGATGTCATCACTGGCGGAGGCGGAGTCTTCCATGCGGGTG
ACCCCGACGCCCTGAGCGGCTGCACGAGCGCCAGGTCGGCGACGACGCGCTCG
GCGAGGATGGCCTGTTGCACGCGGGTGAGGGTGTCCTGGAAGTCGTCCATGTCG
ACGAAGCGGTGGTAGGCCCCTGTGTTGATGGTGTAAGTGCAGTTGGCCATGAGC
GACCAGTTAACGGTCTGCAGGCCAGGCTGCACGACCTCCGAGTACCTGAGCCGC
GAGAAGGCGCGCGAGTCGAAGACGTAGTCGTTGCAGGTGCGCACGAGGTACTG
GTATCCGACTAGGAAGTGCGGCGGCGGCTGGCGATAGAGCGGCCAGCGCTGGGT
GGCCGGCGCGCCCGGGGCCAGGTCCTCGAGCATGAGGCGGTGGTAGCCGTAGA
GGTAGCGGGACATCCAGGTGATGCCGGCGGCGGTGGTGGAGGCGCGCGGGAAC
TCGCGGACGCGGTTCCAGATGTTGCGCAGCGGCAGGAAATAGTCCATGGTCGGC
ACGGTCTGACCGGTGAGACGCGCGCAGTCATTGACGCTCTAGAGGCAAAAACGA
AAGCGGTTGAGCGGGCTCTTCCTCCGTAGTCTGGCGGAACGCAAACGGGTTAGG
CCGCGCGTGTACCCCGGTTCGAGTCCCCTCGAATCAGGCTGGAGCCGCGACTAA
CGTGGTATTGGCACTCCCGTCTCGACCCGAGCCCGATAGCCGCCAGGATACGGC
GGAGAGCCCTTTTTGCCGGCCGAGGGGAGTCGCTAGACTTGAAAGCGGCCGAAA
ACCCCACCGGGTAGTGGCTCGCGCCCGTAGTCTGGAGAAGCATCGCCAGGGTTG
AGTCGCGGCAGAACCCGGTTCGAGGACGGCCGCGGCGAGCGGGACTTGGTCACC
CCGCCGATTTAAAGACCCACAGCCAGCCGACTTCTCCAGTTACGGGAGCGAGCC
CCCTTTTTTCTTTTTGCCAGATGCATCCCGTCCTGCGCCAAATGCGTCCCACCCCC
CCGGCGACCACCGCAACCGCGGCCGTAGCAGGCGCCGGCGCTAGCCAGCCACA
GACAGAGATGGACTTGGAAGAGGGCGAAGGGCTGGCGAGACTGGGGGCGCCGT
CCCCGGAGCGACACCCCCGCGTGCAGCTGCAGAAGGACGTGCGCCCGGCGTACG
TGCCTCCGCAGAACCTGTTCAGGGACCGCAGCGGGGAGGAGCCCGAGGAGATG
CGCGACTGCCGTTTTCGGGCGGGCAGGGAGCTGCGCGAGGGCCTGGACCGCCAG
CGCGTGCTGCGCGACGAGGATTTCGAGCCGAACGAGCAGACGGGGATCAGCCCC
GCGCGCGCGCACGTGGCGGCGGCCAACCTGGTGACGGCCTACGAGCAGACGGT
GAAGCAGGAGCGCAACTTCCAAAAGAGTTTCAACAACCATGTGCGCACGCTGAT
CGCGCGCGAGGAGGTGGCCCTGGGCCTGATGCACCTGTGGGACCTGGCGGAGGC
CATCGTGCAGAATCCGGACAGCAAGCCTCTGACGGCGCAGCTGTTCCTGGTGGT
GCAGCACAGCAGGGACAACGAGGCGTTCAGGGAGGCGCTGCTGAACATCGCCG
AGCCCGAGGGCCGCTGGCTGCTGGAGCTGATTAACATCTTGCAAAGCATTGTAG
TGCAGGAGCGCAGCCTGAGCCTGGCCGAGAAGGTGGCGGCGATCAACTACTCGG
TGCTTAGCCTGGGCAAGTTTTACGCGCGCAAGATTTACAAGACGCCGTACGTGC
CCATAGACAAGGAGGTGAAGATAGACAGCTTTTACATGCGCATGGCGCTCAAGG
TGCTGACGCTGAGCGACGACCTGGGCGTGTACCGCAACGACCGCATCCACAAGG
CCGTCAGCACGAGCCGGCGGCGCGAGCTGAGCGACCGCGAGCTGATGCTGAGCC
TGCGCCGGGCGCTGGTAGGGGGCGCCGCCGGCGGCGAGGAGTCCTACTTTGACA
TGGGGGCGGACCTGCATTGGCAGCCGAGCCGGCGCGCCTTGGAGGCCGCCTACG
GTCCAGAGGACTTGGATGAGGATGAGGAAGAGGAGGAGGATGCACCCGTTGCG
GGGTACTGACGCCTCCGTGATGTGTTTTTAGATGCAGCAAGCCCGGACCCCGCC
ATAAGGGCGGCGCTGCAAAGCCAGCCGTCCGGTCTAGCATCGGACGACTGGGAG
GCCGCGATGCAACGCATCATGGCCCTGACGACCCGCAACCCCGAGTCCTTTAGA
CAACAGCCGCAGGCCAACAGACTCTCGGCCATTCTGGAGGCGGTGGTCCCCTCT
CGCACCAACCCCACGCACGAGAAGGTGCTGGCGATCGTGAACGCGCTGGCGGA
GAACAAGGCCATCCGTCCCGACGAGGCCGGGCTGGTGTACAACGCCCTGCTGGA
GCGCGTGGGCCGCTACAACAGCACGAATGTGCAGTCCAACCTGGACGGCTGGT
GACGGACGTGCGCGAGGCCGTGGCGCAGCGCGAGCGGTTCAAGAACGAGGGCC
TGGGCTCGCTGGTGGCGCTGAACGCCTTCCTGGCGACGCAGCCGGCGAACGTGC
CGCGCGGGCAGGACGATTATACCAACTTTATCAGCGCGCTGCGGCTGATGGTGA
CCGAGGTTCCCCAGAGCGAGGTGTACCAGTCTGGCCCGGACTACTTTTTCCAGAC
TAGCAGACAGGGCCTGCAGACGGTGAACCTGAGCCAGGCTTTCAAGAACCTGCG
CGGGCTGTGGGGCGTGCAGGCGCCCGTGGGCGACCGGTCAACGGTGAGCAGCTT
GCTGACGCCCAACTCGCGGCTGCTGCTGCTGCTGATCGCGCCCTTCACCGACAGC
GGCAGCGTGAACCGCAACTCGTACCTGGGTCACCTGCTGACGCTGTACCGCGAG
GCCATAGGCCAGGCGCAGGTGGACGAGCAGACCTTCCAGGAGATCACTAGCGTG
AGCCGCGCACTGGGTCAAAACGACACCGACAGTCTGGGGCCACCCTGAACTTC
TTGCTGACCAATAGACAGCAGAAGATCCCGGCGCAGTACGCGCTGTCGGCCGAG
GAGGAGCGCATCTTGAGATATGTGCAGCAGAGCGTAGGACTTTTCTTGATGCAG
GAGGGGGCCACCCCCAGCGCCGCGCTGGACATGACCGCGCGCAACATGGAACCT
```

TABLE 7-continued

Nucleic Acid Sequences of Vectors

SEQ ID NO Sequence

AGCATGTACGCCGCCAACCGGCCGTTCATCAATAAGCTGATGGACTACTTGCAC
CGCGCGGCGGCCATGAACTCGGACTACTTTACAAACGCCATCCTGAACCCGCAC
TGGCTCCCGCCGCCGGGGTTCTACACGGGCGAGTACGATATGCCCGACCCCAAC
GACGGGTTCCTGTGGGACGACGTGGACAGCGCGGTGTTCTCCCCGACCTTGCAA
AAGCGCCAGGAGGCGGTGCGCACGCCCGCGAGCGAGGGTGCGGTGGGTCGGAG
CCCCTTTCCTAGCTTAGGGAGTTTGCATAGCTTGCCGGGCTCGGTGAACAGCGGC
AGGGTGAGCCGGCCGCGCTTGCTGGGCGAGGACGAGTACCTGAACGACTCGCTG
CTGCAGCCCCCGCGGGTCAAGAACGCCATGGCCAATAACGGGATAGAGAGTCTG
GTTGACAAACTGAACCGCTGGAAGACCTACGCTCAGGACCATAGGGAGCCTGCG
CCCGTGCCGCGGCGACAGCGTCACGACCGGCAGCGGGGCCTGGTGTGGGACGAC
GAGGACTCGGCCGACGATAGCAGCGTGTTGGACTTGGGCGGGAGCGGTGGGGC
CAACCCGTTCGCACATCTGCAGCCCAAACTGGGGCGACGGATGTTTTGAATGCA
AAATAAAACTCACCAAGGCCATAGCGTGCGTTCTCTTCCTTGTTAGAGATGAGG
CGTGCGGTGGTGTCTTCCTCTCCTCCTCCCTCGTACGAGAGCGTGATGGCGCAGG
CGACCCTGGAGGTTCCGTTTGTGCCTCCGCGGTATATGGCTCCTACGGAGGGCAG
AAACAGCATTCGTTACTCGGAGCTGGCTCCGCTGTACGACACCACTCGCGTGTAT
TTGGTGGACAACAAGTCGGCGGACATCGCTTCCCTGAACTACCAAAACGACCAC
AGCAACTTCCTGACCACGGTGGTGCAGAACAACGATTTCACCCCCGCCGAGGCC
AGCACGCAGACGATAAATTTTGACGAGCGGTCGCGGTGGGCGGTGATCTGAAG
ACCATTCTGCACACAAACATGCCCAATGTGAACGAGTACATGTTCACCAGCAAG
TTTAAGGCGCGGGTGATGGTGGCTAGAAAAAAGGCGGAAGGGGCTGATGCAAA
TGATAGAAGCAAGGATATCTTAGAGTATGAATGGTTTGAGTTTACCCTGCCCGA
GGGCAACTTTTCCGAGACCATGACCATAGACCTGATGAACAACGCCATCTTGGA
AAACTACTTGCAAGTGGGGCGGCAACATGGCGTGCTGGAGAGCGATATCGGAGT
CAAGTTTGACAGCAGGAATTTCAAGCTGGGCTGGGACCCGGTGACCAAGCTGGT
GATGCCAGGGGTCTACACCTACGAGGCCTTCCACCCGGACGTGGTGCTGCTGCC
GGGCTGCGGGGTGGACTTTACCGAGAGCCGCCTGAGCAACCTCCTGGGCATTCG
CAAGAAGCAACCTTTCCAAGAGGGCTTCAGAATCATGTATGAGGATCTAGAAGG
GGGCAACATCCCCGCTCTGCTTGATGTGGAAGCATACCTCAACAGCAAGAATGA
TAAGGAGGAGGCTACCAAGAATGCAAACAGAGATGCTGACAATGGAGGTGGTG
AAACTAGGGGAGATACTTTTCTCACCACCGAACAGCTAAGAGCTGCTGGCAAGG
AGCTGGTTATTAAGCCCATCAAGGAAGATGCTAGCAAGAGGAGCTATAATGTCA
TAGATGGCACCCATGACACCCTGTACCGAAGCTGGTACCTGTCCTATACCTACGG
GGACCCCGAGAAGGGGGTGCAGTCGTGGACGCTGCTCACCACCCCGGACGTCAC
CTGCGGCGCGGAGCAAGTCTACTGGTCGCTGCCTGACCTCATGCAAGACCCCGT
CACCTTCCGCTCTACCCAGCAAGTCAGCAACTACCCCGTGGTCGGCGCCGAGCTC
ATGCCCTTCCGCGCCAAGAGCTTTTACAACGACCTCGCCGTCTACTCCCAGCTCA
TCCGCAGCTACACTTCCTCACCCACGTCTTCAACCGCTTCCCCGACAACCAGAT
CCTCTGCCGCCCGCCCGCGCCCACCATCACCACCGTCAGTGAAAACGTGCCTGCT
CTCACAGATCACGGGACGCTACCGCTGCGCAGCAGTATCCGGGAGTCCAGCGA
GTGACCGTCACTGACGCCCGTCGCCGCACCTGTCCCTACGTCTACAAGGCCCTGG
GCATAGTCGCGCCGCGCGTGCTATCCAGTCGCACCTTCTAAAAAATGTCTATTCT
CATCTCACCCAGCAATAACACCGGCTGGGGTATTACTAGGCCCAGCACCATGTA
CGGAGGAGCCAAGAAGCGCTCCCAGCAGCACCCCGTCCGCGTCCGCGGCCACTT
CCGCGCTCCCTGGGGCGCTTACAAGCGCGGGCGGACTCCCGCCGCCGCCGTGCG
CACCACCGTTGACGACGTCATCGACTCGGTGGTCGCCGACGCGCGCAACTACAC
CCCCGCCCCCTCCACCGTGGACGCGGTCATCGACAGCGTGGTGGCCGACGCTCG
CGACTATGCCAGACGCAAGAGCCGGCGGCGACGGATCGCCAGGCGCCACCGGA
GCACGCCCGCCATGCGCGCCGCCCGGGCTCTGCTGCCGCCGCCAGACGCACGG
GCCGCCGGGCCATGATGCGAGCCGCGCGCCGCCGCCGCCACTGCACCCCCCGCAG
GCAGGACTCGCAGACGAGCGGCCGCCGCCGCCGCCGGCCATCTCTAGCATGA
CCAGACCCAGGCGCGGAAACGTGTACTGGGTGCGCGACTCCGTCACGGGCGTGC
GCGTGCCCGTGCGCACCCGTCCTCCTCGTCCCTGATCTAATGCTTGTGTCCTCCCC
CGCAAGCGACGATGTCAAAGCGCAAATCAAGGAGGAGATGCTCCAGGTCGTC
GCCCCGGAGATTTACGGACCACCCCAGGCGGACCAGAAACCCCGCAAAATCAA
GCGGGTTAAAAAAAGGATGAGGTGGACGAGGGGGCAGTAGAGTTTGTGCGCG
AGTTCGCTCCGCGGCGGCGGGTAAATTGGAAGGGGCGCAGGGTGCAGCGCGTGT
TGCGGCCCGGCACGGCGGTGGTGTTCACGCCCGGCGAGCGGTCCTCGGTCAGGA
GCAAGCGTAGCTATGACGAGGTGTACGGCGACGACGACATCCTGGACCAGGCG
GCGGAGCGGGCGGGCGAGTTTGCCTACGGGAAGCGGTCGCGCGAAGAGGAGCT
GATCTCGCTGCCGCTGGACGAGAGCAACCCCACGCCGAGCCTGAAGCCCGTGAC
CCTGCAGCAGGTGCTGCCCCAGGCGGTGCTGCTGCCGAGCCGCGGGGTCAAGCG
CGAGGGCGAGAACATGTACCCGACCATGCAGATCATGGTGCCCAAGCGCCGGCG
CGTGGAGGAAGTGCTGGACACCGTGAAAATGGATGTGGAGCCCGAGGTCAAGG
TGCGCCCCATCAAGCAGGTGGCGCGGGCCTGGGCGTGCAGACCGTGGACATTC
AGATCCCCACCGACATGGATGTCGACAAAAAACCCTCGACCAGCATCGAGGTGC
AGACCGACCCCTGGCTTCCAGCCTCCACCGCTACCGTCTCCACTTCTACCGCCGC
CACGGCTACCGAGCCTCACAGGAGGCGAAGATGGGGCGCCGCCAGCCGGCTGA
TGCCCAACTACGTGTTGCATCCTTCCATTATCCCGACGCCGGGCTACCGCGGTAC
CCGATATTACGCCAGCCGCAGGCGCCCAGCCACCAAGCGCCGCCGCCGCACCAC
CCGCCGCCGTCTGGCCCCCGCCCGCGGTGCGCCGCGTAACCACGCGCGGGGCCG
CTCGCTCGTTCTGCCCACCGTGCGCTACCACCCCAGCATCCTTTAATCCGTGTGC
TGTGATACTGTTGCAGAGAGATGGCTCTCACTTGCCGCCTGCGCATCCCCGTCCC
GAATTACCGAGGAAGATCCCGCCGCAGGAGAGGCATGGCAGGCAGTGGCCTGA
ACCGCCGCCGGCGGCGGGCCATGCGCAGGCGCCTGAGTGGCGGCTTTCTGCCCG
CGCTCATCCCCATAATCGCCGCGGCCATCGGCACGATCCCGGGCATAGCCTTCCGT

TABLE 7-continued

Nucleic Acid Sequences of Vectors

| SEQ ID NO | Sequence |
|---|---|
| | TGCGCTGCAGGCGTCGCAGCGCCGTTGATGTGCGAATAAAGCCTCTTTAGACTCT
GACACACCTGGTCCTGTATATTTTTAGAATGGAAGACATCAATTTTGCGTCCCTG
GCTCCGCGGCACGGCACGCGGCCGTTCATGGGCACCTGGAACGAGATCGGCACC
AGCCAGCTGAACGGGGGCGCCTTCAATTGGAGCAGTGTCTGGAGCGGGCTTAAA
AATTTCGGCTCGACGCTCCGGACCTATGGGAACAAGGCCTGGAATAGTAGCACG
GGGCAGTTGTTGAGGGAAAAGCTCAAAGACCAGAACTTCCAGCAGAAGGTGGT
GGACGGCCTGGCCTCGGGCATTAACGGGGTGGTGGACATCGCGAACCAGGCCGT
GCAGCGCGAGATAAACAGCCGCCTGGACCCGCGGCCGCCCACGGTGGTGGAGA
TGGAAGATGCAACTCCTCCGCCGCCCAAGGGCGAGAAGCGGCCGCGGCCCGATG
CGGAGGAGACGATCCTGCAGGTGGACGAGCCGCCCTCGTACGAGGAGGCCGTC
AAGGCCGGCATGCCAACCACGCGCATCATCGCGCCGCTGGCCACGGGTGTAATG
AAACCCGCCACCCTTGACCTGCCTCCACCACCCACGCCCGCTCCACCAAAGGCA
GCTCCGGTTGTGCAGCCCCCTCCGGTGGCGACCGCCGTGCGCCGCGTCCCCGCCC
GCCGCCAGGCCCAGAACTGGCAGAGCACGCTGCACAGTATCGTGGGCCTAGGAG
TGAAAAGTCTGAAGCGCCGCCGATGCTATTGAGAGAGAGGAAAGAGGACACTA
AAGGGAGAGCTTAACTTGTATGTGCCTTACCGCCAGAGAACGCGCGAAGATGGC
CACCCCCTCGATGATGCCGCAGTGGGCGTACATGCACATCGCCGGGCAGGACGC
CTCGGAGTACCTGAGCCCGGGTCTGGTGCAGTTTGCCCGCGCCACCGACACGTA
CTTCAGCCTGGGCAACAAGTTTAGGAACCCCACGGTGGCTCCCACCCACGATGT
GACCACGGACCGGTCCCAGCGTCTGACGCTGCGCTTCGTGCCCGTGGATCGCGA
GGACACCACGTACTCGTACAAGGCGCGCTTCACTCTGGCCGTGGGCGACAACCG
GGTGCTAGACATGGCCAGCACTTACTTTGACATCCGCGGCGTCCTGGACCGCGG
TCCCAGCTTCAAACCCTACTCGGGCACAGCTTACAACAGCCTGGCCCCAAAGAG
CGCCCCCAATCCAAGTCAGTGGACCGCCAATGAAAAACAAACTGGCGGCCAACC
AAAATCTGTTACCCAAACATTTGGATCTGCTCCAATGGGAGGCAGCAATATTACT
ATTGAAGGATTGGTTATTGGAACTAAGGAGGAAGAAGGCAATGCCACTGAAGA
AATATTCGCAGATAAAACATTCCAGCCAGAACCTCAAGTAGGAGAAGAAAACTG
GCAGGAAACAGAAGCCTTCTATGGAGGAAGGGCTCTTAAAAAGGATACCAAAA
TGAAACCATGTTACGGTTCATTTGCTAGACCCACCAATGAAAAAGGAGGGCAAG
CAAAATTAAAGCTCAACGATCAGGGTCAGCCAACTAAAGATTATGACATAGACC
TGGCATTCTTTGATACTCCGGGCGGAACACCTCCAACAGGCAGTGGTCAACAGG
AAGAATACAAAGCAGACATTGTTATGTACACTGAAAATGTCAACCTTGAAACCC
CAGACACCCACGTGGTATATAAGCCAGGAAAAGAGGATGAGAGTTCTGAAATA
AATTTGACACAGCAGTCCATGCCCAACAGACCTAACTACATTGGCTTTAGGGAC
AACTTTGTGGGGCTCATGTATTACAACAGCACCGGCAATATGGGTGTGCTGGCT
GGTCAGGCTTCTCAGTTGAACGCTGTGGTCGACTTGCAAGACAGAAATACCGAG
CTATCTTACCAGCTATTGCTAGATTCTCTGGGCGACAGGACCAGATACTTTAGCA
TGTGGAACTCTGCGGTGGACAGCTATGATCCCGATGTCAGGATCATTGAGAATC
ACGGTGTGGAAGATGAACTTCCAAACTATTGCTTCCCATTGAATGGTACTGGCAC
CAATTCCACTTATCAAGGCGTAAAGGTGAAAACAGGTCAGGATGGAGCTGAGGA
GACCGAGTGGGAAAAAGATGAAACTGTTGCAAGACAAAATCAAATCGCCAAGG
GCAACGTCTATGCCATGGAGATCAACCTCCAGGCCAACCTGTGGAAGAGTTTTC
TGTACTCGAACGTAGCCCTGTACCTGCCTGACTCATACAAGTACACGCCGGCCA
ACGTCACGCTGCCCGCCAACACCAACACCTACGAGTACATGAACGGCCGCGTGG
TAGCCCCCTCGCTGGTGGACGCCTACATCAACATTGGCGCCCGCTGGTCGCTGGA
CCCCATGGACAATGTCAACCCCTTCAACCACCACCGCAACGCGGGCCTGCGCTA
CCGCTCCATGCTTCTGGGCAACGGACGCTACGTGCCCTTCCACATTCAAGTGCCC
CAAAAGTTCTTTGCCATCAAGAACCTGCTCCTGCTACCCGGCTCCTACACCTACG
AGTGGAACTTCCGCAAGGATGTCAACATGATCCTGCAGAGTTCCCTCGGAAACG
ACCTGCGCGTCGACGGCGCATCCGTCCGCTTCGACAGCGTCAACCTCTACGCCAC
CTTCTTCCCCATGGCGCACAACACCGCCTCCACCCTGGAAGCCATGCTGCGCAAC
GACACCAACGACCAGTCCTTCAACGACTACCTCTCGGCCGCCAACATGCTCTACC
CCATCCCGGCCAAGGCCACCAACGTGCCCATCTCCATCCCTCGCGCAACTGGG
CCGCCTTCCGCGGCTGGAGTTTCACCCGTCTGAAAACCAAGGAAACTCCCTCCCT
CGGCTCGGGTTTTGACCCCTACTTTGTCTACTCGGGCTCCATCCCCTACCTCGAC
GGAACCTTCTACCTCAACCACACCTTCAAGAAGGTTTCCATCATGTTCGACTCCT
CGGTCAGCTGGCCCGGCAACGACCGGCTGCTCACACCGAACGAGTTCGAGATCA
AGCGCAGCGTCGACGGGGAGGGCTACAACGTGGCCCAATGCAACATGACCAAG
GACTGGTTCCTCGTCCAGATGCTTTCCCACTACAACATCGGTTACCAGGGCTTCC
ATGTGCCCGAGGGCTACAAGGACCGCATGTACTCCTTCTTCCGCAACTTCCAGCC
CATGAGCAGGCAGGTGGTCGATGAGATCAACTACAAGGACTACAAGGCCGTCAC
CCTGCCCTTCCAGCACAACAACTCGGGCTTCACCGGCTACCTAGCACCCACCATG
CGCCAGGGCAGCCCTACCCCGCCAACTTCCCCTACCCGCTCATCGGCTCCACCG
CAGTCCCCTCCGTCACCCAGAAAAAGTTCCTCTGCGACAGGGTCATGTGGCGCA
TCCCCTTCTCCAGCAACTTCATGTCCATGGGCGCCCTCACCGACCTGGGTCAGAA
CATGCTCTACGCCAACTCGGCCCACGCGCTCGACATGACCTTCGAGGTGGACCC
CATGGATGAGCCCACCCTCCTCTATCTTCTCTTCGAAGTTTTCGACGTGGTCAGA
GTGCACCAGCCGCACCGCGGCGTCATCGAGGCCGTCTACCTGCGCACACCCTTCT
CCGCCGGCAACGCCACCACATAAGCATGAGCGGCTCCAGCGAAAGAGAGCTCG
CGGCCATCGTGCGCGACCTGGGCTGCGGGCCCTACTTTTTGGGCACCCACGACA
AGCGCTTCCCTGGCTTCCTCGCCGGCGACAAGCTGGCCTGCGCCATCGTCAACAC
GGCCGGCCGCGAGACCGGAGGCGTGCACTGGCTCGCCTTCGGCTGGAATCCGCG
CTCGCGCACCTGCTACATGTTCGACCCCTTTGGGTTTTCGGACCGCCGGCTCAAG
CAGATTTACAGCTTCGAGTACGAGGCCATGCTGCGCCGCAGCGCCCTGGCTTCCT
CGCCCGACCGCTGTCTCAGCCTCGAGCAGTCCACCCAGACCGTGCAGGGGCCCG
ACTCCGCCGCCTGCGGACTTTTCTGTTGCATGTTCTTGCATGCCTTCGTGCACTGG |

TABLE 7-continued

Nucleic Acid Sequences of Vectors

| SEQ ID NO | Sequence |
|---|---|
| | CCCGACCGACCCATGGACGGAAACCCCACCATGAACTTGCTGACGGGGGTGCCC |
| | AACGGCATGCTACAATCGCCACAGGTGCTGCCCACCCTCAGGCGCAACCAGGAG |
| | GAGCTCTACCGCTTCCTCGCGCGCCACTCCCCTTACTTTCGCTCCCACCGCGCCG |
| | CCATCGAACATGCCACCGCTTTTGACAAAATGAAACAACTGCGTGTATCTCAAT |
| | AAACAGCACTTTTATTTTACATGCACTGGAGTATATGCAAGTTATTTAAAAGTCG |
| | AAGGGGTTCTCGCGCTCGTCGTTGTGCGCCGCGCTGGGGAGGGCCACGTTGCGG |
| | TACTGGTACTTGGGATGCCACTTGAACTCGGGGATCACCAGTTTGGGAACAGCG |
| | ATCTCGGGGAAGGTTTCGCTCCACATGCGCCGGCTCATTTGCAGGGCGCCCAGT |
| | ATGTCAGGCGCGGAGATCTTGAAATCGCAGTTGGGACCGGTGCTCTGCGCGCGC |
| | GAGTTGCGGTACACGGGGTTGCAGCACTGGAACACCATCAGACTGGGGTGCTTC |
| | ACGCTGGCCAGCACGCTCTTGTCGCTGATCTGATCCTTGTCCAGGTCCTCGGCGT |
| | TGCTCAGGCCGAACGGGGTCATCTTGCACAGCTGGCGGCCCAGGAAGGGCACGC |
| | TCTGAGGCTTGTGGTTACACTCGCAGTGCACTGGCATCAGCATCATCCCCGCACC |
| | GCGCTGCATATTCGGGTAGAGGGCCTTAACAAAGGCCGAGATCTGCTTGAAAGC |
| | TTGCTGGGCCTTGGCCCCCTCGCTGAAGAACAGCCCGCAGCTCTTCCCACTGAAC |
| | TGGTTATTTCCGCACCCGGCATCCTGCACGCAGCAGCGCGCGTCATGGCTGGTCA |
| | GTTGCACCACGCTACGTCCCCAGCGGTTCTGGGTCACCTTGGCCTTGCTGGGCTG |
| | CTCCCTTCAACGCGCGCTGGCCGTTCTCGCTGGTCACATCCATCTCCACCACGTGG |
| | TCCTTGTGGATCATCACCGTCCCGTGCAGACACTTGAGCTGGCCTTCCACCTCGG |
| | TGCAGCCATGGTCCCACAGGGCGCAGCCGGTGCACTCCCAGTTCTTGTGCGCGA |
| | TCCCGCTGTGACTGAAGATGTAACCTTGCAACATGCGGCCCATCACGGTGCTAA |
| | ATGATTTACTGGTGCTGAAGGTCAGTTGCAGGCCGCGGGCCTCCTCGTTCATCCA |
| | GGTCTGACACATCTTCTGGAAGATCTCGGTCTGCTCGGGCATTAGCTTGTAGGCA |
| | TCGCGCAGGCCGCTGTCGACGCGGTAGCGTTCCATCAGCACGTTCATGGCATCC |
| | ATGCCCTTCTCCCAGGACGAGACCAGAGGCAGACTCAGGGGGTTGCGCACGTTC |
| | AGGACACCGGGGGTCGCGGGCTCGACGATGCGTTTTCCGTCCTTGCCTTCCTTCA |
| | ACAGAACCGGAGGCTGGCTGAATCCCACTCCTACGATCACGGCATCTTCCTGGG |
| | GCATCTCTTCGTCGGGGTCTACCTTGGTCACATGCTTGGTTTTCCTGGGTTGCTTC |
| | TTTTTTGGAGGGCTGTCCACCGGGACCACGTCCTCCTCGGAAGACCCGGAGCCC |
| | ACCCGCTGATACTTTCGGCGCTTGGTGGGCAGAGGAGGTGGCGGCGGCGAGGGG |
| | CTCCTCTCCTGCTCCGGCGGATAGCGCGCCGACCCGTGGCCCCGGGGCGGAGTG |
| | GCCTCTCGCTCCATGAACCGGCGCACGTCCTGACTGCCGCCGGCCATTGTTTCCT |
| | AGGGGAAGATGGAGGAGCAGCCGCGTAAGCAGGAGCAGGAGGAGGACTTAACC |
| | ACCCACGAACAACCCAAAATCGAGCAGGACCTGGGCTTCGAAGAGCCGGCTCGT |
| | CTAGAAACCCCACAGGATGAACAGGAGCACGAGCAAGACGCAGGCCAGGACGA |
| | GACCGACGCTGGGCTCGAGCATGGCTACCTAGAGGAGGACATGCTGCTGAAACA |
| | CCTGCAGCGCCAGTCCCTCATCCTCAGGGACGCCCTGGCCGACCGGAGCGAGAC |
| | CCCCCTCAGCGTTGAGGAGCTAAGTCGGGCCTACGAGCTCAACCTTTTCTCGCCG |
| | CGCGTGCCCCCCAAACGCCAGCCCAACGGCACCTGCGAGCCCAACCCGCGTCTC |
| | AACTTCTACCCCGTCTTCGCGGTCCCCGAGGCCCTTGCCACCTATCACATCTTTTT |
| | CAAGAACCAAAAGATCCCCGTCTCCTGTCGCGCCAACCGCACCCGCGCCGACGC |
| | GCTCCTAGCTCTGGGGCCCGGCGCGCGCATACCTGATATCGCTTCCCTGGAAGA |
| | GGTGCCCAAGATCTTCGAAGGGCTCGGTCGGGACGAGACGCGCGCGGCGAACG |
| | CTCTGAAAGAAACAGCAGAGGAAGAGGGTCACACTAGCGCCCTGGTAGAGTTG |
| | GAAGGTGACAACGCCAGGCTGGCCGTGCTCAAGCGCAGCGTCGAGCTCACCCAC |
| | TTCGCCTACCCCGCCGTCAACCTCCCGCCCAAGGTCATGCGTCGCATCATGGATC |
| | AGCTCATCATGCCCCACATCGAAGCCCTCGATGAAAGTCAGGAACAGCGGCCCG |
| | AGGACGCCCAGCCCGTGGTCAGCGACGAGCAGCTCGCGCGCTGGCTCGGGACCC |
| | GCGACCCCCAGGCCCTGGAGCAGCGGCGCAAGCTCATGCTGGCCGTGGTCCTGG |
| | TCACCCTCGAGCTGGAATGCATGCGCCGCTTCTTCACCGACCCCGACACCCTGCG |
| | CAAGGTCGAGGAGACCCTGCACTACACTTTCAGGCACGGTTTCGTCAGGCAGGC |
| | CTGCAAGATCTCCAACGTGGAGCTGACCAACCTGGTCTCTTGCCTGGGGATCCTG |
| | CACGAGAACCGCCTGGGGCAGACCGTGCTTCACTCTACCCTCAAGGGCGAGGCG |
| | CGGCGGGACTACATCCGCGACTGCGTCTTTCTTTCTTTTGCCATACATGGCAGT |
| | CGGCCATGGGTGTGTGGCAGCAGTGTCTAGAGGACGAGAACCTGAAGGAGCTG |
| | GACAAGCTTCTTGCTAGAAATCTTAAAAAGCTGTGGACGGGCTTCGACGAGCGC |
| | ACCGTCGCCTCGGACCTGGCCGAGATCGTCTTCCCAGAGCGCCTGAGGCAGACG |
| | CTGAAAGGCGGACTGCCCGACTTCATGAGCCAGAGCATGTTGCAAAACTACCGC |
| | ACTTTCATTCTCGAGCGATCTGGGATGCTGCCCGCCACCTGCAACGCTTTCCCCT |
| | CCGACTTTGTTCCACTGAGCTACCGCGAGTGTCCCCGCCGCTGTGGAGCCACTG |
| | CTACCTCTTGCAGCTGGCCAACTACATCTCCTACCACTCGGACGTGATCGAGGAC |
| | GTGAGCGGCGAGGGGCTTCTCGAGTGCCACTGCCGCTGCAACCTGTGCTCCCCG |
| | CACCGCTCCCTGGTCTGCAACCCCCAGCTCCTAAGCGAGACCCAGGTCATTGGTA |
| | CCTTCGAGCTGCAAGGTCCGCAGGAGTCCACCGCTCCGCTGAAACTCACGCCGG |
| | GGTTGTGGACTTCCGCGTACCTGCGCAAATTTGTACCCGAGGACTACCACGCCCA |
| | TGAGATAAAGTTCTTCGAGGACCAATCGCGCCCGCAGCACGCGGATCTCACGGC |
| | CTGCGTCATCACCCAGGGCGCGATCCTCGCCCAATTGCACGCCATCCAAAAATC |
| | CCGCCAAGAGTTTCTTCTGAAAAAGGGTAGAGGGGTCTACCTGGACCCCCAGAC |
| | GGGCGAGGTGCTCAACCCGGGTCTCCCCCAGCATGCCGAGGAAGAAGCAGGAG |
| | CCACTAGTGGAGGAGATGGAAGAAGAATGGGACAGCCAGGCAGAGGAGGACGA |
| | ATGGGAGGAGGAGACAGAGGAGGAAGAATTGGAAGAGGTGGAAGAGGAGCAG |
| | GCAACAGAGCAGCCCGTCGCCGCACCATCCGCGCCGGCAGCCCCGGCGGTCACG |
| | GATACAACCTCCGCAGCTCCGGCCAAGCCTCCTCGTAGATGGGATCGAGTGAAG |
| | GGTGACGGTAAGCACGAGCGGCAGGGCTACCGATCATGGAGGTCCCACAAAGC |
| | CGCGATCATCGCCTGCTTGCAAGACTGCGGGGGGAACATCGCTTTCGCCCGCCG |
| | CTACCTGCTGTTCCACCGCGGAGTAAACATCCCCCGCAACGTGTTGCATTACTAC |

TABLE 7-continued

Nucleic Acid Sequences of Vectors

SEQ ID NO Sequence

```
CGTCACCTTCACAGCTAAGAAAAAATCAGAAGTAAGAGGAGTCGCCGGAGGAG
GCCTGAGGATCGCGGCGAACGAGCCCTTGACCACCAGGGAGCTGAGGAACCGG
ATCTTCCCCACTCTTTATGCCATTTTTCAGCAGAGTCGAGGTCAGCAGCAAGAGC
TCAAAGTAAAAAACCGGTCTCTGCGCTCGCTCACCCGCAGTTGCTTGTACCACAA
AAACGAAGATCAGCTGCAGCGCACTCTCGAAGACGCCGAGGCTCTGTTCCACAA
GTACTGCGCGCTCACTCTTAAAGACTAAGGCGCGCCCACCCGGAAAAAAGGCGG
GAATTACCTCATCGCCACCATGAGCAAGGAGATTCCCACCCCTTACATGTGGAG
CTATCAGCCCCAGATGGGCCTGGCCGCGGGCGCCTCCCAGGACTACTCCACCCG
CATGAATTGGCTAAGTGCCGGCCCCTCGATGATCTCACGGGTCAACGGGGTCCG
TAACCATCGAAACCAGATATTGTTGGAGCAGGCGGCGGTCACCTCCACGCCCAG
GGCAAAGCTCAACCCGCGTAATTGGCCCTCCACCCTGGTGTATCAGGAAATCCC
CGGGCCGACTACCGTACTACTTCCGCGTGACGCACTGGCCGAAGTCCGCATGAC
TAACTCAGGTGTCCAGCTGGCCGGCGGCGCTTCCCGGTGCCCGCTCCGCCCACA
ATCGGGTATAAAAACCCTGGTGATCCGAGGCAGAGGCACACAGCTCAACGACG
AGTTGGTGAGCTCTTCGATCGGTCTGCGACCGGACGGAGTGTTCCAACTAGCCG
GAGCCGGGAGATCCTCCTTCACTCCCAACCAGGCCTACCTGACCTTGCAGAGCA
GCTCTTCGGAGCCTCGCTCCGGAGGCATCGGAACCCTCCAGTTTGTGGAGGAGTT
TGTGCCCTCGGTCTACTTCAACCCCTTCTCGGGATCGCCAGGCCTCTACCCGGAC
GAGTTCATACCGAACTTCGACGCAGTGAGAGAAGCGGTGGACGGCTACGACTGA
ATGTCCCATGGTGACTCGGCTGAGCTCGCTCGGTTGAGGCATCTGGACCACTGCC
GCCGCCTGCGCTGCTTTGCCCGGGAGAGCTGCGGACTCATCTACTTTGAGTTTCC
CGAGGAGCACCCCAACGGCCCTGCGCACGGAGTGCGGATCACCGTAGAGGGCA
CCACCGAGTCTCACCTGGTCAGGTTCTTCACCCAGCAACCCTTCCTGGTTGAGCG
GGACCGGGGCGCCACCACCTACACCGTCTACTGCATCGTCCTACCCCGAAGTTG
CATGAGAATTTTTGCTGTACTCTGTGTGCTGAGTTTAATAAAAGCTGAAATCAGA
CTCTACTCTGGAATCCAGTGTCGTCATAACATCACAAAGACCATCAACTTCACCA
CCGAAGAACAGGTAAACTTTACCTGCAAACCACACAAGAAGTACATCATCTGGT
TATATCAGAACTCTACTCTAGCTGTAGCCAACACCTGCTCGAACGACGGTGTTCT
TCTACCAAACAACCTCACAAGTGGACTTACCTTCTCTGTTAGAAGGGCAAAGCT
AATTCTCTATCGCCCTATCTTAGAAGGAACTTACCATTGTCACAGCGGACCTTGT
CACCACATTTTCCATTTGGTGAACGTCACCAGCAGCAGCAACAGCTCAGAAACT
AACCTCTCTCGTACTAACAGACCTCAATTCGGAGGTGAGCTAAGGCTTCCCCCTT
CTGAGGAGGGGGTTAGCCCATACGAAGTGGTCGGGTATTTGATTTTAGGGGTGG
TACTGGGTGGGTGCATAGCGGTGCTAGCTCAGCTGCCTTGCTGGGTGGAAATCA
AAATCTTTATATGCTGGGTCAGACATTGTGGGGAGGAACCATGAATGGGCTCTT
GCTGATTATCCTTTCCCTGGTGGGGGGTGTACTGTCATGCCACGAACAGCCACGA
TGTAACATCACCACAGGCAATCATATGAGCAGAGAGTGCACTGTAGTCATTAAA
TGCGAGCACGACTGCCCACTAAACATTACATTCAAGAATAACACCATGGGAAAT
GTATGGGTGGGTTTCTGGGAACCAGGAGATGAGCAGAACTACACGGTCACTGTC
CATGGTAGCAATGGAAATCACACTTTCGGTTTCAAATTCATTTTTGAAGTTATGT
GTGATATCACACTGCATGTGGCTAGACTTCATGGCTTGTGGCCCCCTACCAAGGA
GAACATGATTGGGTTTTCTTTGGCTTTTGTGATCATGGCCTGCTTGATGTCAGGTC
TGCTGGTAGGGGCTTTAGTGTGGTTCCTCAAACGCAAGCCCAGGTATGGAAATG
AGGAGAAGGAAAAATTGCTATAAATTCTTTTTCTTTTCACAGCACCATGAATACT
TTGACCAGTGTCGTGCTGCTCTCTCTTCTTGTAGCTTTTAGTCAGGCAGGAATTAT
TAACTTAAATGTATCATGGGGAATGAATCTAACTTTAGTGGGACCATCAGACCT
ACCAGTTACATGGTATGACGGAAAGGGAATGCAGTTTTGTGATGGAAATACAAT
TAAGAACCCACAAATCAAGCATAGCTGTGATCAACAGAATCTAACTTTACTTAA
TGCTGACAAGTCTCATGAAAGGACTTACCTAGGTTACAGACATGACAGTAAGGG
AAAAGTAGACTATAAGGTTACAGTCATACCACCTCCTCCAACCACTCGCAAGCC
TTTGTCAGAGCCTCATTATGTTACTGTAACTATGGGCTATAACATAACTTTAGTG
GGACCCTCAGACCTGCCAGTTACATGGTATGATGGAGAAGGAAATAAATTCTGC
GATGGAGAAAAAGTTGAACATGCAGAATTTAATCATACATGTAACATCCAGAAC
CTGACACTGCTTTTTGTCAACTTAACGCATAATGGAGCATACATTGGTTATAACA
AAGACGGTTCTGATAGAGAATTATATGAGGTGTCAGTCAAAACCTTGTTTCAGA
ACGGGGCTGGACAAAGTAAGGTTGAACAAGGTAATAAATGGAAAACTAATACC
ACTCAAAGTGGTGGTAAAAAAACCAAAACAGATCATAGAAACCAGAGTCCAAA
AAGAAAATCAACAAATAATCTTCAACCAACACAATTGTATGTTAGACCTTTTACT
AATGTTAGTTTAACTGGACCTCCAAATGGCAAGGTTACTTGGTATGACGGCGAA
CTTAATGATCCATGTGAACAAAAGTACAAACTCAGAACTTTTTGCAATCAGCAA
AATCTAACTTTAATTAATGTAACCAGCACTTATGATGGCATCTATTATGGCACTG
ATGAAAAGATAAGGCAAATCGTTACAGAATAAAAGTAAATACTACAAATCAC
AAAACTGTTAAAATTAAGCCACATACCAGAGAACCTCCTGCTAAACAAGAAAAA
CAGTTTGAATTACAAACTGCAGAAACTGATGAAAACGAATCAAAAATTCCATCA
ACTACTGTGGCAATCGTGGTGGGAGTGATTGCGGGCTTTGTAACTCTAATCATTG
TCTTCATCTGCTACATCTGCTGCCGCAAGCGTCCCAGGTCATACAATCATATGGT
AGACCCACTACTCAGCTTCTCTTACTGAAACTCAGTCACTCTCATTTCAGAACCA
TGAAGGCTTTCACAGCTTGCGTTCTGATTAGCTTATTCACACTTAGTTCAGCTGG
TTTATATTCAAGTTAATGTGACTAGAGGTGGAAACATTACATTAAATGGACCACT
ACAAAATACTACATGGTTAAGATACCACCTAAATGGTTGGCAACATATTTGTAC
ATGGTCTGGTCCATCATATAAGTGCCATACTAATAATGGAAGCATTACAATTTTT
GCTATTAACATCACTTCTGGAACTTATAAAGCCGAAGGATATAAAAAAGAGGTT
AGGACTTTTTCATCTAAAAATCAAAGACATACAATTGAAGATTCTGGTGATTATG
AGGAACATAAAAATACTTTTGTATAATTTAACAATATTTGAACTGCCAACCACTAA
AGCACCCACCACAGTTAGGACAACTAGGGAAACAACTGCACAGCCTACTACAAA
TCCCACCACTCGAGACAACTACTAGTCCAACAACACAGCCCACTACAATTACAAC
```

TABLE 7-continued

Nucleic Acid Sequences of Vectors

| SEQ ID NO | Sequence |
|---|---|
| | TAGGGAGGTAACTACTCACACTACACAGTTAGACACTACAGTGCAGAATAGTAC<br>TGTGTTAATCAGGTTTTTGTTGAGGGAGGAAAGTACTACTGAACAGACAGAGGC<br>TACCTCAATTGCCTTCAGCAGCACTGCAAATTTAACTTCGCTTGCTTCAATAAAT<br>GAAACCATCGTGCCGATGATGCTGGAACAAGATTTAAGAGGTTTGGATATGCAA<br>ATCACTTTTCTGGTTGTCTGTGGAATCTTTATTCTCGCTGTCCTTCTCTACTTTGTC<br>TGCTGCAAGGCCAGAGAGAAATCTAGGCGGCCCATCTACAGGCCAGTAATCGGG<br>GAACCTCAGCCCCTCCAAGTGGACGGAGGCTTAAGAAATCTTCTCTTCTCTTTTA<br>CAGTATGGTGATCAGCCATGATTCCTAGGTTCTTCCTATTTAACATCCTCTTCTGT<br>CTCTTCAACATCTGCGCTGCCTTTGCGGCCGTCTCGCACGCATCGCCCGACTGTC<br>TCGGGCCCTTCCCCACCTACCTCCTCTTTGCCCTGCTCACCTGCACCTGCGTCTGC<br>AGCATTGTCTGCGTGGTCATTACCTTCCTGCAGCTTATCGACTGGTGCTGCGCGC<br>GCTACAATTACCTACACCACAGTCCCGAATACAGGGACGAGAACGTAGCCAGAA<br>TATTAAGGCTCATCTGACTATGCAGACTCTGCTCATACTGCTATCCCTCCTATCCC<br>CTGTCCTTGCTGCTAAAGACTATTCTCAATGTAAATTTGCGGACATATGGAATTT<br>CTTAGACTGCTATGATGCGAAAATTGATATGCCCTCCTATTACTTGGTAATTGTG<br>GGAATAGTCATGGTCTGCTCCTGCACTTTCTTTGCCATCATGATATACCCCTGTTT<br>TGATCTCGGCTGGAACTCTGTTGAGGCATTCACATACACACTAGAAAGCAGTTC<br>ACTAGCTTCCACGCCACCACCCACACCGCCTCCCCGCAGAAATCAGTTTCCACTG<br>ATTCAGTACTTAGAAGAGCCCCCTCCCCGGCCCCCTTCCACTGTTAGCTACTTTC<br>ACATAACCGGCGGCGATGACTGACCACCACCTGGACCTCGAGATGGACGGCCAG<br>GCCTCCGAGCAGCGCATCCTGCAACTGCGCGTCCGTCAGCAGCAGGAGCGGGCC<br>GCCAAGGAGCTCCTCGATGCCATCAACATCCACCAGTGCAAGAAGGGAATCTTC<br>TGCCTGGTCAAACAGGCAAAGATTACCTACGAGCTCGTGTCCGGCGGCAAGCAG<br>CATCGCCTCGCCTATGAGCTGCCCAGCAGAAGCAGAAGTTCACCTGCATGGTG<br>GGCGTCAACCCCATAGTCATCACCCAGCAGTCGGGCGAGACCAGCGGCTGCATC<br>CACTGCTCCTGCGAAAGCCCCGAGTGCATCTACTCCCTCCTTAAGACCCTTTGCG<br>GACTCCGCGACCTCCTCCCCATGAACTGATGTTGATTAAAATCCCAAAAACCAAT<br>CAGCCCATTTCCCCATCCCCATTTACTCAAGAATAAATTATTGGAACTATTCATT<br>CAATAAAGATCACTTACTTGAAATCTGAAAGTATGTCTCTGGTGTAGTTGTTTAG<br>CAGCACCTCGGTTCCCTCCTCCCAGCTCTGGTACTCCAGTCCCCGGCGGGCGGCG<br>AACTTCCTCCACACCTTGAAAGGGATGTCAAATTCCTGGTCCACAATTTTCATTG<br>TCTTCCCTCTCAGATGTCAAAGAGGCTCCGGGTGGAAGATGACTTCAACCCCGTC<br>TACCCCTATGGCTACGCGCGGAATCAGAACATCCCCTTCCTCACTCCCCCCTTTG<br>TATCCTCCGATGGATTCAAAAACTTCCCCCCTGGGGTCCTGTCGCTCAAACTAGC<br>TGACCCAATAGCCATCGTCAATGGGGATGTCTCACTCAAAGTGGGAGGGGGTCT<br>CACTTTGCAAGATGGAACTGGAAAACTAACAGTCAATACTGAACCACCTTTGCA<br>ACTTGCAAACAACAAATTAGGGATTGCTTTGGACGCTCCATTTGATGTTATAGAT<br>AATAAACTCACAATGTTAGCAGGCCATGGCTTGTCTATTATAACAAAAGAAACA<br>TCAACATTGCCTGGCTTAGTTAATACTCTTGTAGTATTAACTGGAAAGGGTATTG<br>GAACAGAATCAACAGATAATGGTGGAAGCGTATGTGAGAGTTGGAGAAGGT<br>GGCGGCTTATCATTTAATAATGATGGAGACTTGGTAGCATTTAATAAAAAAGAA<br>GATAAGCGCACCCTATGGACAACTCCAGACACATCTCCAAATTGCAAGATTGAT<br>CAGGATAAGGACTCTAAGTTAACTCTGGTCCTTACAAAGTGTGGAAGTCAAATA<br>TTGGCTAATGTGTCATTAATTGTCGTAGCTGGTAAGTACAAAATTATCAATAACA<br>ATACTCAACCATCTCTCAAAGGATTTACCATTAAATTATTGTTTGATCAAAATGG<br>AGTACTTATGGAATCTTCAAATCTTGGTAAATCATATTGGAACTTTAGAAATGAA<br>AATTCAATTATGTCAACAGCTTATGAAAAAGCTATTGGATTCATGCCTAATTTGG<br>TAGCCTATCCAAAACCTACCGCTGGCTCTAAAAAATATGCAAGAGATATAGTTT<br>ATGGAAACATCTACCTTGGTGGAAAGCCAGATCAACCAGTAACCATTAAAACTA<br>CCTTTAATCAGGAAACTGGATGTGAATATTCTATCACATTTGATTTTAGTTGGGC<br>CAAGACTTATGTAAATGTTGAATTTGAAACAACCTCTTTTACCTTTTCCTATATCG<br>CCCAAGAATGAAAGGTCAATAAACGTGTTTTTCATTTGAAAATTTCATGTATCTT<br>TATTGATTTTTACACCAGCACGAGTAGTCAGTCTCCCACCACCAGCCCATTTCAC<br>AGTGTACACGGTTCTTTCAGCACGGGTGGCCTTAAATAGGGGAATGTTCTGATTA<br>GTGCGGGAACTGAACTTGGGGTCTATAATCCACACAGTTTCCTGGCGAGCCAAA<br>CGGGGGTCGGTGATTGAGATGAAGCCGTCCTCTGAAAAGTCATCCAAGCGGGCC<br>TCACAGTCCAAAGTCACAGTCTGGTGGAATGAGAAGAACGCACAGATTCATACT<br>CGGAAAACAGGATGGGTCTGTGCCTCTCCATCAGCGCCCTCAGCAGTCTCTGCC<br>GTCGGGGCTCTGTGCGGCTGCTGCATATGGGATCGGGATCGCAAGTCTCTCTGAC<br>TATAATCCCCACAGCCTTCAGCATCAGTCTCCTGGTGCGTCGGGCACAGCACCGC<br>ATCCTGATCTCTGCCATGTTCTCACAGTAAGTGCAGCACATAATCACCATGTTAT<br>TCAGCAGCCCATAATTTAGGGCGCTCCAGCCAAAGCTCATGTTGGGGATGATGG<br>AACCCACGTGACCATCGTACCAGATGCGGCAGTATATCAAGTGCCTGCCTCTCAT<br>GAACACACTGCCCATGTACA |
| SEQ ID NO: 1440 | CATCATCAATAATATACCCCACAAAGTAAACAAAAGTTAATATGCAAATGAGCT<br>TTTGAATTTTAACGGTTTTGGGGCGGAGCCAACGCTGATTGGACGAGAAGCGGT<br>GATGCAAATAACGTCACGACGCACGGCTAACGGCCGGCGCGGAGGCGTGGCCT<br>AGGCCGGAAGCAAGTCGCGGGGCTAATGACGTATAAAAAAGCGGACTTTAGAC<br>CCGGAAACGGCCGATTTTCCCGCGGCCACGCCCGGATATGAGGTAATTCTGGGC<br>GGATGCAAGTGAAATTAGGTCATTTTGGCGCCAAAACTGAATGAGGAAGTGAAA<br>AGTGAAAAATACCTGTCCCGCCCAGGGCGGAATATTTACCGAGGGCCGAGAGAC<br>TTTGACCGATTACGTGGGGTTTCGATTGCGGTGTTTTTTTCGCGAATTTCCGCGTC<br>CGTGTGAAAGTCCGGTGTTTATGTCACAGATCAGCTGATCCACAGGGTATTTAAA<br>CCAGTTGAGCCCGTCAAGAGGCCACTCTTGAGTGCCAGCGAGTAGAGATTTCTC<br>TGAGCTCCGCTCCCAAAGTGTGAGAAAAATGAGACACCTGCGCCTCCTGTCTTC |

TABLE 7-continued

Nucleic Acid Sequences of Vectors

SEQ ID NO Sequence

AACTGTGCCTATTAACATGGCCGCATTATTGCTGGAGGACTATGTGAGTACAGTA
TTGGAGGACGAACTACATCCATCTCCATTTGAGCTGGGACCTACACTTCAGGACC
TTTATGATTTGGAGGTAGATGCCCATGATGACGACCCAAACGAAGAGGCTGTGA
ATTTAATATTTCCAGAATCTCTGATTCTTCAGGCTGACATAGCCAGCGAAGCTGT
ACCTACACCACTTCATACACCGACTTTGTCACCCATACCTGAATTGGAAGAGGA
GGACGAGTTAGACCTCCGATGTTATGAGGAAGGTTTTCCTCCCAGCGATTCAGA
GGACGAACAGGGTGAGCAGAGCATGGCTCTAATCTCAGAATATGCTTGTGTGGT
TGTGGAAGAGCATTTTGTGTTGGACAATCCTGAGGTGCCCGGGCAAGGCTGTAG
ATCCTGCCAGTACCACCGGGATAAGACCGGAGACACAAACGCCTCCTGCGCTCT
GTGTTACATGAAAAAGAACTTCAGCTTTATTTACAGTAAGTGGAGTGAATGTGA
GAGAGGCTGAGTGCTTAACACATAACTGGGTGATGCTTAAACAGCTGTGCTAAG
TGTGGTTTATTTTTGTTTCTAGGTCCGGTGTCAGAGGATGAGTCATCGCCCTCAG
AAGAAAACCACCCGTGTCCCCCTGAGCTGTCAGGCGAAACGCCCCTGCAAGTGC
ACAAACCCACCCCAGTCAGACCCAGTGGCGAGAGGCGAGCAGCTGTTGAAAAA
ATTGAGGACTTGTTACATGACATGGGTGGGGATGAACCTTTGGACCTGAGCTTG
AAACGCCCCAGGAACTAGGCGCAGCTGTGCTTAGTCATGTGTAAATAAAGTTGT
ACAATAAAAGTATATGTGACGCATGCAAGGTGTGGTTTATGACTCATGGGCGGG
GCTTAGTCCTATATAAGTGGCAACACCTGGGCACTGGGCACAGACCTTCAGGGA
GTTCCTGATGGATGTGTGGACTATCCTTGCAGACTTTAGCAAGACACGCCGGCTT
GTAGAGGATAGTTCAGACGGGTGCTCCGGGTTCTGGAGACACTGGTTTGGAACT
CCTCTATCTCGACTGGTGTACACAGTTAAGAAGGATTATAACGAGGAATTTGAA
AATCTTTTTGCTGATTGCTCTGGCCTGCTAGATTCTCTGAATCTCGGCCACCAGTC
CCTTTTCCAGGAAAGGGTACTCCACAGCCTTGATTTTTCCAGCCCAGGGCGCACT
ACAGCCGGGGTTGCTTTTGTGGTTTTTCTGGTTGACAAATGGAGCCAGAACACCC
AACTGAGCAGGGGCTACATTCTGGACTTCGCAGCCATGCACCTGTGGAGGGCAT
GGGTGAGGCAGCGGGGACAGAGAATCTTGAACTACTGGCTTATACAGCCAGCAG
CTCCGGGTCTTCTTCGTCTACACAGACAAACATCCATGTTGGAGGAAGAAATGA
GGCAGGCCATGGACGAGAACCCGAGGAGCGGCCTGGACCCTCCGTCGGAAGAG
GAGCTGAATTGAATCAGGTATCCAGCTTGTACCCAGAGCTTAGCAAGGTGCTGA
CATCCATGGCTAGGGGAGTGAAGAGGGAGAGGAGCGATGGGGCAATACCGGG
ATGATGACCGAGCTGACGGCCAGCCTGATGAATCGCAAGCGCCCAGAGCGCATT
ACCTGGCACGAGCTACAGATGGAGTGCAGGGATGAGTTGGGCCTGATGCAGGAT
AAATATGGCCTGGAGCAGATAAAAACACATTGGTTGAACCCAGATGAGGATTGG
GAGGAGGCCATTAAGAAATATGCCAAGATAGCCCTGCGCCCAGATTGCAAGTAC
ATAGTGACCAAGACCGTGAATATTAGACATGCCTGCTACATTTCAGGGAACGGG
GCAGAGGTGGTCATCGATACCCTGGACAAGGCCGCCTTCAGGTGTTGCATGATG
GGAATGAGAGCAGGAGTGATGAATATGAATTCCATGATCTTCATGAACATGAAG
TTCAATGGAGAGAAGTTTAATGGGGTGCTGTTCATGGCCAACAGCCACATGACC
CTGCATGGCTGCAGTTTCTTTGGCTTCAACAATATGTGCGCCGAGGTCTGGGGCG
CTTCCAAGATCAGGGGATGTAAGTTTTATGGCTGCTGGATGGGCGTGGTCGGAA
GACCTAAGAGCGAGATGTCTGTGAAGCAGTGTGTGTTTGAGAAATGCTACCTGG
GAGTCTCTACCGAGGGCAATGCTAGAGTGAGACACTGCTCTTCCCTGGATACGG
GCTGCTTCTGCCTGGTGAAGGGTACGGCCTCTCTGAAGCATAATATGGTGAAGG
GCTGCACAGATGAGCGCATGTACAACATGCTAACATGCGACTCGGGGGTCTGTC
ATATCCTGAAGAACATCCATGTGACCTCCCACCCCAGAAAGAAGTGGCCAGTGT
TTGAGAATAACCTGCTGATCAAGTGCCATATGCACCTGGGTGCCAGAAGGGGCA
CCTTCCAGCCGTACCAGTGCAACTTTAGCCAGACCAAGCTGCTGTTGGAAAACG
ATGCCTTCTCCAGGGTGAACCTGAACGGCATCTTTGACATGGATGTCTCGGTGTA
CAAGATCCTGAGATACGATGAGACCAAGTCCAGGGTGCGCGCTTGCGAGTGCGG
GGGCAGACACACCAGGATGCAGCCAGTGGCCCTGGATGTGACCGAGGAGCTGA
GACCAGACCACCTGGTGATGGCCTGTACCGGGACCGAGTTCAGCTCCAGTGGGG
AGGACACAGATTAGAGGTAGGTTTGAGTAGTGGGCGTGGCTAATGTGAGTATAA
AGGCGGGTGTCTTACGAGGGTCTTTTTGCTTTTCTGCAGACATCATGAACGGGAC
CGGCGGGCCTTCGAAGGGGGGCTTTTTAGCCCTTATTTGACAACCCGCCTGCCG
GGATGGGCCGGAGTTCGTCAGAATGTGATGGGATCTACGGTGGATGGGCGTCCA
GTGCTTCCAGCAAATTCCTCGACCATGACCTACGCGACCGTGGGGAGCTCGTCG
CTTGACAGCACCGCCGCAGCCGCGGCAGCCGCAGCCGCCATGACAGCGACGAG
ACTGGCCTCGAGCTATATGCCCAGCAGCGGTAGCAGCCCCTCTGTGCCCAGTTCC
ATCATCGCCGAGGAGAAACTGCTGGCCCTGCTGGCCGAGCTGGAAGCCCTGAGC
CGCCAGCTGGCCGCCCTGACCCAGCAGGTGTCCGATCTCCGCGAGCAACAGCAG
CAGCAAAATAAATGATTCAATAAACACAGATTCTGATTCAAACAGCAAAGCATC
TTTATTATTTATTTTTTCGCGCGCGGTAGGCCCTGGTCCACCTCTCCCGATCATTG
AGAGTGCGGTGGATTTTTTCCAGGACCCGGTAGAGGTGGGATTGGATGTTGAGG
TACATGGGCATGAGCCCGTCCCGGGGGTGGAGGTAGCACCACTGCATGGCCTCG
TGCTCTGGGGTCGTGTTGTAGATAATCCAGTCATAGCAGGGGCGCTGGGCGTGG
TGCTGGATGATGTCCTTGAGGAGGAGACTGATGGCCACGGGGAGCCCCTTGGTG
TAGGTGTTGGCAAAGCGGTTAAGCTGGGAGGGATGCATGCGGGGGGAGATGAT
GTGCAGTTTGGCCTGGATCTTGAGGTTGGCGATGTTGCCACCCAGATCCCGCCGG
GGGTTCATATTGTGCAGGACCACCAGAACGGTGTAGCCCGTGCACTTGGGGAAC
TTATCATGCAACTTGGAAGGGAATGCGTGGAAGAATTTGGAGACGCCCTTGTGC
CCGCCCAGGTTTTCCATGCACTCATCGATGATGGCAATGGGCCGTGGGCTG
CGGCTTTGGCAAAAACGTTTCTGGGTCAGAGACATCATAATTATGCTCCTGGGT
GAGATCATCATAAGACATTTTAATGAATTTGGGGCGAAGGGTGCCAGATTGGGG
GACGATCGTTCCCTCGGGCCCCGGGGCGAAGTTCCCCTCGCAGATCTGCATCTCC
CAGGCTTTCATCTCGGAGGGGGGATCATGTCCACCTGCGGGGCGATGAAAAAAA
ACGGTTTCCGGGGCGGGGGTGATGAGCTGCGAGGAGAGCAGGTTTCTTAACAGC

TABLE 7-continued

Nucleic Acid Sequences of Vectors

| SEQ ID NO | Sequence |
|---|---|
| | TGGGACTTGCCGCACCCGGTCGGGCCGTAGATGACCCCGATGACGGGTTGCAGG<br>TGGTAGTTCAAGGAGATGCAGCTGCCGTCGTCCCGGAGGAGGGGGGCCACCTCG<br>TTGAGCATGTCTCTCACTTGGAGGTTTTCCCGGACGAGCTCGCCGAGGAGGCGGT<br>CCCCGCCCAGCGAGAGCAGCTCTTGCAGGGAAGCAAAGTTTTTCAGGGGCTTGA<br>GCCCGTCGGCCATGGGCATCTTGGCAAGGGTCTGCGAGAGGAGCTCCAGGCGGT<br>CCCATAGCTCGGTGACGTGCTCTACGGCATCTCGATCCAGCAGACTTCCTCGTTT<br>CGGGGGTTGGGACGACTGCGACTGTAGGGCACGAGACGATGGGCGTCCAGCGC<br>GGCCAGCGTCATGTCCTTCCAGGGTCTCAGGGTCCGAGTGAGGGTGGTCTCCGTC<br>ACGGTGAAGGGGTGGGCCCCGGGCTGGGCGCTTGCAAGGGTGCGCTTGAGACTC<br>ATCCTGCTGGTGCTGAAACGGGCACGGTCTTCGCCCTGCGCGTCGGCGAGATAG<br>CAGTTGACCATGAGCTTGTAGTTAAGGGCCTCGGCGGCGTGGCCCTTGGCACGG<br>AGCTTGCCTTTGGAAGAGCGCCCGCAGGCGGGACAGAGGAGGGATTGCAGGGC<br>GTAGAGCTTGGGTGCGAGAAAGACGGACTCGGGAGCGAAGGCGTCCGCTCCGC<br>AGTGGGCGCAGACGGTCTCGCACTCGACGAGCCAGGTGAGCTCGGGCTGCTCGG<br>GGTCAAAAACCAGTTTTCCCCCGTTCTTTTTGATGCGCTTCTTACCTCGCGTCTCC<br>ATGAGTCTGTGTCCGCGTTCGGTGACAAACAGGCTGTCTGTGTCCCCGTAGACGG<br>ACTTGATTGGCCTGTCCTGCAGGGGCGTCCCGCGGTCCTCCTCGTAGAGAAACTC<br>GGACCACTCTGAGACAAAGGCGCGCGTCCACGCCAAGACAAAGGAGGCCACGT<br>GCGAGGGGTAGCGGTCGTTGTCCACCAGGGGGTCCACCTTTTCCACCGTGTGCA<br>GACACATGTCCCCCTCCTCCGCATCCAAGAAGGTGATTGGCTTGTAGGTGTAGGC<br>CACGTGACCGGGGGTCCCCGACGGGGGGGTATAAAAGGGGGCGGGTCTGTGCTC<br>GTCCTCACTCTCTTCCGCGTCGCTGTCCACGAGCGCCAGCTGTTGGGGTAGGTAT<br>TCCCTCTCGAGAGCGGGCATGACCTCGGCACTCAGGTTGTCAGTTTCTAGAAACG<br>AGGAGGATTTGATGTTGGCCTGCCCTGCCGCAATGCTTTTTAGGAGACTTTCATC<br>CATCTGGTCAGAAAAGACTATTTTTTTATTGTCAAGCTTGGTGGCAAAGGAGCCA<br>TAGAGGGCGTTGGAGAGAAGCTTGGCGATGGATCTCATGGTCTGATTTTTGTCAC<br>GGTCGGCGCGCTCCTTGGCCGCGATGTTGAGCTGGACATACTCGCGCGCGACAC<br>ACTTCCATTCTGGGAAGACGGTGGTGCGCTCGTCGGGCACGATCCTGACGCGCC<br>AGCCGCGATTATGCAGGGTGACCAGGTCCACGCTGGTGGCCACCTCGCCGCGCA<br>GGGGCTCGTTGGTCCAGCAGAGGCGTCCGCCCTTGCGCGAGCAGAACGGGGGCA<br>GCACATCAAGCAGATGCTCGTCAGGGGGGTCCGCATCGATGGTGAAGATGCCCG<br>GACAGAGTTCCTTGTCAAAATAATCGATTTTTGAGGATGCATCATCCAAGGCCAT<br>CTGCCACTCGCGGGCGGCCAGCGCTCGCTCGTAGGGGTTGAGGGGCGGACCCCA<br>GGGCATGGGATGCGTGAGGGCGGAGGCGTACATGCCGCAGATGTCGTAGACAT<br>AGATGGGCTCCGAGAGGATGCCGATGTAGGTGGGATAACAGCGCCCCCGCGG<br>ATGCTGGCGCGCACATAGTCATACAACTCGTGCGAGGGGGCCAAGAAAGCGGG<br>GCCGAGATTGGTGCGCTGGGGCTGCTCGGCGCGGAAGACGATCTGGCGAAAGAT<br>GGCATGCGAGTTGGAGGAGATGGTGGGCCGTTGGAAGATGTTAAAGTGGGCGTG<br>GGGCAAGCGGACCGAGTCGCGGATGAAGTGCGCGTAGGAGTCTTGCAGCTTGGC<br>AACGAGCTCGGCGGTGACAAGGACGTCCATGGCGCAGTAGTCCAGCGTTTCACG<br>GATGATGTCATAACCCGCCTCTTCTTTCTTCTCCCACAGCGCGCGGTTGAGGGCG<br>TACTCCTCGTCATCCTTCCAGTACTCCCGGAGCGGGAATCCTCGATCGTCCGCAC<br>GGTAAGAGCCCAGCATGTAGAAATGGTTCACGGCCTTGTAGGGACAGCAGCCCT<br>TCTCCACGGGGAGGGCGTAAGCTTGAGCGGCCTTGCGGAGCGAGGTGTGCGTCA<br>GGGCGAAGGTATCCCTAACCATGACTTTCAAGAACTGGTACTTGAAATCCGAGT<br>CGTCGCAGCCGCCGTGCTCCCAGAGCTCGAAATCGGTGCGCTTCTTCGAGAGGG<br>GGTTAGGCAGAGCGAAAGTGACGTCATTGAAGAGAATCTTGCCTGCCCGCGGCA<br>TGAAATTGCGGGTGATGCGGAAAGGGCCCGGAACGGAGGCTCGGTTGTTGATGA<br>CCTGGGCGGCGAGGACGATCTCGTCGAAGCCGTTGATGTTGTGCCCGACGATGT<br>AGAGTTCCATGAATCGCGGGCGGCCTTTGATGTGCGGCAGCTTTTTGAGTTCCTC<br>GTAGGTGAGGTCCTCGGGGCATTGCAGGCCGTGCTGCTCGAGCGCCCACTCCTG<br>GAGATGTGGGTTGGCTTGCATGAATGAAGCCCAGAGCTCGCGGGCCATGAGGGT<br>CTGGAGCTCGTCGCGAAAGAGGCGGAACTGCTGGCCCACGGCCATCTTTTCTGG<br>GGTGACGCAGTAGAAGGTGAGGGGGTCCCGCTCCCAGCGATCCCAGCGTAAGCG<br>CACGGCGAGATCGCGAGCGAGGGCGACCAGCTCGGGGTCCCCGGAGAATTTCAT<br>GACCAGCATGAAGGGGACGAGCTGCTTGCCGAAGGACCCCATCCAGGTGTAGGT<br>TTCTACATCGTAGGTGACAAAGAGCCGCTCCGTGCGAGGATGAGAGCCGATTGG<br>GAAGAACTGGATTTCCTGCCACCAGTTGGTCGAGTGGCTGTTGATGTGATGAAA<br>GTAGAAATCCCGCCGGCGAACCGAGCACTCGTGCTGATGCTTGTAAAAGCGTCC<br>GCAGTACTCGCAGCGCTGCACGGGCTGTACCTCATCCACGAGATACACAGCGCG<br>TCCCTTGAGGAGGAACTTCAGGAGTGGCGGCCCTGGCTGGTGGTTTTCATGTTCG<br>CCTGCGTGGGACTCACCCTGGGGCTCCTCGAGGACGGAGAGGCTGACGAGCCCG<br>CGCGGGAGCCAGGTCCAGATCTCGGCGCGGCGGGGGCGGAGCGCGAAAACGAG<br>GGCGCGCAGTTGGGAGCTGTCCATGGTGTCGCGGAGATCCAGGTCCGGGGCAG<br>GGTTCTGAGGTTGACCTCGTAGAGGCGGGTGAGGGCGTGCTTGAGATGCAGATG<br>GTACTTGATCTCCACGGGTGAGTTGGTGGTCGTGTCCACGCATTGCATGAGCCCG<br>TAGCTGCGCGGGGCCACGACCGTGCCGCGGTGCGCTTTTAGAAGCGGTGTCGCG<br>GACGCGCTCCCGGCGGCAGCGGCGGTTCCGGCCCCGCGGGCAGTGGCGGTAGAG<br>GCACGTCGGCGTGGCGCTCGGGCAGGTCCCGGTGCTGCGCCCTGAGAGCGCTGG<br>CGTGCGCGACGACGCGGCGGTTGACATCCTGGATCTGCCGCCTTTGCGTGAAGA<br>CCACGGGCCCCGTGACTTTGAACCTGAAAGACAGTTCAACAGAATCAATCTCGG<br>CGTCATTGACGGCGGCCTGACGCAGGATCTCTTGCACGTCGCCCGAGTTGTCCTG<br>GTAGGCGATCTCGGACATGAACTGCTCGATTTCCTCCTCCTGGAGATCGCCGCGG<br>CCCGCGCGCTCTACGGTGGCGGCAAGGTCATTCGAGATGCGACCCATGAGCTGC<br>GAGAAGGCGCCCAGGCCGCTCTCGTTCCAGACGCGGCTGTAAACCACGTCCCCG<br>TCGGCGTCGCGCGCGCGCATGACCACCTGCGCGAGGTTGAGCTCCACGTGCCGC |

TABLE 7-continued

Nucleic Acid Sequences of Vectors

SEQ ID NO Sequence

GTAAAGACGGCGTAGTTGCGCAGGCGCTGGAAGAGGTAGTTGAGGGTGGTGGC
GATGTGCTCGGTGACGAAGAAGTACATAATCCAGCGGCGCAGGGGCATTTCGCT
GATGTCGCCAATGGCCTCCAGCCTTTCCATGGCCTCGTAGAAATCCACGGCGAA
GTTGAAAAACTGGGCGTTGCGGGCCGAGACCGTGAGCTCGTCTTTCCAGGAGCCT
GATGAGTTCGGCGATGGTGGCGCGCACCTCGCGCTCGAAATCCCAGGGGGCCTC
CTCCTCTTCCTCTTCTTCCATGACGACCTCTTCTTCTATTTCTTCCTCTGGGGCG
GTGGTGGTGGCGGGGCCCGACGACGACGGCGACGCACCGGGAGACGGTCGACG
AAGCGCTCGATCATCTCCCCGCGGCGGCGACGCATGGTTTCGGTGACGGCGCGA
CCCCGTTCGCGAGGACGCAGCGTGAAGACGCCGCCGGTCATCTCCCGGTAATGG
GGTGGGTCCCCGTTGGGCAGCGATAGGGCGCTGACAATGCATCTTATCAATTGC
GGTGTAGGGCACGTGAGCGCGTCGAGATCGACCGGATCGGAGAATCTTTCGAGG
AAAGCGTCTAGCCAATCGCAGTCGCAAGGTAAGCTCAAACACGTAGCAGCCCTG
TGGACGCTGTTAGAATTGCGGTTGCTGATGATGTAATTGAAGTAGGCGTTTTTGA
GGCGGCGGATGGTGGCGAGGAGGACCAGGTCCTTGGGTCCCGCTTGCTGGATGC
GGAGCCGCTCGGCCATGCCCCAGGCCTGGCCCTGACACCGGCTCAGGTTCTTGT
AGTAGTCATGCATGAGCCTCTCGATGTCATCACTGGCGGAGGCGGAGTCTTCCAT
GCGGGTGACCCCGACGCCCCTGAACGGCTGCACGAGCGCCAGGTCGGCGACGAC
GCGCTCGGCGAGGATGGCCTGTTGCACGCGGGTGAGGGTGTCCTGGAAGTCGTC
CATGTCGACGAAGCGGTGGTAGGCCCCTGTGTTGATGGTGTAAGTGCAGTTGGC
CATAAGCGACCAGTTGACGGTCTGCAGGCCGGGTTGCACGACCTCGGAGTACCT
GAGCCGCGAGAAGGCGCGCGAGTCGAAGACATAGTCGTTGCAGGTGCGCACGA
GGTACTGGTATCCGACTAGAAAGTGCGGCGGCGGCTGGCGGTAGAGCGGCCAGC
GCTGGGTGGCCGGCGCGCCCGGGGCCAGGTCCTCAAGCATGAGTCGGTGGTAGC
CGTAGAGGTAGCGGGACATCCAGGTGATGCCGGCGGCGGTGGTGGAGGCGCGC
GGGAACTCGCGGACGCGGTTCCAGATGTTGCGCAGGGGCAGGAAATAGTCCATG
GTCGGCACGGTCTGGCCGGTGAGACGCGCGCAGTCATTGATGCTCTAGAGGCAA
AAACGAAAGCGGTTGAGCGGGCTCTTCCTCCGTAGCCTGGCGGAACGCAAACGG
GTTAGGCCGCGTGTGTACCCCGGTTCGAGTCCCCTCGAATCAGGCTGGAGCCGC
GACTAACGTGGTATTGGCACTCCCGTCTCGACCCAAGCCCGATAGCCGCCAGGA
TACGGCGGAGAGCCCTTTTTGTCGGCCGAGGGGAGTCGCTAGACTTGAAAGCGG
CCGAAAACCCTGCCGGGTAGTGGCTCGCGCCCGTAGTCTGGAGAAGCATCGCCA
GGGTTGAGTCGCGGCAGAACCCGGTTCAAGGACGGCCGCGGCGAGCGGGACTT
GGTCACCCCGCCGATTTAAAGACCCACAGCCAGCCGACTTCTCCAGTTACGGGA
GCGAGCCCCCTTTTTTCTTTTTGCCAGATGCATCCCGTCTTCCTGCGCCAAATGCGTCC
CACCCCCCCGGCGACCACCGCGACCGCGGCCGTAGCAGGCGCCGGCGCTAGCCA
GCCACAGCCACAGACAGAGATGGACTTGGAAGAGGGCGAAGGGCTGGCGAGAC
TGGGGGCGCCGTCCCCGGAGCGACATCCCCGCGTGCAGCTGCAGAAGGACGTGC
GCCCGGCGTACGTGCCTGCGCAGAACCTGTTCAGGGACCGCAGCGGGGAGGAGC
CCGAGGAGATGCGCGACTGCCGGTTTCGGGCGGGCAGGGAGCTGCGCGAGGGC
CTGGACCGCCAGCGCGTGCTGCGCGACGAGGATTTCGAGCCGAACGAGCAGACG
GGGATCAGCCCCGCGCGCGCGCACGTGGCGGCGGCCAACCTGGTGACAGCCTAC
GAGCAGACGGTGAAGCAGGAACGCAACTTTCAAAAGAGTTTCAACAACCACGT
GCGCACCCTGATCGCGCGCGAGGAGGTGGCCCTGGGCCTGATGCACCTGTGGGA
CCTGGCCGGAGGCCATTGTGCAGAACCCGGACAGCAAGCCTCTGACGGCACAACT
GTTCCTGGTGGTGCAGCACAGCAGGGACAACGAGGCGTTCAGGGAGGCGCTGCT
AAACATCGCCGAGCCCGAGGGCCGCTGGCTGCTGGAGCTGATCAACATCTTGCA
AAGCATCGTAGTGCAGGAGCGCAGCCTGAGCTTGGCCGAGAAGGTGGCGGCGA
TCAACTACTCGGTGCTAAGCCTGGGCAAGTTTTACGCGCGCAAGATTTACAAGA
CGCCGTACGTGCCCATAGACAAGGAGGTGAAAATAGACAGCTTTTACATGCGCA
TGGCGCTCAAGGTGCTGACGCTGAGCGACGACCTGGGCGTGTACCGCAACGACC
GCATCCACAAGGCCGTGAGCACGAGCCGGCGGCGCGAGCTGAGCGACCGCGAG
CTGATGCTAAGCCTGCGCCGGGCGCTGGTAGGTGGCGCCGCCGGCGGCGAGGAG
TCCTACTTCGACATGGGGGCGGACCTGCATTGGCAGCCGAGCCGGCGCGCCTTG
GAGGCCGCCTACGGTCCAGAGGACTTGGATGAGGATGAGGAAGAGGAGGAGGA
TGCACCCGTTGCGGGGTACTGACGCCTCCGTGATGTGTTTTTAGATGTCCCAGCA
GCAAGCCCCGGACCCCGCCATAAGGGCGGCGCTGCAAAGCCAGCCGTCCGGTCT
AGCATCGGACGACTGGGAGGCCGCGATGCAACGCATCATGGCCCTGACGACCCG
CAACCCCGAGTCCTTTAGACAACAGCCGCAGGCCAACAGACTTTCGGCCATTCT
GGAGGCGGTGGTCCCCTCTCGGACCAACCCCACGCACGAGAAGGTGCTGGCGAT
CGTGAACGCGCTGGCGGAGAACAAGGCTATTCGTCCCGACGAGGCTGGGCTGGT
ATACAACGCCCTGCTGGAGCGCGTGGGCCGCTACAACAGCACGAACGTGCAGTC
CAACCTGGACCGGCTGGTGACGGACGTGCGCGAGGCCGTGGCGCAGCGCGAGC
GGTTCAAGAACGAGGGCCTGGGCTCGCTGGTGGCGCTGAACGCCTTCCTGGCGA
CGCAGCCGGCGAACGTGCCGCGCGGGCAGGACGATTATACCAACTTTATCAGCG
CGCTGCGGCTGATGGTGACCGAGGTTCCCCAGAGCGAGGTGTACCAGTCGGGCC
CGGACTACTTTTTCCAGACTAGCAGACAGGGCCTGCAGACGGTGAACCTGAGCC
AGGCTTTCAAGAACCTGCGCGGGCTGTGGGGCGTGCAGGCGCCCGCTGGGCGACC
GGTCGACGGTGAGCAGCTTGCTGACGCCCAACTCGCGGCTGCTGCTGCTGCTGA
TCGCGCCCTTCACCGACAGCGGCAGCGTGAACCGCAACTCGTACCTGGGTCACC
TGCTGACGCTGTACCGCGAGGCCATAGGCCAGGCACAGGTGGACGAGCAGACCT
TCCAGGAGATCACTAGTGTAAGCCGCGCGCTGGGTCAGAACGACACCGACAGTC
TGAGGGCCACCCTGAACTTCTTGCTGACCAATAGACAGCAGAAGATCCCGGCGC
AGTATGCGCTGTCGGCCGAGGAGGAGCGCATCCTGAGATATGTGCAGCAGAGCG
TAGGGCTGTTTCTGATGCAGGAGGGGCCACCCCCAGCGCCCGCGCTGGACATGA
CCGCGCGCAACATGGAACCTAGCATGTACGCCGCCAACCGGCCGTTTATCAATA
AGCTGATGGACTACCTGCACCGCGCGGCGTCCATGAACTCGGACTACTTTACCA

TABLE 7-continued

Nucleic Acid Sequences of Vectors

SEQ ID NO Sequence

ATGCCATTTTGAACCCGCACTGGCTCCCGCCGCCGGGGTTCTACACGGGCGAGT
ACGACATGCCTGACCCCAACGACGGGTTTTTGTGGGACGACGTGGACAGCGCGG
TGTTCTCACCGACCTTGCAAAAGCGCCAGGAGGCGGTGCGCACGCCCGCGAGCG
AGGGCACGGTGGGTCGGAGCCCCTTTCCTAGCTTAGGGAGTTTGCATAGCTTGCC
GGGCTCGGTGAACAGCGGCAGGGTGAGCCGGCCGCGCGCTTGCTGGGCGAGGACG
AGTACCTAAACGACTCGCTGCTGCAGCCGCCGCGGGTCAAGAACGCCATGGCCA
ATAACGGGATAGAGAGTCTGGTGGACAAACTGAACCGCTGGAAGACCTACGCTC
AGGACCATAGGGAGCCTGCGCCCGCCGCGGCGACAGCGCCACGACCGGCAG
CGGGGCCTGGTGTGGGACGACGAGGACTCGGCCGACGATAGCAGCGTGTTGGAC
TTGGGCGGGAGCGGTGGGGTCAACCCGTTCGCGCATCTGCAGCCCAAACTGGGG
CGACGGATGTTTTGAATGCAAAATAAAACTCACCAAGGCCATAGCGTGCGTTCT
CTTCCTTGTTAGAGATGAGGCGTGCGGTGGTGTCTTCCTCTCCTCCTCCCTCGTAC
GAGAGCGTGATGGCGCAGGCGACCCTGGAGGTTCCGTTTGTGCCTCCGCGGTAT
ATGGCTCCTACGGAGGGCAGAAACAGCATTCGTTACTCAGAGCTGGCTCCGCTG
TACGACACCACTCGCGTGTACTTGGTGGACAACAAGTCGGCGGACATCGCTTCC
CTGAACTACCAAAACGACCACAGCAACTTTCTGACCACGGTGGTGCAAAACAAC
GATTTCACCCCCGCCGAGGCTAGCACGCAGACGATAAATTTTGACGAGCGGTCG
CGGTGGGGCGGTGATCTGAAGACCATTCTGCACACCAACATGCCCAATGTGAAC
GAGTACATGTTTACCAGCAAGTTTAAGGCGCGGGTGATGGTGGCTAGGAAACAC
CCACAGGGGTAGAAGCAACAGATTTAAGCAAGGATATCTTAGAGTACCAGTGG
TTTGAGTTTACCCTGCCCGAGGGCAACTTTTCCGAGACCATGACCATAGACCTGA
TGAACAACGCCATCTTGGAAAACTACTTGCAAGTGGGGCGGCAAAATGGCGTGC
TGGAGAGCGATATCGGAGTCAAGTTTGACAGCAGGAATTTCAAGCTGGGCTGGG
ACCCCGTGACCAAGCTGGTGATGCCAGGGGTCTACACCTATGAGGCCTTCCACC
CGGACGTGGTGCTGCTGCTGGCTGCGGGGTGGACTTCACCGAGAGCCGCCTAA
GCAACCTTCTGGGCATTCGCAAGAAGCAACCTTTCCAAGAGGGCTTCAGAATCA
TGTATGAGGATCTCGAAGGGGGCAACATTCCCGCACTTCTGAATGTGACCAAGT
ACCTGGAAAGCAAGAAGAAGCTAGAGGAGAATGCCGCTAAGGCTAATGGTCCT
GCAAGAGGAGACAGTAGTGTCTCAAGAGAGGTGGAAAAGGCAGCTGAAAAGA
GCTTGTCATTGAGCCCATCAAGCAAGATGATAGCAAGAGAAGTTACAACCTCAT
TGAGGGTACCCATGACACCCTGTACCGAAGCTGGTACCTGTCCTATACCTACGG
GGACCCCGAGAAGGGGGTGCAGTCGTGGACGCTGCTCACCACCCCGGACGTCAC
CTGCGGCGCGGAGCAAGTCTACTGGTCGCTGCCGGACCTCATGCAAGACCCCGT
CACCTTCCGCTCTACCCAGCAAGTCAGCAACTACCCCGTGGTCGGCGCCGAGCTC
ATGCCTTTCCGCGCCAAGAGCTTTTACAACGACCTCGCCGTCTACTCCCAGCTCA
TCCGCAGCTACACCTCCCTCACCCACGTCTTCAACCGCTTCCCCGACAACCAGAT
CCTCTGCCGCCCGCCCGCGCCCACCATCACCACCGTCAGTGAAAACGTGCCTGCT
CTCACAGATCACGGGACGCTACCGCTGCGCAGCAGTATCCGCAGGAGTCCAGCGA
GTGACCGTCACTGACGCCCGTCGCCGCACCTGTCCCTACGTCTACAAGGCCCTGG
GCATAGTCGCGCCGCGCGTGCTTTCCAGTCGCACCTTCTAAAAAATGTCTATTCT
CATCTCGCCCAGCAATAACACCGGCTGGGGTCTTACTAGGCCCAGCACCATGTA
CGGAGGAGCCAAGAAACGCTCCCAGCAGCACCCCGTCCGCGTCCGCGGCCACTT
TCGCGCTCCCTGGGGCGCATACAAGCGCGGGCGGACTTCCACCGCCGCCGCCGT
GCGCACCACCGTCGACGACGTCATCGACTCGGTGGTCGCCGATGCGCGCAACTA
TACCCCCGCCCCCTCCACCGTGGACGCGGTCATTGACAGCGTGGTGGCCGACGC
GCGCGACTATGCCAGACGCAAGAGCCGGCGGCGACGGATCGCCAGGCGCCACC
GGAGCACGCCCGCCATGCGCGCCGCCCGGGCTCTGCTGCGCCGCGCCAGACGCA
CGGGCCGCCGGGCCATGATGCGAGCCGCGCGCCGCGCTGCCACTGCACCCACCC
CCGCAGGCAGGACTCGCAGACGAGCGGCCGCTGCCGCCGCCGCGGCCATCTCTA
GCATGACCAGACCCAGGCGCGGAAACGTGTACTGGGTGCGCGACTCCGTCACGG
GCGTGCGCGTGCCCGTGCGCACTCGTCCTCCTCGTCCCTGATCTAATGCTTGTGT
CCTCCCCCGCAAGCGACGATGTCAAAGCGCAAAATCAAGGAGGAGATGCTCCAG
GTCGTCGCCCCGGAGATTTACGGACCCCCGGACCAGAAACCCCGCAAAATCAAG
CGGGTTAAAAAAAGGATGAGGTGGACGAGGGGGCAGTAGAGTTTGTGCGCGA
GTTCGCTCCGCGGCGGCGCGTAAATTGGAAGGGGCGCAGGGTGCAGCGTGTGTT
GCGGCCCGGCACGGCGGTGGTGTTCACGCCCGGCGAGCGGTCCTCGGTCAGGAG
CAAGCGTAGCTATGACGAGGTGTACGGCGACGACGACATCCTGGACCAGGCGGC
GGAGCGGGCGGGCGAGTTCGCCTACGGGAAGCGGTCGCGCGAAGAGGAGCTGA
TCTCGCTGCCGCTGGACGAAAGCAACCCCACGCCGAGCCTCGAAACCCGTGACCC
TGCAGCAGGTGCTGCCCCAGGCGGTGCTGCTGCCGAGCCGCGGGGTTAAGCGCG
AGGGCGAGAGCATGTACCCGACCATGCAGATCATGGTGCCCAAGCGCCGGCGCG
TGGAGGACGTGCTGGACACCGTGAAATGGATGTGGAGCCCGAGGTCAAGGTG
CGCCCCATCAAGCAGGTGGCGCCGGGCCTGGGCGTGCAAACCGTGGACATTCAG
ATCCCCACCGACATGGATGTCGACAAAAAACCCTCGACCAGCATCGAGGTGCAA
ACCGACCCCTGGCTCCCAGCCTCCACCGCTACCGTCTCCACTTCTACCGCCGCCA
CGGCCACCGAGCCTCCCAGGAGGCGAAGATGGGGCCCTGCCAACCGGCTGATGC
CCAACTACGTGTTGCATCCTTCCATCATCCCGACGCCGGGCTACCTGCGGCACCCG
GTACTACGCCAGCCGCCAGGCGCCCAGCCAGTAAACGCCGCCGCCGCACCGCCAC
CCGCCGCCGTCTGGCCCCCGCCCGCGTGCCGCCGTGACCACGCGCCGGGGCCG
CTCGCTCGTTCTGCCCACCGTGCGCTACCACCCCAGCATCCTTTAATCCGTGTGC
TGTGATACTGTTGCAGAGAGATGGCTCTCACTTGCCGCCTGCGCATCCCCGTCCC
GAATTACCGAGGAAGATCCCGCCGCAGGAGAGGCATGGCAGGCAGTGGCCTGA
ACCGCCGCCGGCGGCGGGCCATGCGCAGGCGCCTGAGTGGCGGCTTTCTGCCCG
CGCTCATCCCCATAATCGCCGCGGCCATCGGCACGATCCCGGGCATAGCTTCCGT
TGCGCTGCAGGCGTCGCAGCGCCGTTGATGTGCGAATAAAGCCTCTTTAGACTCT
GACACACCTGGTCCTGTATATTTTTAGAATGGAAGACATCAATTTTGCGTCCCTG

TABLE 7-continued

Nucleic Acid Sequences of Vectors

| SEQ ID NO | Sequence |
|---|---|
| | GCTCCGCGGCACGGCACGCGGCCGTTCATGGGCACCTGGAACGAGATCGGCACC |
| | AGCCAGCTGAACGGGGGCGCCTTCAATTGGAGCAGTGTCTGGAGCGGGCTTAAA |
| | AATTTCGGCTCGACGCTCCGGACCTATGGGAACAAGGCCTGGAATAGTAGCACT |
| | GGGCAGTTGTTAAGGGAAAAGCTCAAAGACCAGAACTTCCAGCAAAAGGTGGT |
| | GGACGGGCTGGCCTCGGGCATTAACGGGGTGGTGGACATCGCGAACCAGGCCGT |
| | GCAGCGCGAGATAAACAGCCGCCTGGACCCGCGGCCGCCCACGGTGGTGGAGA |
| | TGGAAGATGCAACTCCTCCGCCGCCCAAGGGCGAGAAGCGGCCGCGGCCCGAC |
| | GCGGAGGAGACGATCCTGCAGGTGGACGAGCCGCCCTCGTACGAGGAGGCCGT |
| | AAAGGCCGGCATGCCCACCACGCGCATCATCGCGCCACTGGCCACGGGTGTAAT |
| | GAAACCCGCCACCCTTGACCTGCCTCCACCACCCACGCCCGCTCCACCGAAGGC |
| | AGCTCCGGTAGTGCAGCCCCTCCGGTGGCGACCGCCGTGCGCCGCGTCCCCGC |
| | CCGCCGCCAGGCCCAAAACTGGCAAAGCACGCTGCACAGTATTGTGGGCCTGGG |
| | AGTGAAAAGTCTGAAGCGCCGCCGATGCTATTGAAAGAGAGGAAGGAAGACAC |
| | TAAAGGGAGAGCTTAACTTGTATGTGCCTTACCGCCAGAGAACGCGCGAAGATG |
| | GCCACCCCCTCGATGATGCCGCAGTGGGCGTACATGCACATCGCCGGGCAGGAC |
| | GCCTCGGAGTACCTGAGCCCGGGTCTGGTGCAGTTTGCCCGCGCCACCGACACG |
| | TACTTCAGCCTGGGCAACAAGTTTAGGAACCCCACGGTGGCCCCAACCCACGAT |
| | GTGACCACGGACCGGTCCCAGCGTCTGACGCTGCGCTTCGTGCCCGTGGATCGC |
| | GAGGACACCACGTACTCGTACAAGGCGCGCTTCACTCTGGCCGTGGGCGACAAC |
| | CGGGTGCTAGACATGGCCAGCACTTACTTTGACATCCGCGGCGTTCTGGACCGC |
| | GGCCCCAGCTTCAAACCCTACTCGGGCACGGCTTACAACAGCCTGGCCCCCAAG |
| | GGCGCCCCCAATTCCAGTCAGTGGGATGCTCAAGAAAAAAATGGACAAGGAGG |
| | AAATGACATGGTTACCAAAACTCACACATTTGGCGTGGCTGCTATGGGAGGAAC |
| | AAATATTACAAACCAGGGTTTGTTAATTGGAACTGAAGAAACAGCCGATAATCC |
| | TCCAAAGGAAATCTTTGCAGACAAATTATTCCAGCCAGAACCTCAAGTAGGAGA |
| | GGAAAACTGGCAAGACAGCAATGCATTCTATGGAGGCAGGGCTCTTAAGAAGG |
| | AAACTAAAATGAAACCATGCTATGGATCTTATGCTAGACCAACAAACACAAGTG |
| | GCGGACAGGCTAAGCTTAAAACTGGTGACAATATCGATCCTACCAAGGATTTCG |
| | ACATAGATCTTGCTTTCTTCGATACTCCTGGCGGAAATCCTCCAGCAGGTGGTAG |
| | TGGAACGGAAGAATACAAAGCAGATATTGTTATGTACACTGAAAATGTCAACCT |
| | TGAAACACCTGACACTCATGTGGTGTACAAACCAGCCAAAGAGGATGAAAGTTC |
| | TCAGGCCAACTTGGTTCAGCAGTCCATGCCCAACAGACCCAACTACATTGGCTTC |
| | AGAGACAATTTTGTGGGGCTCATGTATTACAACAGCACTGGCAACATGGGAGTG |
| | CTGGCTGGTCAGGCCTCTCAGTTGAATGCTGTGGTGGACTTGCAAGACAGAAAC |
| | ACAGAGCTGTCTTACCAGCTCTTGCTAGATTCTCTGGGTGACAGAACCAGATACT |
| | TTAGCATGTGGAACTCTGCGGTGGACAGCTATGATCCAGATGTCAGAATCATTG |
| | AAAATCACGGTGTGGAAGATGAGCTTCCAAACTATTGCTTTCCATTGGATGGCTC |
| | TGGTACCAATGCTGCCTACCAAGGTGTAAAGGTTCAAGATGGTGAAGACGGGGA |
| | TAAAGAAACTGAATGGGAAAAAGATACCAAAGTCGCAGATCGTAACCAACTGT |
| | GCAAGGGTAACATCTTCGCCATGGAGATCAACCTCCAGGCCAACCTGTGGAAGA |
| | GTTTTCTGTACTCGAACGTGGCCCTGTACCTGCCCGACTCCTACAAGTACACGCC |
| | GGCCAACATCACGCTGCCCGCCAACACCAACACCTACGAGTACATGAACGGCCG |
| | CGTGGTAGCCCCCTCGCTGGTGGACGCATACGTCAACATCGGTGCGCGCTGGTC |
| | GCTGGACCCCATGGACAACGTCAACCCCTTCAACCACCACCGCAACGCGGGCCT |
| | GCGCTACCGCTCCATGCTTCTCGGCAACGGCCGCTACGTGCCCTTCCACATCCAA |
| | GTGCCCCAAAAGTTCTTTGCCATTAAGAACCTGCTCCTGCTCCCCGGCTCCTACA |
| | CCTACGAGTGGAACTTCCGCAAGGATGTCAACATGATCCTGCAGAGTTCCCTCG |
| | GAAACGACCTGCGCGTCGACGGCGCCTCCGTGCGCTTCGACAGCGTCAACCTCT |
| | ACGCTACCTTCTTCCCCATGGCGCACAACACCGCCTCCACCCTGGAAGCCATGCT |
| | GCGCAACGACACCAACGACCAGTCCTTTAACGACTACCTCTCGGCCGCCAACAT |
| | GCTCTACCCCATACCGGCCAAGGCCACCAACGTGCCCATCTCCATCCCTCGCGC |
| | AACTGGGCTGCCTTCCGCGGCTGGAGTTTCACCCGGCTCAAGACCAAGGAAACT |
| | CCTTCCCTTGGCTCGGGTTTCGACCCCTACTTTGTCTACTCGGGCTCCATCCCCTA |
| | CCTCGACGGGACCTTCTACCTCAACCACACCTTCAAAAAGGTGTCCATTATGTTC |
| | GACTCCTCGGTCAGCTGGCCCGGCAACGACCGGCTGCTCACGCCGAATGAGTTC |
| | GAGATCAAGCGCAGCGTCGACGGGGAGGGCTACAACGTGGCCCAATGCAACAT |
| | AACCAAGGACTGGTTCCTCGTCCAGATGCTCTCCCACTACAACATCGGCTACCAG |
| | GGCTTCCACGTGCCCGAGGGCTACAAGGACCGCATGTACTCCTTTTTCCGCAACT |
| | TCCAGCCCATGAGCAGGCAGGTGGTGGATGAGATCAACTACAAGGACTACAAG |
| | GCCGTCACCCTGCCCTTCCAGCACAACAACTCTGGCTTCACCGGCTACCTCGCAC |
| | CCACCATGCGTCAGGGGCAGCCTTACCCCGCCAACTTCCCTTACCCGCTCATCGG |
| | CTCCACCGCAGTCCCCTCCGTCACCCAGAAAAAGTTCCTCTGCGACAGGGTCATG |
| | TGGCGCATCCCCTTCTCCAGCAACTTCATGTCCATGGGTGCCCTCACCGACCTGG |
| | GTCAGAACATGCTCTATGCCAACTCGGCCCACGCGCTCGACATGACCTTCGAGG |
| | TGGACCCCATGGATGAGCCCACCCTCCTCTATCTTCTCTTCGAAGTTTTCGACGT |
| | GGTCAGAGTGCACCAGCCGCACCGCGGCGTCATCGAGGCCGTCTACCTGCGCAC |
| | ACCCTTCTCCGCCGGCAACGCCACCACCTAAGCATGAGCGGTTCCAGCGAACGA |
| | GAACTCGCGGCCATCGTGCGCGACCTGGGCTGCGGGCCCTACTTTTTGGGCACCC |
| | ACGACAAGCGCTTCCCGGGCTTCCTAGCCGGCGACAAGCTGGCCTGCGCCATCG |
| | TCAACACGGCCGGCGCGAGACCGGAGGCGTGCACTGGCTCGCCTTCGGCTGGA |
| | ACCCGCGCTCGCGCACCTGCTACATGTTCGACCCCTTTGGGTTCTCGGACCGCGG |
| | GCTCAAGCAGATTTACAGCTTCGAGTACGAGGCCATGCTGCGCCGAAGCGCCCT |
| | GGCCTCCTCGCCCGACCGCTGTCTCAGCCTCGAACAGTCCACCCAGACCGTGCA |
| | GGGGCCCGACTCCGCCGCCTGCGGACTTTTTTGTTGCATGTTCTTGCATGCGTTC |
| | GTGCACTGGCCCGACCGACCCATGGACGGAAAACCCCACCATGAACTTGCTGACG |
| | GGGGTGCCCAACGGCATGCTACAATCGCCACAGGCTGCCCACCCCTCCGGCGC |

TABLE 7-continued

Nucleic Acid Sequences of Vectors

SEQ ID NO Sequence

```
AACCAGGAGGAGCTCTACCGCTTCCTCGCGCGCCACTCCCCTTACTTCCGATCCC
ACCGCGCCGCCATCGAACACGCCACCGCTTTTGACAAAATGAAACAACTGCGTG
TATCTCAATAAACAGCACTTTTATTTTACATGCACTGGAGTATATGCAAGTTATT
TAAAAGTCGAAGGGGTTCTCGCGCTCGTCGTTGTGCGCCGCGCTGGGGAGGGCC
ACGTTGCGGTACTGGTACTTGGAAAGCCACTTGAACTCGGGGATCACCAGTTTG
GGCACTGGGGTCTCGGGGAAGGTCTCGCTCCACATGCGCCGGCTCATCTGCAGG
GCGCCCAGCATGTCAGGGCCGGAGATCTTGAAATCACAGTTGGGGCCGGTGCTC
TGCGCGCGCGAGTTGCGGTACACGGGGTTGCAGCACTGGAACACCATCAGACTG
GGGTACTTCACACTGGCAAGCACGCTCTTGTCGCTAATCTGATCCTTGTCCAGGT
CCTCGGCGTTGCTCAGGCCGAACGGGGTCATCTTGCACAGCTGGCGGCCCAGGA
AGGGCACGCTCTGAGGCTTGTGGTTACACTCGCAGTGCACGGGCATCAGCATCA
TCCCCGCGCCGCGCTGCATATTCGGGTAGAGGGCCTTGACGAAGGCCGCGATCT
GCTTGAAAGCTTGCTGGGCCTTGGCCCCCTCGCTGAAGAACAGACCGCAGCTCTT
CCCGCTGAACTGGTTATTCCCGCACCCGGCATCATGCACGCAGCAGCGCGCGTC
ATGGCTGGTCAGTTGCACCACGCTCCGTCCCCAGCGGTTCTGGGTCACCTTAGCC
TTGCTGGGCTGCTCCTTCAGCGCGCGCTGTCCGTTCTCGCTGGTCACATCCATCTC
CACCACGTGGTCCTTGTGAATCATCACCGTTCCATGCAGACACTTGAGCTGACCT
TCCACCTCGGTGCAGCCGTGATCCCACAGGACGCAGCCGGTGCACTCCCAATTCT
TGTGCGCGATCCCGCTGTGGCTGAAAATGTAACCTTGCAACAGGCGACCCATAA
TGGTGCTAAATGATTTCTGGGTGGTGAATGTCAGTTGCATCCCGCGGGCCTCCTC
GTTCATCCAGGTCTGGCACATCTTCTGGAAGATCTCGGTCTGCTCCGGCATGAGC
TTGTAAGCATCGCGCAAGCCGCTGTCGACGCGGTAGCGTTCCATCAGCACGTTC
ATGGTATCCATGCCCTTCTCCCATGACGAGACCAGAGGCAGACTCAGGGGGTTG
CGCACGTTCAGGACACCAGGGGTCGCGGGCTCGACGATGCGTTTTCCGTCCTTGC
CTTCCTTCAACAGAACCGGAGGCTGGCTGAATCCCACTCCCACGATCACGGCGT
CTTCCTGGGGCATCTCTTCGTCGGGGTCTACCTTGGTCACATGCTTGGTCTTTCTG
GCTTGCTTCTTTTTTGGAGGGCTGTCCACGGGGACCACGTCCTCCTCGGAAGACC
CGGAGCCCACCCGCTGATACTTTCGGCGCTTGGTGGGCAGAGGAGGTGGCGGCG
GCGAGGGGCTCCTCTCCTGCTCCGGCGGATAGCGCGCCGACCCGTGGCCCCGGG
GCGGAGTGGCCTCTCGCTCCATGAACCGGCGCACGTCCTGACTGCCGCCGGCCA
TTGTTTCCTAGGGGAAGATGGAGGAGCAGCCGCGTAAGCAGGAGCAGGAGGAG
GACTTAACCACCCACGAGCAACCCAAAATCGAGCAGGACCTGGGCTTCGAAGAG
CCGGCTCGTCTAAAACCCCCACAGGATGAACAGGAGCACGAGCAAGACGCAGG
CCAGGAGGAGACCGACGCTGGGCTCGAACATGGCTACCTGGGAGGAGAGGAGG
ATGTGCTGCTAAAACACCTGCAGCGCCAGTCCCTCATCCTCCGGGACGCCCTGGC
CGACCGGAGCGAAACCCCCCTCAGCGTCGAGGAGCTGTGTCGGGCCTACGAGCT
CAACCTCTTCTCGCCGCGCGTGCCCCCCAAACGCCAGCCCAACGGCACCTGCGA
GCCCAACCCGCGTCTCAACTTCTATCCCGTCTTTGCGGTCCCCGAGGCCCTTGCC
ACCTATCACATCTTTTTCAAGAACCAAAAGATCCCCATCTCCTGTCGCGCCAATC
GCACTCGCGCCGACGCGCTCCTCGCTCTGGGGCCCGGCGCGCGCATACCTGATA
TCGCTTCCCTGGAAGAGGTGCCCAAGATCTTCGAAGGGCTCGGTCGGGACGAGA
CGCGCGCGGCAAACGCTCTGAAAGAAACAGCAGAGGAAGAGGGTTACACTAGC
GCCCTGGTAGAGTTGGAAGGCGACAACGCCAGGCTGGCCGTGCTTAAGCGCAGC
GTCGAGCTCACCCATTTCGCCTACCCCGCCGTCAACCTCCCGCCCAAGGTCATGC
GTCGCATCATGGATCAGCTCATCATGCCCCACATCGAGGCCCTTGATGAAAGTC
AGGAACAGCGCCCCGAGAACGCCCAGCCCGTGGTCAGCGACGAGATGCTCGCG
CGCTGGCTCGGGACCCGCGACCCCCAGGCCCTGGAGCAGCGGCGCAAGCTCATG
CTGGCCGTGGTCCTGGTCACCCTTGAGCTCGAATGCATGCGCCGCTTTTTTACCG
ACCCCGAGACCCTGCGCAAGGTCGAGGAGACCCTGCACTACACTTTCAGACACG
GTTTCGTCAGGCAGGCCTGCAAGATCTCCAACGTGGAGCTGACCAACCTGGTCT
CCTGCCTGGGGATCCTACACGAGAACCGCTTGGGACAGACCGTGCTCCACTCTA
CCCTGAAGGGCGAGGCGCGGCGGGACTACATCCGCGACTGCGTCTTTCTCTTTCT
CTGCCACACATGGCAAGCGGCCATGGGCGTGTGGCAGCAGTGTCTCGAGGACGA
GAACCTGAAGGAGCTGGACAAGCTTCTTGCTAGAAACCTTAAAAAGCTGTGGAC
GGGCTTCGACGAGCGCACCGTCGCCTCGGACCTGGCCGAGATCGTCTTCCCCGA
GCGCCTGAGGCAGACGCTGAAAGGAGGGCTGCCCGACTTCATGAGCCAGAGCAT
GTTGCAAAACTACCGCACTTTCATTCTCGAGCGATCTGGGATGCTGCCCGCCACC
TGCAACGCCTTCCCCTCCGACTTTGTCCCGCTGAGCTACCGCGAGTGTCCCCGC
CGCTGTGGAGCCACTGCTACCTCTTGCAGCTGGCCAACTACATTGCCCACCACTC
GGATGTGATCGAGGACGTGAGCGGCGAGGGGCTGCTCGAGTGCCACTGTCGCTG
CAACCTATGCTCCCCGCACCGCTCCCTGGTCTGCAACCCCCAGCTACTGAGCGAG
ACCCAGGTCATCGGTACCTTTGAGCTGCAAGGTCCGCAGGAGTCCACCGCTCCG
CTGAAACTCACGCCGGGGTTGTGGACTTCCGCGTACCTGCGCAAATTTGTACCCG
AGGACTACTACGCCCATGAGATAAAGTTCTTCGAGGACCAATCGCGTCCGCAGC
ACGCGGATCTCACGGCCTGCGTCATCACCCAGGGCGCGATCCTGCCCAATTGC
ACGCCATCCAAAAATCCCGCCAAGAGTTTCTTCTGAAAAAGGGTAGAGGGGTCT
ACCTGGACCCCCAGACGGGCGAGGTGCTCAACCCGGGTCTCCCCCAGCATGCCG
AGGAAGAAGCAGGAGCCGCTAGTGGAGGAGATGGAAGAAGAATGGGACAGCC
AGGCAGAGGAGGACGAATGGGAGGAGGAGACAGAGGAGGAAGACTTGGAAGA
GGTGGAAGAGGAGCAGGCAACAGAGCAGCCCGTCGCCGCACCATCCGCGCCGG
CAGCCCCTCCGGTCACGGATACAACCTCCGCAGCTCCGGCCAAGCCTCCTCGTA
GATGGGATCGAGTGAAGGGTGACGGTAAGCACGAGCGACAGGGCTACCGATCA
TGGAGGGCCCACAAAGCCGCGATCATCGCCTGCTTGCAAGACTGCGGGGGGAAC
ATCGCTTTCGCCCGCCGCTACCTGCTCTTCCACCGCGGGGTGAACATCCCCCGCA
ACGTGTTGCATTACTACCGTCACCTTCACAGCTAAGAAAAAGCAAGTCAAAGGA
GTCGCCGGAGGAGGAGGCCTGAGGATCGCGACGAACGAGCCCTTGACCACCAG
```

TABLE 7-continued

Nucleic Acid Sequences of Vectors

SEQ ID NO Sequence

GGAGCTGAGGAACCGGATCTTCCCCACTCTTTATGCCATTTTTCAGCAAAGTCGA
GGTCAGCAGCAAGAGCTCAAAGTAAAAAACCGGTCTCTGCGCTCGCTCACCCGC
AGTTGCTTGTACCACAAAAACGAAGATCAGCTGCAGCGCACTCTCGAAGACGCC
GAGGCTCTGTTCCACAAGTACTGCGCGCTGACTCTTAAAGACTAAGGCGCGCCC
ACCCGGAAAAAAGGCGGGAATTACCTCATCGCCACCATGAGCAAGGAGATTCCC
ACCCCTTACATGTGGAGCTATCAGCCCCAGATGGGCCTGGCCGCGGGCGCCTCC
CAGGACTACTCCACCCGCATGAACTGGCTTAGTGCCGGCCCCTCGATGATCTCAC
GGGTCAACGGGGTCCGTAACCATCGAAACCAGATATTGTTGCAGCAGGCGGCGG
TCACCTCCACGCCCAGGGCAAAGCTCAACCCGCGTAATTGGCCCTCCACCCTGGT
GTATCAGGAAATCCCCGGGCCGACTACCGTACTACTTCCGCGTGACGCACTGGC
CGAAGTCCGCATGACTAACTCAGGTGTCCAGCTGGCCGGCGGCGCTTCCCGGTG
CCCGCTCCGCCCACAATCGGGTATAAAAACCCTGGTGATCCGAGGCAGAGGCAC
ACAGCTCAACGACGAGTTGGTGAGCTCTTCAATCGGTCTGCGACCGGACGGAGT
GTTCCAACTAGCCGGAGCCGGGAGATCGTCCTTCACTCCCAACCAGGCCTACCT
GACCTTGCAGAGCAGCTCTTCGGAGCCTCGCTCGGGAGGCATCGGAACCCTCCA
GTTCGTGGAGGAGTTTGTGCCCTCGGTCTACTTCAACCCCTTCTCGGGCTCGCCA
GGCCTCTACCCGGACGAGTTTATACCGAACTTCGACGCAGTGAGAGAAGCGGTG
GACGGCTACGACTGAATGTCCTATGGTGACTCGGCTGAGCTCGCTCGGTTGAGG
CATCTGGACCACTGCCGCCGCCTGCGCTGCTTTGCCCGGGAGAGCTACGGCCTCA
TCTACTTTGAGCTGCCCGAGGAGCACCCCAACGGCCCTGCACACGGAGTGCGGA
TCACCGTAGAGGGCACCACCGAGTCTCACCTGGTCAGGTTCTTCACCCAGCAAC
CCTTCCTGGTCGAGCGGGACCGGGGCGCCACCACCTACACCGTCTACTGCATTTG
TCCTACCCCGAAGTTGCATGAGAATTTTTGTTGTACTCTTTGTGGTGAGTTTAATA
AAAGCTAAACTCTTGCAATACTCTGGACCTTGTCGTCATCAACTCAACGAGACCG
TCTACCTCACCAACCAGACTGAGGTAAAACTTACCTGCAGACCACACAAGACCT
ATATCATCTGGTTCTTCGAGAACACCTCATTTGCAGTCTCCAACACTCACTGCAA
CGACGGTGTTGAACTTCCCAACAACCTTTCCAGTGGACTGAGTTACAATACACGT
AGAGCTAAGCTCATCCTCTACAATCCTTTTGTAGAGGGAACCTACCAGTGCCAG
AGCGGACCTTGCTTCCACAGTTTTACTTTGGTGAACGTTACCGGCAGCAGCACAG
CCGCTCCAGAAACTAACCTTCCTTCTGATACTATCAAACCTTGTTTCGGAGGTGA
GCTAAGGCTTCCCCCTTCTCAGGAGGGGGTTAGCCCATACGAAGTGGTCGGGTA
TTTGATTTTAGGGGTGGTCCTGGGTGGGTGCATAGCGGTGCTAGCTCAGCTGCCT
TGCTGGGTGGAAATCAAAATCTTTATATGCTGGGTAAGACATTGTGGGGAGGAA
CTATGAAGGGGCTCTTGCTGATTATCCTTTCCCTGGTGGGGGGTGTGCTGTCATG
CCACGAACAGCCACGATGTAACATCACCACAGGCAATGAGAGGAACGACTGCTC
TGTAGTTATCAAATGCGAGCACCATTGTCCTCTCAACATTACATTCAAAAATAAG
ACCATGGGAAATGTATGGGTGGGATTCTGGCAACCAGGAGATGAGCAGAACTAC
ACGGTCACTGTCCATGGTAGCAATGGCAATCACACTTTCGGTTTCAAATTCATTT
TTGAAGTCATGTGTGATATCACACTACATGTGGCTAGACTTCATGGCTTGTGGCC
CCCTACCAAGGATAACATGGTGGGTTTTTCTTTGGCTTTTGTGATCATGGCCTGC
TTGATGTCAGGTCTGCTGGTAGGGGCTCTAGTGTGGTTTCTGAAACGCAAGCCCA
GGTATGGAAATGAAGAGAAGGAAAAATTGCTATAAATTCTTTTTCTTTTTCGCAG
AACCATGAATACAGTGAACCGTATCGTGCTGCTCTCTCTTCTTGTAGCTTTTAGT
CAGGCAGGATTTCATACTATCAATGCTACATGGTGGGCTAATATAACTTTAGTGG
GACCCCCAGACACACCAGTCACTTGGTATGATACTCAAGGATTGTGGTTTTGCAA
TGGCAGTAGAGTTAAGAATCCTCAAATCAGACATACATGTAATGATCAAAACCT
TACTTTGATCCATGTGAACAAAACTTATGAAAGAACATACATGGGTTATAATAG
ACAAGGGACTAAAAAAGAAGACTACAAAGTTGTAGTTATACCACCTCCTCCTGC
TACTGTAAAACCACAGCCAGAGCCAGAGTATGTGTTTGTTTATATGGGAGAGAA
CAAAACTCTAGAAGGTCCTCCGGGAACTCCAGTCACATGGTTTAATCAGGATGG
AAAGAAATTTTGTGAAGGAGAAAAAGTTCTTCATCCAGAATTTAACCACACCTG
TGACAAACAAAACCTTATACTACTGTTTGTGAATTTTACACATGATGGAGCTTAC
CTTGGGTACAATCATCAAGGAACCCAGAGAACACACTATGAAGTTACAGTATTA
GATCTTTTTCCAGATTCTGGCCAAATGAAAATTGAAAATCATAGTGAGGAAACA
GAGCAAAAAAATGATGAACATCATAACTGGCAGAAACAGGGTGGGCAAAAACA
GGGTGGGCAAAAAACAAATCAAACAAAAGTTAATGACAGGAGAAAAACAGCGC
AAAAAAGACCATCAAAGCTAAAGCCGGCAACTATTGAGGCAATGCTGGTTACAG
TGACTGCCGGGTCTAACTTAACTTTGGTTGGACCTAAAGCAGAAGGAAAAGTTA
CTTGGTTTGATGGAGATTTAAAAAGACCATGTGAGCCTAATTACAGACTAAGAC
ACGAATGTAATAATCAAAACTTAACTCTGATTAATGTAACTAAAGATTATGAGG
GAACTTACTATGGTACAAATGACAAAGATGAGGGCAAAAGGTACAGAGTGAAA
GTAAATACTACAAATTCTCAATCTGTGAAAATTCAGCCATATACCAGACAAACT
ACTCCTGATCAAGAGCACAAATTTGAATTACAGTTCGAAACTAATGGAAATTAT
GATTCAAAAATTCCCTCAACCACTGTGGCAATCGTGGTGGGTGTGATTGCGGGCT
TCATAACTCTGATCATTGTCTTCATATGCTACATCGCTGCCGCAAGCGTCCCAG
GGCATACAATCATATGGTAGACCCACTACTCAGCTTCTCTTACTAAGACTCAGTC
ACTTTCATTTCAGAACCATGAAGGCTTTCACAGCTTGCGTTCTGATTAGCCTAGT
CACACTTAGTGTAGCTATTAAAAATCAATATCATGTTCATAATGTTACCAGAGAT
GGATATATCACATTAAATGTAACAATTGATAATACTACCTGGACAAGATATCATT
TAAATAAGTGGCATCAAATTTGTACGTGGTCAGACCCATCATACAAATGTCACA
GCAATGGCAGCATTACCATTCATGCTTTCAATATTACTTCTGGCCAGTACAAAGC
TGAAAGTTTTACTAACTGGTTTAGATATTACGGTAATCATAAACATGAAATTCAT
ATTTTTAACATAACTGTAATTGAGCATCCTACAACAAAAGCACCCACCACTGCTA
ATACAGCTACATCAATTAAATCAACAACCACACAGCCTACTACTAGGGAGACAA
CTCAACCTACCACCACAGTCAGTACAACTACTGAGACCACTACTCAAACTACAC
AGCTAGACACAACAGTGCAGAATAGCACTGTGTTGGTTAGGTATCTGTTGAGGG

TABLE 7-continued

Nucleic Acid Sequences of Vectors

| SEQ ID NO | Sequence |
|---|---|
| | AGGAAAGTACTACTGAACAGACAGAGGCTACCTCAAGTGCCTTTAGCAGCACTG |
| | CAAATTTAACTTCGCTTGCTTGGACTAATGAAACCGGAGTATCATTGATGAATCA |
| | TCAGCCTTTCTCAGGTTTGGATATTCAAATTACTTTTCTGGTTGTTTGTGGGATCT |
| | TTATTCTTGTGGTTCTTCTGTACTTTGTCTGCTGCAAAGCCAGAGAGAAATCTAG |
| | GAGGCCCATCTACAGGCCAGTAATCGGGGAACCTCAGCCACTCCAAGTGGAAGG |
| | GGGTCTAAGGAATCTTCTTTTCTCTTTTTCAGTATGGTGATCAGCCATGATTCCTA |
| | GGTTCTTCCTATTTAACATCCTCTTCTGTCTCTTCAACATCTGCGCTGCCTTTGCA |
| | GCCGTCTCGCACGCCTCGCCCGACTGTCTCGGGCCCTTCCCAACCTACCTCCTCT |
| | TTGCCCTGCTCACCTGCACCTGCGTCTGCAGCATTGTCTGCCTGGTCATCACCTTC |
| | CTGCAGCTTATCGACTGGTGCTGTGCGCGCTACAATTATCTCCATCACAGTCCCG |
| | AATACAGGGACAAGAACGTAGCCAGAATCTTAAGGCTCATCTGACCATGCAGAC |
| | TCTGCTCATGCTGCTATCCCTCCTATCCCCTGCCCTAGCCACTTATGCTGATTACT |
| | CTAAATGCAAATTCGCAGACATATGGAATTTCTTAGATTGCTATCAGGAAAAAA |
| | TTGATATGCCCTCCTATTACTTGGTGATTGTGGGAATAGTCATGGTCTGCTCCTG |
| | CACTTTCTTTGCCATCATGATTTACCCCTGTTTTGATCTCGGCTGGAACTCTGTTG |
| | AAGCATTCACATACACACTAGAAAGCAGTTCACTAGCCTCCACGCCACCACCCA |
| | CACCGCCTCCTCGCAGAAATCAGTTCCCCCTGATACAGTACTTAGAAGAGCCCC |
| | TCCCCGACCCCCTTCCACTGTTAGCTACTTTCACATAACCGGCGGCGATGACTGA |
| | CCACCACCTGGACCTCGAGATGGACGGCCAGGCCTCCGAGCAGCGCATCCTGCA |
| | ACTGCGCGTCCGTCAGCAGCAGGAGCGGGCCGCCAAGGAGCTCCTTGATGCCAT |
| | CAACATCCACCAGTGCAAGAAGGGCATCTTCTGCCTGGTCAAACAGGCAAAGAT |
| | CACCTACGAGCTCGTGTCCAACGGCAAACAGCATCGCCTTACCTATGAGATGCC |
| | CCAGCAGAAGCAGAAGTTCACCTGCATGGTGGGCGTCAACCCCATAGTCATCAC |
| | CCAGCAGTCGGGCGAGACCAACGGCTGCATCCACTGCTCCTGCGAAAGCCCCGA |
| | GTGCATCTACTCCCTTCTCAAGACCCTTTGCGGACTCCGCGACCTCCTCCCCATG |
| | AACTGATGTTGATTAAAAGCCCAGAAACCAATCAGACCCTTCCTCATTTCCCCAT |
| | CCCAATACTCATAAGAATAAATCATTGGAATTAATCATTCAATAAAGATCACTTA |
| | CTTGAAATCTGAAAGTATGTCTCTGGTGTAGTTGCTCAGCAACACCTCGGTACCC |
| | TCCTCCCAGCTCTGGTACTCCAGTCCCCGGCGGGCGGCGAACTTCCTCCACACCT |
| | TGAAAGGGATGTCAAATTCCTGGTCCACAATTTTCATTGTCTTCCCTCTTAGATG |
| | TCAAAGAGGCTCCGGGTGGAAGATGACTTCAACCCCGTCTACCCCTATGGCTAC |
| | GCGCGGAATCAGAATATCCCCTTCCTCACTCCCCCCTTTGTCTCCTCCGATGGAT |
| | TCAAAAACTTCCCCCCTGGGGTACTGTCACTCAAACTGGCTGATCCAATCACCAT |
| | TACCAATGGGGATGTATCCCTCAAGGTGGGAGGTGGTCTCACTTTGCAAGATGG |
| | AAGCCTAACTGTAAACCCTAAGGCTCCACTGCAAGTTAATACTGATAAAAAACT |
| | TGAGCTTGCATATGATAATCCATTTGAAAGTAGTGCTAATAAACTTAGTTTAAAA |
| | GTAGGACATGGATTAAAAGTATTAGATGAAAAAAGTGCTGCGGGGTAAAAGAT |
| | TTAATTGGCAAACTTGTGGTTTTAACAGGAAAAGGAATAGGCACTGAAAATTTA |
| | GAAAATACAGATGGTAGCAGCAGAGGAATTGGTATAAATGTAAGAGCAAGAGA |
| | AGGGTTGACATTTGACAATGATGGATACTTGGTAGCATGGAACCCAAAGTATGA |
| | CACGCGCACACTTTGGACAACACCAGACACATCTCCAAACTGCACAATTGCTCA |
| | AGATAAGGACTCTAAACTCACTTTGGTACTTACAAAGTGTGGAAGTCAAATATT |
| | AGCTAATGTGTCTTTGATTGTGGTCGCAGGAAAGTACCACATCATAAATAATAA |
| | GACAAATCCAAAAATAAAAAGTTTTACTATTAAACTGCTATTTAATAAGAACGG |
| | AGTGCTTTTAGACAACTCAAATCTTGGAAAAGCTTATTGGAACTTTAGAAGTGG |
| | AAATTCCAATGTTTCGACAGCTTATGAAAAAGCAATTGGTTTTATGCCTAATTTG |
| | GTAGCGTATCCAAAACCCAGTAATTCTAAAAAATATGCAAGAGACATAGTTTAT |
| | GGAACTATATATCTTGGTGGAAAACCTGATCAGCCAGCAGTCATTAAAACTACC |
| | TTTAACCAAGAAACTGGATGTGAATACTCTATCACATTTAACTTTAGTTGGTCCA |
| | AAACCTATGAAAATGTTGAATTTGAAACCACCTCTTTTACCTTCTCCTATATTGC |
| | CCAAGAATGAAAGACCAATAAACGTGTTTTTCATTTGAAATTTTCATGTATCTTT |
| | ATTGATTTTTACACCAGCACGAGTAGACAGTCTCCCACCACCAGCCCATTTTACA |
| | GTGTACACGGTTCTCTCAGCACGGGTAGCCTTAAATAGGGAAATATTCTCATTAG |
| | TGCGGGAATTGGACTTGGGGTCTATAATCCACACAGTTTCCTGGCGAGCCAAAC |
| | GGGGGTCGGTGATTGAAATAAAGCCGTCCTCTGAAAAGTCATCCAAGCGGGCCT |
| | CACAGTCCAAGGTCACAGTCTGGTGGAACAAGAAGAACGCACAGATTCATACTC |
| | GGAAAACAGGATGGGTCTGTGCCTCTCCATCAGCGCCCTCAGCAGTCTCTGCCG |
| | CCGGGGCTCGGTGCGGCTGCTGCAAATGGGATCGGGATCACAAGTCTCTCTGAC |
| | TATGATCCCAACAGCCTTCAGCATCAGTCTCCTGGTGCGACGGGCACAGCACCG |
| | CATCCTGATCTCTGCCATGTTCTCACAGTAAGTGCAGCACATAATCACCATGTTA |
| | TTCAGCAGCCCATAATTCAGGGCGCTCCAGCCAAAGCTCATGTTGGGAATGATG |
| | GAACCCACGTGACCATCGTACCAGATG |
| SEQ ID NO: 1441 | CATCATCAATAATATACCCCACAAAGTAAACAAAAGTTAATATGCAAATGAGCT |
| | TTTGAATTTTAACGGTTTTGGGCGGAGCCAATGCTGATTGGCCGAGAAGCGGT |
| | GATGCAAATGACGTCACGACGCACGGCTGACGGTCGCCGCGGAGGCGTGGCCTA |
| | GCCCGGAAGCAAGTCGCGTGGCTGATGACGTATAAAAAGCGGACTTTAGACCCG |
| | GAAACGGCCGATTTTCCCGCGGCCACGCCCGGATATGAGGTAATTCTGGGCGGA |
| | TGCAAGTGAAATTAGGTCATTTTGGCGCGAAAACTGAATGAGGAAGTGAAAAGC |
| | GAAAAATACCGGTCCCGCCCAGGGCGGAATATTTACCGAGGGCCGAGAGACTTT |
| | GACCGATTACGTGGGGTTTCGATTGCGGTGTTTTTTCGCGAATTTCCGCGTCC |
| | GTGTCAAAGTCCGGTGTTTATGTCACAGATCAGCTGATCCACAGGGTATTTAAAC |
| | CAGTCGAGCCCGTCAAGAGGCCACTCTTGAGTGCCAGCGAGTAGAGATTTCTCT |
| | GAGCTCCGCTCCCAGAGTGTGAGAAAAATGAGACACCTGCGCCTCCTGCCTGAA |
| | ACTGTGCCTATGGACATGGCTGTGCTTCTACTGGATGACTTTGTGAATACAGTAT |
| | TGGAGGATGAACTGCATCCAACTCCGTTTGAGCTGGGACCCACACTTCAGGACC |

TABLE 7-continued

Nucleic Acid Sequences of Vectors

SEQ ID NO Sequence

TATATGATCTGGAGGTAGATGCCCATGATGACGACCCGAACGAAGAGGCTGTGA
ATTTAATATTTCCAGAATCTATGATTCTTCAGGCTGACATAGCCAACGAATCTAT
ACCTACTCCACTTCATACACCGACTCTGTCACCCATACCTGAATTGGAAGAGGAG
GACGAACTAGACCTCCGGTGTTATGAGGAAGGTTTTCCTCCCAGCGATTCAGAG
GACGAACAGGGTGAGCAGAGCATGGCTATAATCTCAGACTATGCTTGTGTGGTT
GTGGAAGAGCATTTTGTGTTGGACAATCCTGAGGTGCCCGGGCAAGGCTGTAGA
TCCTGCCAATATCACCGGGATCAGACCGGAGACCCAAATGCTTCATGCGCTCTGT
GTTACATGAAAAGACTTTCAGCTTTATTTACAGTAAGTGGAGTGAATGTGAGA
GAGGCTGAGTGCTTAACACATAACTGTAATGCTTGAACAGCTGTGCTAAGTGTG
GTTTATTTTTGTTACTAGGTCCGGTGTCAGAGGATGAGTCATCGCCCTCAGAAGA
CGACCACCCGTCTTCCCCCGATCTCACAGATGACACGCCCCTGCAAGTGATCAG
ACCCACCCCAGTCAGACTCAGTGGGGAGAGGCGAATGGCTGTTGACAAAATCGA
GGACTTGTTGCAGGACATGGGTGGGGATGAACCTTTGGACCTGAGCTTGAAACG
CCCCAGGAACTAGGCGCAGCTGTGCTGAGTCATGTGTAAATAAAGTTGTACAAT
AAAAGTATATGTGACGCATGCAAGGTGTGGTTTATGACTCATGGGCGGGCTTA
GTCCTATATAAGTGCTAACACCTGGGCACTTAGGCACAGACCTTCAGGAGCTCCT
GATGGAGGTGTGGACTATCCTTGCAGACTTTAGCAAGACACGCCGGCTTGTAGA
GGATAGTTCAGACGGGTGCTCCGGGTTCTGGAGACACTGGTTTGGAACTCCTCTA
TCTCGCCTGGTGTACACAGTTAAGAAGGATTATAACGAGGAATTTGAAAATCTTT
TTGCCGACTGCTCTGGCCTGCTTGATTCTCTGAATTTTGGCCACCAGTCCCTTTTC
CAGGAAAGGGTCCTCCACAGCCTTGATTTTTCCAGCCCAGGGCGCACTACAGCC
GGGGTTGCTTTTGTGGTTTTTCTGGTTGACAAATGGAGCCAGAACACCCAACTGA
GCAGGGGCTACATTCTGGACTTCGCGGCCATGCACCTGTGGAGGGCTGGGTCA
GGCAGCGGGGACAGAGAATCTTGAACTACTGGCTTCTACAGCCAGCAGCTCCGG
GTCTTCTTCGTCTACACAGACAAACATCCATGTTGGAGGAAGAAATGAGGCAGG
CCATGGACGAGAACCCGAGGAGCGGCCTGGACCCTCCGTCGGAAGAGGAGCTG
GATTGAATCAGGTATCCAGCCTGTACCCAGAGCTTAGCAGGGTGCTGACATCCA
TGGCCAGGGGAGTGAAGAGGGAGAGGAGCGATGGGGGCAATACCGGGATGATG
ACAGAGCTGACGGCCAGCCTGATGAATCGCAAGCGCCCAGAGCGCATTACCTGG
CATGAGCTACAGATGGAGTGCAGGGATGAGGTGGGCCTGATGCAGGATAAATAT
GGCCTGGAGCAGATAAAAACCCACTGGTTGAACCCAGATGAGGATTGGGAGGA
GGCCATTAAGAAATATGCCAAGATAGCCCTACGCCCAGATTGCAAGTACAGGGT
GACCAAGACGGTGCATATCAGACATGCCTGCTACATCTCAGGGAACGGGGCAGA
GGTGGTCATCGATACCCTGGACAAGGCCGCCTTCAGGTGTTGCATGATGGGAAT
GAGAGCCGGAGTGATGAATATGAATTCCATGATCTTTATGAACATGAAGTTCAA
TGGAGAGAAGTTTAATGGGGTGCTGTTCATGCCAACAGCCACATGACCCTGCA
TGGCTGCGACTTTTTCGGCTTTAACAATATGTGCGCAGAGGTCTGGGGCGCTTCC
AAGATCAGGGGATGTAAGTTTTATGGCTGCTGGATGGGCGTGGTCGGAAGACCC
AAGAGCGAGATGTCTGTGAAGCAGTGTGTGTTTGAGAAATGCTACCTGGGAGTC
TCTACCGAGGGCAATGCTAGAGTGAGACACTGCTCTTCCCTGGAGACGGGCTGC
TTCTGCCTGGTGAAGGGCACAGCCTCTCTGAAGCATAATATGGTGAAGGGCTGC
ACGGATGAGCGCATGTACAACATGCTGACATGCGACTCGGGGGTCTGCCATATT
CTGAAGAACATCCATGTGACCTCCCACCCCCGGAAGAAGTGGCCAGTGTTTGAG
AATAACCTGCTTATCAAGTGCCACGTGCACCTGGGTGCCAGAAGGGGCACCTTC
CAGCCGTACCAGTGTAACTTTAGCCAGACCAAGCTGCTGTTGGAGAACGATGCC
TTCTCCAGGGTGAACCTGAACGGCATCTTTGACATGGATGTCTCGGTGTACAAGA
TCCTGAGATACGATGAGACCAAGTCCAGGGTGCGCGCTTGCGAGTGCGGGGGCA
GACACACCAGGATGCAGCCAGTGGCCCTGGATGTGACCGAGGAGCTGAGACCA
GACCACCTGGTGATGGCCTGTACCGGGACCGAGTTCAGCTCCAGTGGGGAGGAC
ACAGATTAGAGGTAGGTTTGAGTAGTGGGCGTGGCTAAGGTGACTATAAAGGCG
GGTGTCTTACGAGGGTCTTTTTGCTTTTCTGCAGACATCATGAACGGGACTGGCG
GGGCCTTCGAAGGGGGGCTTTTTAGCCCTTATTTGACAACCCGCCTGCCGGGATG
GGCCGGAGTTCGTCAGAATGTGATGGGATCGACGGTGGACGGGCGCCCAGTGCT
TCCAGCAAATTCCTCGACCATGACCTACGCGACCGTGGGGAACTCGTCGCTTGA
CAGCACCGCCGCAGCCGCGGCAGCCGCAGCCGCCATGACAGCGACGAGACTGG
CTTCGAGCTACATGCCCAGCAGCAGCAGTAGCCCCTCTGTGCCCAGTTCCATCAT
CGCCGAGGAGAAACTGCTGGCCCTGCTGGCCGAGCTGGAAGCCCTGAGCCGCCA
GCTGGCCGCCCTGACCCAGCAGGTGTCCGATCTCCGCGAGCAACAGCAGCAAAA
TAAATGATTCAATAAACACAGATTCTGATTCAAAAGCAAAGCATCTTTATTATTT
ATTTTTTCGCGCGCGGTAGGCCCTGGTCCACCTTTCCCGATCATTGAGAGTGCGG
TGGATTTTTTCCAGGACCCGGTAGAGGTGGGATTGGATGTTGAGGTACATGGGC
ATGAGCCCGTCCCGGGGGTGTAGGTAGCACCACTGCATGGCCTCGTACTCTGGG
GTCGTGTTGTAGATGATCCAGTCATAGCAGGGGCGCTGGGCGTGGCTGGATG
ATGTCCTTGAGGAGGAGACTGATGGCCACGGGGAGCCCCTTGGTGTAGGTGTTG
GCAAAGCGGTTGAGCTGGGAGGGATGCATGCGGGGGGAGATGATGTGCAGTTT
GGCCTGGATCTTGAGGTTGGCAATGTTGCCGCCCAGATCCCGCCTGGGGTTCATG
TTGTGCAGGACCACCAGGACGGTGTAGCCCGTGCACTTGGGAACTTATCATGC
AACTTGGAAGGGAATGCGTGGAAGAATTTGGAGACGCCCTTGTGCCCGCCCAGG
TTTTCCATGCACTCATCCATGATGATGGCAATGGGCCCGTGGGCTGCGGCTTTGG
CAAAGACGTTTCTGGGGTCAGAGACATCGTAATTATGCTCCTGGGTGAGATCAT
CATAAGACATTTTAATAAATTTGGGGCGGAGGGTGCCAGATTGGGGGACGATGG
TTCCCTCGGGCCCCGGGGCAAAGTTCCCTCGCAGATCTGCATCTCCCAGGCTTT
CATCTCGGAGGGGGGATCATGTCCACCTGCGGGCGATGAAAAAAACGGTTTC
CGGGGCGGGGTGATGAGCTGCGAGGAGAGCAGGTTTCTCAACAGCTGGGACTT
GCCGCACCCGGTTGGGCCGTAGATGACCCCGATGACGGGTTGCAGGTGGTAGTT
CAAGGAGATGCAGCTGCCGTCGTCCCGGAGGAGGGGGGCCACCTCGTTGAGCAT

TABLE 7-continued

Nucleic Acid Sequences of Vectors

SEQ ID NO Sequence

GTCCCTGACTTGGAGGTTTTCCCGGACGAGCTCGCCAAGGAGGCGGTCTCCGCC
GAGCGAGAGTAGCTCTTGCAGGGAAGCAAAGTTTTTCAGGGGCTTGAGCCCGTC
GGCCATGGGCATCTTGGCGAGGGTCTGCGAGAGTAGCTCCAGGCGGTCCCAGAG
CTCGGTGACGTGCTCTACGGCATCTCGATCCAGCAGACTTCCTCGTTTCGGGGGT
TGGGACGACTGCGACTGTAGGGCACGAGACGATGGGCGTCCAGCGCTGCCAGCG
TCATGTCCTTCCATGGTCTCAGGGTCCGCGTGAGCGTGGTCTCCGTCACGGTGAA
GGGGTGGGCCCCGGGCTGGGCGCTTGCAAGGGTTCGCTTGAGACTCATCCTGCT
GGTGCTGAAACGGGCACGGTCTTCGCCCTGCGCGTCGGCGAGATAGCAGTTGAC
CATGAGCTCGTAGTTGAGGGCCTCGGCGGCGTGGCCCTTGGCGCGGAGCTTGCC
CTTGGAAGAGCGCCCGCAGGCGGGACAGAGGAGGGATTGCAGGGCGTAGAGCT
TGGGTGCGAGAAAGACGGACTCGGGGGCGAAGGCGTCCGCTCCGCAGTGGGCG
CAGACGGTCTCGCACTCGACGAGCCAGGTGAGCTCGGGGTGTTCGGGGTCAAAA
ACCAGTTTTCCCCCGTTCTTTTTGATGCGCTTCTTACCTCGCGTCTCCATGAGTCT
GTGTCCGCGCTCGGTGACAAACAGGCTGTCTGTGTCCCCGTAGACGGACTTGAT
GGGCCTGTCCTGCAGGGGCGTCCCGCGGTCCTCCTCGTAGAGAAACTCGGACCA
CTCTGAGACGAAGGCGCGCGTCCACGCCAAGACAAAGGAGGCCACGTGCGAGG
GGTAGCGGTCGTTGTCCACCAGGGGGTCCACCTTTTCCACCGTGTGCAGGCACAT
GTCCCCCTCCTCCGCATCCAAGAAGGTGATTGGCTTGTAGGTGTAGGCCACGTGA
CCGGGGGTCCCCGACGGGGGGGTATAAAAGGGGGCGGGTCTGTGCTCGTCCTCA
CTCTCTTCCGCGTCGCTGTCCACGAGCGCCAGCTGTTGGGGTAGGTATTCCCTCT
CGAGAGCGGGCATGACCTCGGCACTCAGGTTGTCAGTTTCTAGAAACGAGGAGG
ATTTGATGTTGGCTTGCCCTGCCGCGATGCTTTTTAGGAGACTTTCATCCATCTGG
TCAGAAAAGACTATTTTTTTATTGTCAAGCTTGGTGGCGAAGGAGCCATAGAGG
GCATTGGAGAGAAGCTTGGCGATGGATCTCATGGTCTGATTTTTGTCACGGTCGG
CGCGCTCCTTGGCCGCGATGTTGAGCTGGACATACTCGCGCGCGACGCACTTCCA
TTCGGGGAAGACGGTGGTGCGCTCGTCGGGCACGATCCTGACGCGCCAGCCGCG
GTTATGCAGGGTGACCAGGTCCACGCTGGTGGCCACCTCGCCGCGCAGGGGCTC
GTTGGTCCAGCAGAGTCTGCCGCCCTTGCGCGAGCAGAAAGGGGGCAGCACATC
AAGCAGATGCTCGTCAGGGGGGTCCGCATCGATGGTGAAGATGCCGGGACATAG
TTCCTTGTCAAAATAGTCTATTTTTGAGGATGCATCATCCAAGGCCATCTGCCAC
TCGCGGGCGGCCATCGCTCGCTCGTAGGGGTTGAGGGGCGGACCCCAGGGCATG
GGGTGCGTGAGCGCGGAGGCATACATGCCGCAGATGTCATAGACATAGATGGGC
TCCGAGAGGATGCCGATGTAGGTGGGATAACAGCGCCCCCGCGGATGCTGGCG
CGCACGTAGTCATACAACTCGTGCGAGGGGGCCAAGAAGGCGGGGCCGAGATT
GGTGCGCTGGGGCTGCTCGGCGCGGAAGACGATCTGGCGAAAGATGGCGTGCG
AGTTGGAGGAGATGGTGGGCCGTTGGAAGATGTTAAAGTGGGCGTGTGGCAGGC
GGACCGAGTCGCGGATGAAGTGCGCGTAGGAGTCTTGCAGCTTGGCGACGAGCT
CGGCGGTGACGAGGACGTCCATGGCGCAGTAGTCCAGCGTTTCGCGGATGATGT
CATAACCCGCTTCTCCTTTCTTCTCCCACAGCTCGCGGTTGAGGGCGTACTCCTC
GTCATCCTTCCAATACTCCCGGAGCGGGAATCCTCGATCGTCCGCACGGTAAGA
GCCCAGCATGTAGAAATGGTTCACGGCCTTGTAGGGACAGCAGCCCTTCTCCAC
GGGGAGGGCGTAAGCTTGAGCGGCCTTGCGGAGCGAGGTGTGCGTCAGGGCGA
AGGTGTCCCTGACCATGACTTTCAAGAACTGGTACTTGAAGTCCGAGTCGTCGCA
GCCGCCGTGCTCCCAGAGCTCGAAATCGGTGCGCTTCTTCGAGAGGGGGTTAGG
CAGAGCGAAAGTGACGTCATTGAAGAGAATCTTGCCTGCTCGCGGCATGAAATT
GCGGCTGATGCGGAAAGGGCCCGGGACGGAGGCTCGGTTGTTGATGACCTGGGC
GGCGAGGACGATCTCGTCGAAGCCGTTGATATTGTGCCCGACGATGTATAGTTC
CATGAATCGCGGGCGGCCTTTGATGTGCGGCAGCTTTTTGAGCTCCTCGTAGGTG
AGGTCCTCGGGGCATTGCAGGCCGTGCTGCTCGAGGGCCCACTCCTGGAGATGT
GGGTTGGCTTGCATGAAGGAAGCCCAGAGCTCGCGGGCCATGAGGGTCTGGAGC
TCGTCGCGAAAGAGGCGGAACTGCTGGCCCACGGCCATCTTTTCTGGGGTGACG
CAGTAGAAGGTGAGGGGGTCCCGCTCCCAGCGATCCCAGCGTAAGCGCACGGCG
AGATCGCGAGCGAGGGTGACCAGCTCGGGGTCCCCCGAGAATTTCATGACCAGC
ATGAAGGGGACGAGCTGCTTGCCGAAGGACCCCATCCAGGTGTAGGTTTCTACA
TCGTAGGTGACAAAGAGCGCTCCGTGCGAGGATGAGAGCCGATTGGGAAGAA
CTGGATTTCCTGCCACCAGTTGGACGAGTGGCTGTTGATGTGATGAAAGTAGAA
ATCCCGCCGGCGAACCGAGCACTCGTGCTGATGCTTGTAAAAGCGTCCGCAGTA
CTCGCAGCGCTGCACGGGCTGTACCTCATCCACGAGATACACAGCGCGTCCCTT
GAGGAGGAACTTCAGGAGTGGCGGCCCTGGCTGGTGGTTTTCATGTTCGCCTGC
GTGGGACTCACCCTGGGGCTCCTCGAGGACGGAGAGGCTGACGAGCCCGCGCGG
GAGCCAGGTCCAGATCTCGGCGCGGCGGGGCGGAGAGCGAAGACGAGGGCGC
GCAGTTGGGAGCTGTCCATGGTGTCGCGGAGATCCAGGTCCGGGGGCAGGGTTC
TGAGGTTGACCTCGTAGAGGCGGGTGAGGGCGTGCTTGAGATGCAGATGGTACT
TGATTTCCACTGGGGAGTTGGTGGCCGTGTCCACGCATTGCATGAGCCCGTAGCT
GCGCGGGGCCACGACCGTGCCGCGGTGCGCTTTTAGAAGCGGTGTCGCGGACGT
GCTCCCGGCGGCAGCGGCGGTTCCGGCCCCGGGCAGGGGCGGCAGAGGCAC
GTCGGCGTGGCGCTCGGGCAGGTCCCGGTGCTGCGCCCTGAGAGCGCTGGCGTG
CGCGACGACGCGGCGGTTGACATCCTGGATCTGCCGCCTCTGCGTGAAGACCAC
CGGCCCCGTGACTTTGAACCTGAAAGACAGTTCAACAGAATCAATCGGCGTC
ATTGACGGCGGCCTGACGCAGGATCTCTTGCACGTCGCCCGAGTTGTCCTGGTAG
GCGATCTCGGACATGAACTGCTCGATCTCCTCCTCCTGGAGATCGCCGCGGCCCG
CGCGCTCGACGGTGGCGGCGAGGTCATTTGAGATGCGACCCATGAGCTGCGAGA
AGGCGCCCAGCCCGCTCTCGTTCCAGACGCGGCTGTAGACTACGTCCCCGTCTGC
GTCGCGCGCGCATGACCACCTGCGCGAGGTTGAGCTCCACGTGCCGCGTGAA
GACGGCGTAGTTGCGCAGGCGCTGGAAGAGGTAGTTGAGGGTGGTGGCGATGTG
CTCGGTGACGAAGAAGTACATGATCCAGCGGCGCAGGGGCATCTCGCTGATGTC

TABLE 7-continued

Nucleic Acid Sequences of Vectors

SEQ ID NO Sequence

GCCGATGGCCTCCAGCCTTTCCATGGCTTCGTAGAAATCCACGGCGAAGTTGAA
AAACTGGGCGTTGCGGGCCGAGACCGTGAGCTCGTCTTCCAGGAGCCGGATGAG
CTCGGCGATGGTGGCGCGCACCTCGCGCTCGAAATCCCCGGGGGCCTCCTCCTCT
TCCTCTTCTTCCATGACGACCTCTTCTTCTATTTCTTCCTCTGGGGGCGGTGGTGG
TGGCGGGGCCCGACGACGACGGCGACGCACCGGGAGACGGTCGACGAAGCGCT
CGATCATCTCCCCGCGGCGGCGACGCATGGTTTCGGTGACGGCGCGACCCCGTT
CGCGAGGACGCAGCGTGAAGACGCCGCCGGTCATCTCCCGGTAATGGGGCGGGT
CCCCGTTGGGCAGCGATAGGGCGCTGACGATGCATCTTATCAATTGCGGTGTAG
GGGACGTGAGCGCGTCGAGATCGACCGGATCGGAGAATCTTTCGAGGAAAGCGT
CTAGCCAATCGCAGTCGCAAGGTAAGCTCAAACACGTAGTAGCCCCGTGGACGC
TGTTAGAATTGCGGTTGCTGATGATGTAATTGAAGTAGGCGTTTTTAAGGCGGCG
GATGGTGGCGAGGAGGACCAGGTCCTTGGGTCCCGCTTGCTGGATGCGGAGCCG
CTCGGCCATGCCCCAGGCCTGGCCCTGACACCGGCTCAGGTTCTTGTAGTAGTCA
TGCATGAGCCTCTCAATGTCATCACTGGCGGAGGCGGAGTCTTCCATGCGGGTG
ACCCCGACGCCCTGAGCGGTTGCACAAGCGCCAGGTCGGCGACGACGCGCTCG
GCGAGGATGGCCTGTTGCACGCGGGTGAGGGTGTCCTGGAAGTCGTCCATGTCG
ACGAAGCGGTGGTAGGCCCCGGTGTTAATGGTGTAGGTGCAGTTGGCCATGAGC
GACCAGTTGACGGTCTGCAGGCCGGGCTGCACGACCTCGGAGTACCTGAGCCGC
GAGAAGGCGCGCGAGTCGAAGACGTAGTCGTTGCAGGTGCGCACGAGGTACTG
GTATCCGACTAGGAAGTGCGGCGGCGGCTGGCGGTAGAGCGGCCAGCGCTGGGT
GGCCGGCGCGCCCGGGGCCAGGTCCTCGAGCATGAGGCGGTGGTAGCGCGTAGA
GGTAGCGGGACATCCAGGTGATGCCGGCGGCGGTGGTGGAGGCGCGCGGGAAC
TCGCGGACGCGGTTCCAGATGTTGCGCAGCGGCAGGAAATAGTCCATGGTCGGC
ACGGTCTGGCCGGTGAGACGCGCGCAGTCATTGACGCTCTAGAGGCAAAAACGA
AGCGGTTGAGCGGGCTCTTCCTCCGTAGCCTGGCGGAACGCAAACGGGTTAGGC
CGCGTGTGTACCCCGGTTCGAGTCCCCTCGAATCAGGCTGGAGCCGCGACTAAC
GTGGTATTGGCACTCCCGTCTCGACCCGAGCCCGATAGCCGCCAGGATACGGCG
GAGAGCCCTTTTTGCCGGCCGAGGGGGTCGCTAGACTTGAAAGCGGCCGAAAA
CCCCGCGGGTAGTGGCTCGCGCCCGTAGTCTGGAGAAGCATCGCCAGGGTTGA
GTCGCGGCAGAACCCGGTTCGCGGACGGCCGCGGCGAGCGGGACTTGGTCACCC
CGCCGATTTAAAGACCCACAGCCAGCCGACTTCTCCAGTTACGGGAGCGAGCCC
CCTTTTTTCTTTTTGCCAGATGCATCCCGTCCTGCGCCAAATGCGTCCCACCCCCC
CGGCGACCACCGCGACCGCGGCCGTAGCAGGCACCGGCGCTAGCCAGCCACAG
ACAGAGATGGACTTGGAAGAGGGCGAAGGGCTGGCGAGACTGGGGGCGCCGTC
CCCGGAGCGACACCCCCGCGTGCAGCTGCAGAAGGACATGCGCCCGGCGTACGT
GCCTCCGCAGAACCTGTTCAGGGACCGCAGCGGGGAGGAGCCCGAGGAGATGC
GCGACTGCCGTTTTCGGGCGGGCAGGGAGCTGCGCGAGGGCCTGGACCGCCAGC
GCGTGCTGCGCGACGAGGATTTCGAGCCGAACGAGCAGACGGGGATCAGCCCC
GCGCGCGCGCACGTGGCTGCGGCCAACCTGGTGACGGCCTACGAGCAGACGGTG
AAGCAGGAGCGCAACTTCCAAAAGAGTTTCAACAACCATGTGCGCACGCTGATC
GCGCGCGAGGAGGTGGCCCTGGGCCTGATGCACCTGTGGGACCTGGCGGAGGCC
ATCGTGCAGAATCCGGACAGCAAGCCTCTGACGGCGCAGCTGTTCCTGGTGGTG
CAGCACAGCAGGGACAACGAGGCGTTCAGGGAGGCGCTGCTGAACATCGCCGA
GCCCGAGGGCCGCTGGCTGCTGGAGCTGATTAACATCTTGCAAAGCATCGTAGT
GCAGGAGCGCAGCCTGAGCCTGGCCGAGAAGGTGGCGGCGATCAACTACTCGGT
GCTGAGCCTGGGCAAGTTTTACGCGCGCAAGATTTACAAGACGCCGTACGTGCC
CATAGACAAGGAGGTGAAGATAGACAGCTTTTACATGCGCATGGCGCTCAAGGT
GCTGACGCTGAGCGACGACCTGGGCGTGTACCGCAACGACCGCATCCACAAGGC
CGTGAGCGCGAGCCGGCGGCGCGAGCTGAGCGACCGCGAGCTGATGCTGAGCCT
GCGCCGGGCGCTGGTAGGGGGCGCCGCCGGCGGCGAGGAGTCCTACTTCGACAT
GGGGGCGGACCTGCATTGGCAGCCGAGCCGGCGCGCCTTGGAGGCCGCCTACGG
TCCAGAGGACGACTTGGATGAGGAAGAGGAGGAGGATGCACCCGCTGCGGGT
ACTGACGCCTCCGTGATGTGTTTTTAGATGCAGCAAGCCCCGGACCCCGCCATAA
GGGCGGCGCTGCAAAGCCAGCCGTCCGGTCTAGCATCGGACGACTGGGAGGCCG
CGATGCAACGCATCATGGCCCTGACGACCCGCAACCCCGAGTCCTTTAGACAAC
AGCCACAGGCCAACAGACTTTCGGCCATTCTGGAGGCGGTGGTCCCCTCTCGGA
CCAACCCCACGCATGAGAAGGTGCTGGCGATCGTGAACGCGCTGGCCGAGAAC
AAGGCCATCCGTCCCGACGAGGCCGGGCTGGTGTACAACGCCCTGCTGGAGCGC
GTGGGCGCTACAACAGCACAAACGTGCAGTCCAACCTGGATCGGCTGGTGACG
GACGTGCGCGAGGCCGTGGCGCAGCGCGAGCGATTCAAGAACGAGGGCCTTGG
CTCGCTGGTGGCGCTGAACGCCTTCCTGGCAACGCAGCCGGCGAACGTGCCGCG
CGGGCAGGACGATTATACCAACTTTATCAGCGCGCTGCGGCTGATGGTGACCGA
GGTTCCCCAGAGCGAGGTGTACCAGTCGGGCCCGGACTACTTTTTCCAGACTAG
CAGACAGGGCCTGCAGACGGTGAACCTGAGCCAGGCTTTCAAGAACCTGCGCGG
GCTGTGGGGCGTGCAGGCGCCCGTGGGCGACCGGTCGACGGTGAGCAGCTTGCT
GACGCCCAACTCGCGGCTGCTGCTGCTGATCGCGCCCTTCACCGACAGCGG
CAGCGTGAACCGCAACTCGTACCTGGGCCACCTGCTGACGCTGTACCGCGAGGC
CATAGGCCAGGCGCAGGTGGATGAGCAGACCTTCCAGGAGATCACGAGCGTGA
GCCGCGCGCTGGGGCAGAACGACACCGACAGTCTGAGGGCCACCCTGAACTTCT
TGCTGACCAATAGACAGCAGAAGATCCCGGCCAGTACGCACTGTCGGCCGAGG
AGGAAAGGATCCTGAGATATGTGCAGCAGAGCGTAGGGCTGTTCCTGATGCAGG
AGGGCGCCACCCCCAGCGCCGCTGGACATGACCGCGCGCAACATGGAACCTA
GCATGTACGCCGCCAACCGGCCGTTCATCAATAAGCTGATGGACTACCTGCACC
GCGCGGCGGCCATGAACACGGACTACTTTACCAACGCCATCCTGAACCCGCACT
GGCTCCCGCCGCCGGGGTTCTACACGGGCGAGTACGACATGCCCGACCCCAACG
ACGGGTTCCTGTGGGACGACGTGGACAGCGCGGTGTTCTCGCCGACTTTTCAAA

TABLE 7-continued

Nucleic Acid Sequences of Vectors

SEQ ID NO Sequence

AGCGCCAGGAGGCGCCGCCGAGCGAGGGAGCGGTGGGGAGGAGCCCCTTTCCT
AGCTTAGGGAGTTTGCATAGTTTGCCGGGCTCGGTGAACAGCGGCAGGGTGAGC
CGGCCGCGCTTGCTGGGCGAGGACGAGTACCTGAACGACTCGCTGCTGCAGCCG
CCACGGGCCAAGAACGCCATGGCCAATAACGGGATAGAAAGTCTGGTGGACAA
ACTGAACCGCTGGAAGACCTACGCTCAGGACCATAGGGACGCGCCCGCGCCGCG
GCGACAGCGCCCACGACCGGCAGCGGGGCCTGGTGTGGGACGACGAGGACTCGG
CCGACGATAGCAGCGTGTTGGACTTGGGCGGGAGCGGTGGTGGGGCCAACCCGT
TCGCGCATCTGCAGCCCAGACTGGGGCGGCGGATGTTTTGAAATGCAAAATAAA
ACTCACCAAGGCCATAGCGTGCGTTCTCTTCCTTGTTAGAGATGAGGCGCGCGGT
GGTGTCTTCCTCTCCTCCTCCCTCGTACGAGAGCGTGATGGCGCAGGCGACCCTG
GAGGTTCCGTTTGTGCCTCCGCGGTATATGGCTCCTACGGAGGGCAGAAACAGC
ATTCGTTACTCGGAGCTGGCTCCGCAGTACGACACCACTCGCGTGTACTTGGTGG
ACAACAAGTCGGCGGACATCGCTTCCCTGAACTACCAAAACGACCACAGCAACT
TCCTGACCACGGTGGTGCAGAACAACGATTTCACCCCCGCCGAGGCCAGCACGC
AGACGATAAATTTTGACGAGCGGTCGCGGTGGGGCGGTGATCTGAAGACCATTC
TGCACACCAACATGCCCAATGTGAACGAGTACATGTTCACCAGCAAGTTTAAGG
CGCGGGTGATGGTGTCTAGGAAAAAGGCGGAAGGGGCTGATGAGAATGATAGG
AGCAAGGATATTCTAGAGTATCAGTGGTTTGAGTTTACCCTGCCCGAGGGCAAC
TTTTCCGAGACCATGACCATAGACCTGATGAACAACGCCATCTTGGAAAACTAC
TTGCAAGTGGGGCGGCAAAATGGCGTGCTGGAGAGCGATATCGGAGTCAAGTTT
GACAGCAGGAATTTCAAGCTGGGCTGGGACCCGGTGACCAAGCTGGTGATGCCA
GGGGTCTACACATACGAGGCCTTCCACCCGGACGTGGTGCTGCTGCCTGGCTGT
GGGGTGGACTTCACCGAGAGCGCCTGAGCAACCTCCTGGGCATTCGCAAGAAG
CAACCTTTCCAAGAGGGCTTCAGAATCATGTATGAGGATCTAGAAGGGGCAAC
ATCCCCGCTCTCCTGGATACCAAAAAATATCTGGATAGCAAGAAAGACATTGAA
GATGCAAAGCAGAAAGCGGCGCAGGCAGGTGGTGAGATCAGAGGAGACAGTGC
TGATACTAGAGCTGCAGAGAAGGCGGCTGAAAAAGAGCTGGTTATTGAACCCAT
CGAGCAAGATGAAAGCAAGAGGAGCTATAATGTGATCAAGGGGACCCATGACA
CCCTGTACCGAAGCTGGTACCTGTCCTATACCTACGGGGACCCCGAGAAGGGGG
TGCAGTCGTGGACGCTGCTCACCACCCCGGACGTCACCTGCGGCGCGGAGCAAG
TCTACTGGTCGCTGCCGGACCTCATGCAAGACCCGGTCACCTTCCGCTCCACCCA
GCAAGTCAGCAACTACCCCGTGGTCGGCGCCGAGCTCATGCCCTTCCGCGCCAA
GAGCTTTTACAACGACCTCGCCGTCTACTCCCAGCTCATCCGCAGCTATACCTCC
CTCACCCACGTCTTCAACCGCTTCCCCGACAACCAGATCCTCTGCCGCCCCGCCG
CGCCCACCATCACCACCGTCAGTGAAAACGTGCCTGCTCTCACAGATCACGGGA
CGCTACCGCTGCGCAGCAGTATCCGCGGAGTCCAGCGAGTGACCGTCACTGACG
CCCGTCGCCGCACCTGTCCCTACGTCTACAAGGCCCTGGGCATAGTCGCGCCGCG
TGTGCTTTCCAGTCGCCACCTTCTAAAAAAATGTCTATTCTCATCTCGCCCAGCAA
TAACACCGGCTGGGGTATTACTAGGCCCAGCACCATGTACGGAGGAGCCAAGAA
GCGCTCCCAGCAGCACCCCGTCCGCGTCCGCGGCCACTTCCGCGCTCCCTGGGGC
GCTTACAAGCGCGGCGGACTCCCGCCGCTGCCGTGCGCACCACCGTTGACGAC
GTCATCGACTCGGTGGTCGCCGACGCGCGCAACTATACTCCCGCCCCCTCGACCG
TGGACGCGGTCATTGACAGCGTGGTGGCCGACGCGCGCGACTATGCCAGACGCA
AGAGTCGGCGGCGACGGATCGCCAGGCGCCACCGGAGCACGCCCGCCATGCGC
GCCGCCCGGGCTCTGCTGCGCCGCGCCAGACGCACGGGCCGCCGGGCCATGATG
CGAGCCGCGCCGCCGCGCTGCCACTGCACCCCCCGCAGGCAGGACTCGCAGACGA
GCGGCCGCCGCCGCCGCGGCCATCTCTAGCATGACCAGACCCAGGCGCGGA
AACGTGTACTGGGTGCGCGACTCCGTCACGGGCGTGCGCGTGCCCGTGCGCACC
CGTCCTCCTCGTCCCTGATCTAATGCTTGTGTCCTCCCCCGCAAGCGACGATGTC
AAAGCGCAAATCAAGGAGGAGATGCTCCAGGTCGTCGCCCCGGAGATTTACGG
ACCCCCGGACCAGAAACCCCGCAAAATCAAGCGGGTTAAAAAAAAGGATGAGG
TGGACGAGGGGGCAGTAGAGTTTGTGCGCGAGTTCGCTCCGCGGCGGCGCGTAA
ATTGGAAGGGGCGCAGGGTGCAGCGCGTGTTGCGGCCCGGCACGGCGGTGGTGT
TCACGCCCGGCGAGCGGTCCTCGGTCAGGATGAAACGTAGCTATGACGAGGTGT
ACGGCGACGACGACATCCTGGACCAGGCGGCGGAGCGGGCGGGCGAGTTCGCC
TACGGGAAGCGGTCGCGCGAAGAGGAGCTGATCTCGCTGCCGCTGGACGAGAG
CAACCCCACGCCGAGCCTGAAGCCCGTGACCCTGCAGCAGGTGCTGCCCCAGGC
GGTGCTGCTGCCGAGCCGCGGGGTCAAGCGCGAGGGCGAAAACATGTACCCGA
CCATGCAGATCATGGTGCCCAAGCGCCGGCGCGTGGAGGACGTGCTGGACACCG
TGAAAATGGATGTGGAGCCCGAGGTCAAGGTGCGCCCCATCAAGCAGGTGGTGC
CGGGCCTGGGCGTGCAGACCGTGGACATTCAGATCCCCACCGACATGGATGTCG
ACAAAAAACCCTCGACCAGCATCGAGGTGCAGACCGACCCCTGGCTCCCAGCTA
CTTCTACCGCCACCGCATCCACTTCTACCATGGCTACCGAGCCTCCAAGGAGGCG
AAGATGGGGCGCCGCCAGCCGGCTGATGCCCAACTACGTGTTGCATCCTTCCAT
CATCCCGACGCCGGGCTACCGCGGCACCCGGTACTACGCCAGCCGCAGGCGCCC
AGCCGCCAAACGCCGCCGCCGCACCACCACCCGCCGCGTCTGGCCCCCGCCCG
CGTGCGCCGCGTAACCACGCGCCGGGGCGCTCGCTCGTTCTGCCCACCGTGCG
CTACCACCCCAGCATCCTTTAATCCGTGTGCTGTGATACTGTTGCAGAGAGATGG
CTCTCACTTGCCGCCTGCGCATCCCCGTCCCGAATTACCGAGGAAGATCCCGCCG
CAGGAGAGGCATGGCAGGCAGCGGCCTGAACCGCCGCCGGCGGCGGGCCATGC
GCAGGCGCCTGAGTGGCGGGTTCCTGCCCGCGCTCATCCCCATAATCGCCGCGG
CCATCGGCACGATCCCGGGCATAGCTTCCGTTGCGCTGCAGGCGTCGCAGCGCC
GTTGATGTGCGAATAAAGCCTCTTTAGACTCTGACACACCTGGTCCTGTATATTT
TTAGAATGGAAGACATCAATTTTGCGTCCCTGGCTCCGCGGCACGGCACGCGGC
CGTTCATGGGCACCTGGAACGAGATCGGCACCAGCCAGCTGAACGGGGCGCCT
TCAATTGGAGCAGTGTCTGGAGCGGGCTTAAAAATTTCGGCTCGACGCTCCGGA

TABLE 7-continued

Nucleic Acid Sequences of Vectors

SEQ ID NO Sequence

CCTATGGGAACAAGGCCTGGAATAGTAGCACGGGGCAGTTGTTAAGGGAAAAG
CTCAAAGACCAGAACTTCCAGCAGAAGGTGGTGGACGGGCTGGCCTCGGGCATT
AACGGGGTGGTGGACATCGCGAACCAGGCCGTGCAGCGCGAGATAAACAGCCG
CCTGGACCCGCGGCCGCCCACGGTGGTGGAGATGGAAGATGCAACTCTTCCTCC
GCCCAAAGGCGAGAAGCGGCCGCGGCCCGACGCGGAGGAGACGATCCTGCAGG
TGGACGAGCCGCCCTCGTACGAGGAGGCCGTCAAGGCCGGCATGCCCACTACGC
GCATTATCGCGCCGCTGGCCACGGGTGTAATGAAACCCGCCACCCTTGACCTGC
CTCCACCACCCACGCCCGCTCCACCGAAGGCAGCTCCGGTCGTGCAGGCCCCCC
CGGTGGCGACCGCCGTGCGCCGCGTCCCCGCCCGCCGCCAGGCCCAGAACTGGC
AGAGCACGCTGCACAGTATCGTGGGCCTGGGAGTGAAAAGTCTGAAGCGCCGCC
GATGCTTTTGAGAGAGAGGAGAGGACACTAAAGGGAGAGCTTAACTTGTATGTG
CCTTACCGCCAGAGAACGCGCGAAGATGGCCACCCCCTCGATGATGCCGCAGTG
GGCGTACATGCACATCGCCGGGCAGGACGCCTCGGAGTACCTGAGCCCGGGTCT
GGTGCAGTTTGCCCGCGCCACCGACACGTACTTCAGCCTGGGCAACAAGTTTAG
GAACCCCACGGTGGCCCCGACCCACGATGTGACCACGGACCGGTCCCAGCGTCT
GACGCTGCGCTTCGTGCCCGTGGATCGCGAGGACACCACGTACTCGTACAAGGC
GCGCTTCACTCTGGCCGTGGGCGACAACCGGGTGCTAGACATGGCCAGCACGTA
CTTTGACATCCGCGGCGTCCTGGACCGCGGTCCCAGCTTCAAACCCTACTCGGGC
ACAGCTTACAACAGCCTGGCCCCCAAGGGCGCCCCCAATCCCAGTCAGTGGACT
ACCAAAGAAAAGCAGACCGGAGTAAATGCAGGAGACAAAGAAGTTACAAAGAC
ATTTGGACTTGCCGCCATGGGAGGCAGTAATATTTCTAAGGACGGTTTGCAGATT
GGAACTGACACAACACCAGATGCTGTAAAACCAATATATGCAGACAAAACTTAC
CAGCCAGAACCTCAAGTGGGAGAAGAAAACTGGCAGGATAATGATGAATATTA
TGGCGGCAGGGCTCTTAAAAAAGATACTAAAATGAAGCCATGCTATGGTTCCTT
TGCTAAACCCACAAACAAGGAAGGTGGCCAGGCTAAATTGAAAGAAACACCCA
ATGGTGCTGATCCTCAATATGATGTGGACATGGCCTTCTTCGATTCAACCACTAT
AAACATTCCAGATGTAGTGTTATACACTGAAAATGTAGATTTGGAAACTCCAGA
TACACATGTGGTGTACAAACCAGGCAAAGAGGATGAAAGTTCTGAAGCTAACTT
AACTCAGCAGTCCATGCCAAACAGACCAAACTACATTGGCTTCAGAGACAACTT
TGTGGGGCTCATGTATTACAACAGCACTGGAAACATGGGTGTGCTGGCTGGTCA
GGCTTCCCAATTGAATGCTGTGGTCGACTTGCAAGACAGAAACACAGAGCTGTC
TTACCAGCTTTTGCTAGATTCTCTGGGTGACAGAACCAGATACTTTAGCATGTGG
AACTCTGCGGTGGACAGTTATGATCCCGATGTCAGGATCATTGAAAATCATGGT
GTGGAAGATGAACTTCCAAACTATTGCTTCCCCTTGGACGGTGTTCAAACTAATT
CAGCCTACCAAGGTGTTAAACTAAAGGCTAATCAAGCAGGAGGTGGAGCTAATG
GAGACTGGGAAAAGGATGATACCATTTCAGCCCATAATCAAATTGGAAAGGGCA
ACATCTTTGCCATGGAGATCAACCTCCAGGCCAACCTGTGGAAGAGTTTTCTGTA
CTCGAACGTGGCTCTGTACCTGCCCGACTCCTACAAGTACACGCCGGCCAACGTC
ACGCTGCCCACCAACACCAATACCTATGAGTACATGAACGGCCGCGTGGTGGCA
CCCTCGCTGGTGGATGCCTACATCAACATCGGCGCCCGCTGGTCGCTGGACCCCA
TGGACAATGTCAACCCCTTCAACCACCACCGCAACGCGGGCCTGCGCTACCGCT
CCATGCTTCTGGGAAACGGCCGCTACGTGCCCTTCCACATCCAAGTGCCCCAAA
AGTTCTTTGCCATCAAGAACCTGCTCCTGCTCCCGGGCTCCTACACCTACGAGTG
GAACTTCCGCAAGGACGTCAACATGATCCTGCAGAGTTCCCTCGGCAACGACCT
GCGCGTCGACGGCGCCTCCGTCCGCTTCGACAGCGTCAACCTCTACGCCACCTTC
TTCCCCATGGCGCACAACACCGCCTCCACCCTGGAAGCCATGCTGCGCAACGAC
ACCAACGACCAGTCCTTCAACGACTACCTCTCGGCCGCCAACATGCTCTACCCCA
TCCCGGCCAAGGCCACCAACGTACCCATCTCCATCCCCTCGCGCAACTGGGCCG
CCTTCCGCGGCTGGAGTTTCACCCGTCTCAAGACCAAGGAAACTCCCTCCCTCGG
CTCGGGTTTCGACCCCTACTTTGTCTACTCGGGCTCGATCCCCTACCTTGACGGG
ACCTTCTACCTCAACCACACCTTCAAGAAGGTCTCCATCATGTTCGACTCCTCGG
TCAGCTGGCCCGGCAACGACCGGCTGCTCACGCCGAACGAGTTCGAGATCAAGC
GCAGCGTCGACGGGGAGGGCTACAACGTGGCCCAATGCAACATGACCAAGGAC
TGGTTCCTCGTCCAGATGCTCTCCCACTACAACATCGGCTACCAGGGCTTCCACG
TGCCCGAGGGATACAAGGACCGCATGTACTCCTTCTTCCGCAACTTCCAGCCCAT
GAGCAGGCAGGTGGTCGATGAGATCAACTACAAGGACTACAAGGCCGTCACCCT
GCCCTTCCAGCACAACAACTCGGGCTTCGTCGGCTACCTCGCACCCACCATGCGC
CAGGGGCAGCCTTACCCCGCCAACTTCCCCTACCCGCTCATCGGCCAGACAGCC
GTGCCCTCCGTCACCCAGAAAAAGTTCCTCTGCGACAGGGTCATGTGGCGCATC
CCCTTCTCCAGCAACTTCATGTCCATGGGCGCCCTCACCGACCTGGGTCAGAACA
TGCTCTACGCCAACTCGGCCCACGCGCTCGACATGACCTTCGAGGTGGACCCCAT
GGATGAGCCCACCCTCCTCTATCTTCTCTTCGAAGTTTTCGACGTGGTCAGAGTG
CACCAGCCGCACCGCGGCGTCATCGAGGCCGTCTACCTGCGCACGCCCTTCTCCG
CCGGCAACGCCACCACCTAAGCATGAGCGGCTCCAGCGAACGAGAGCTCGCGGC
CATCGTGCGCGACCTGGGCTGCGGGCCCTACTTTTTGGGCACCCACGACAAGCG
CTTCCCGGGCTTCCTCGCCGGCGACAAGCTGGCCTGCGCCATCGTCAACACGGCC
GGCCGCGAGACCGGAGGCGTGCACTGGCTCGCCTTCGGCTGGAACCCGCGCTCG
CGCACCTGCTACATGTTCGACCCCTTCGGGTTCTCGGACCGCCGGCTCAAACAGA
TTTACAGCTTCGAGTACGAGGCCATGCTGCGCCGAAGCGCCCTCGCCTCCTCGCC
CGACCGCTGTCTCAGCCTCGAGCAGTCCACCCAGACCGTGCAGGGGCCCGACTC
CGCCGCCTGCGGACTCTTCTGTTGCATGTTCTTGCATGCTTTCGTGCACTGGCCCG
ACCGACCCATGGACGGGAACCCCACCATGAACTTGCTGACGGGGTGCCCAACG
GCATGCTACAATCGCCACAGGTGCTGCCCACCCTCCGGCGCAACCAGGAGGAGC
TCTACCGCTTCCTCGCGCGCCACTCCCCCTACTTTCGCTCCCACCGCGCCGCCATC
GAACACGCCACCGCTTTTGATAAAATGAAACAACTGCGTGTATGACTGAAATAA
ACAGCACTTTTATTTTACACAAGCACTGGAGTATATGCAAGTTATTTAAAAGTCG

TABLE 7-continued

Nucleic Acid Sequences of Vectors

SEQ ID NO Sequence

AAGGGGTTCTCGCGCTCGTCGTTGTGCGCCGCGCTGGGGAGGGCCACGTTGCGG
TACTGGTACTTGGGCTGCCACTTGAACTCGGGGATCACCAGTTTGGGCACTGGG
GTCTCGGGGAAGGTCTCGCTCCACATGCGCCGGCTCATCTGCAGGGCGCCCAGC
ATGTCCGGGGCTGAGATCTTGAAATCGCAGTTGGGACCGGTGCTCTGCGCGCGC
GAGTTGCGGTACACGGGGTTGCAGCACTGGAACACCATCAGACTGGGGTGCTTC
ACGCTGGCCAGCACGCTCTTGTCGCTGATCTGATCCTTGTCCAGGTCCTCGGCGT
TGCTCAGGCCGAACGGGGTCATCTTGCACAGCTGGCGGCCCAGGAAGGGAACGC
TGTGGGGCTTGTGGTTACACTCGCAGTGCACGGGCATCAGCATCATCCCCGCGCC
GCGCTGCATATTCGGGTAGAGGGCCTTGACGAAGGCCGTGATCTGCTTGAAAGC
TTGCTGGGCCTTGGCCCCCTCGCTGAAGAACAGGCCGCAGCTCTTCCCGCTGAAC
TGGTTATTCCCACATCCGGCATCTTGCACGCAGCAGGGCGTCATGGCTGGTCA
GTTGCACCACGCTTCGACCCCAGCGGTTCTGGGTCACCTTGGCCTTGCTGGGCTG
TTCCTTCAACGCGCGCTGTCCGTTCTCGCTGGTCACATCCATCTCCACCACGTGG
TCCTTGTGGATCATCACCGTTCCGTGCAGACACTTGAGCTGGCCTTCCACCTCGG
TGCATCCGTGGTCCCACAGGGCGCAGCCGGTGCACTCCCAGTTCTTGTGCGCGAT
CCCGCTGTGGCTGAAGATGTAACCTTGTAACAGGCGGCCCATGACGGTGCTAAA
GGTTTTCTGGGTGGTGAAGGTCAGTTGCAGCGCGCGGGCCTCCTCGTTGCATCCAG
GTCTGGCACATCTTTTGGAAGATCTCGGTCTGCTCGGGCATGAGCTTGTAAGCAT
CGCGCAGGCCGCTTTCGACGCGGTAGCGTTCCATCAGCACGTTCATGGTATCCAT
GCCCTTCTCCCAGGACGAGACCAGAGGCAGACTCAGGGGGTTGCGCACGTTCAG
AATACCGGGGGTCGCGGGCTCGACGATGCGTTTTCCGTCCTTGCCTTCCTTCAAC
AGAACCGGCGGCTGGCTGAATCCCACTCCCACGATCACGGCATCTTCTTCCTGGG
GCATCTCTTCGTCGGGGTCTACCTTGGTCACATGCTTGGTCTTCCTGGCTTGCTTC
TTTGGCAGTTTTGGAGGGCTGTCTACGGGGACCACGTCCTCCTCGGAAGACCCG
GAGCCCACCCGCTGGTACTTTCGGCGCTTGGTGGGCAGAGGAGGTGGCGGCGAG
GGGCTCCTCTCCTGCTCCGGCGGATAGCGCGCCGACCCGTGGCCCCGGGGCGGA
GTGGCCTCTCGGTCCATGAACCGGCGCACGTCCTGACTGCCGCCGGCCATTGTTC
CTAGGGGAAGATGGAGCCGCGTAAGCAGGAGCAGGAGGAGGAGAACTTAACCA
CCCACGAGCAACCCAAAATCGAGCAGGACCTGGGCTTGGAAGATCGTCTAGAAC
CCCCACAGGATGAACAGGAGCACGAGCAAGACGCAGGCCAGGAGGAGACCGAC
GCTGGGCTCGAGCATGGCTACCTAGGAGGAGATGTGCTGCTGAAACACTTGCAG
CGCCAGTCCCTCATCCTCCGGGACGCCCTGGCCGACCGGAGCGAAACCCCCCTC
AGCGTCGAGGAGCTGTGTCGGGCCTACGAGCTCAACCTCTTCTCGCCGCGCGTG
CCCCCCAAACGCCAGCCCAACGGCACCTGCGAGCCCAACCCGCGTCTCAACTTC
TACCCCGTCTTCGCGGTCCCCGAGGCCCTCGCCACCTATCACATCTTTTTCAAGA
ACCAAAAGATCCCCGTCTCCTGCCGCGCCAACCGCACCCGCGCCGACGCGCTCC
TCGCTCTGGGGCCCGGCGCACGCATACCTGATATCGCTTCCCTGGAAGAGGTGC
CCAAGATCTTCGAAGGGCTCGGTCGGGACGAGACGCGCGCGGCGAACGCTCTGA
AAGAAACAGCAGAGGAAGAGGGTCACACTAGCGCCCTGGTAGAGTTGGAAGGC
GACAACGCCAGGCTGGCCGTGCTCAAGCGCAGCGTCGAGCTCACCCACTTCGCC
TACCCCGCCGTCAACCTCCCGCCCAAGGTCATGCGTCGCATCATGGATCAGCTCA
TCATGCCCCACATCGAGGCCCTCGATGAAAGTCAGGAGCAGCGCCCCGAGGACG
CCAAACCCGTGGTCAGCGACGAGATGCTCGCGCGCTGGCTCGGGACCCGCGACC
CCCAGGCCCTGGAGCAGCGGCGCAAGCTCATGCTGGCCGTGGTCCTGGTCACCC
TCGAGCTGGAATGCATGCGCCGCTTCTTCAGCGACCCCGAGACCCTGCGCAAGG
TCGAGGAGACCCTGCACTACACTTTCAGGCACGGGTTCGTCAGGCAGGCCTGCA
AGATCTCCAACGTGGAGCTGACCAACCTGGTCTCCTGTCTGGGGATCCTGCACG
AGAACCGCCTGGGGCAGACCGTGCTCCACTCCACCCTGAAGGGCGAGGCGCGCC
GGGACTATGTCCGCGACTGCATCTTTCTATTTCTCTGCCACACCTGGCAAGCGGC
CATGGGCGTGTGGCAGCAGTGTCTCGAGGACGAGAACCTGAAGGAGCTGGACA
AGCTTCTTGCTAGAAACCTCAAAAAGCTGTGGACGGGCTTCGACGAGCGGACCA
CCGCCGCCGACCTGGCCGAGATCGTTTTCCCCGAGCGCCTGAGGCAGACGCTGA
AAGGCGGGCTTCCCGACTTCATGAGCCAGAGCATGTTGCAAAACTACCGCACTT
TCATTCTCGAGCGATCTGGGATGCTGCCCGCCACCTGCAACGCCTTCCCCTCCGA
CTTTGTCCCGCTGAGCTACCGCGAGTGTCCCCCGCCGCTGTGGAGCCACTGCTAC
CTCTTGCAGCTGGCCAACTACATCGCCTACCACTCGGATGTGATCGAGGACGTG
AGCGGCGAGGGCTGCTCGAGTGCCACTGCCGCTGCAACCTGTGCTCCCCGCAC
CGCTCCCTGGTCTGCAACCCCCAGCTCCTGAGCGAAACCCAGGTCATCGGTACCT
TCGAGCTGCAAGGTCCGCAGGAGTCCACCGCTCCGCTGAAACTCACGCCGGGGT
TGTGGACTTCCGCGTACCTGCGCAAATTTGTACCCGAGGACTACCACGCCCACG
AGATAAAGTTCTTCGAGGACCAATCGCGCCCGCAGCACGCGGATCTCACGGCCT
GCGTCATCACCCAGGGCGCCATCCTCGCCCAATTGCACGCCATCCAAAAATCCC
GCCAAGAGTTTCTTCTGAAAAAGGGTAGAGGGGTCTACCTGGACCCCCAGACGG
GCGAGGTGCTCAACCCGGGTCTCCCCCAGCATGCCGAGGAAGAAGCCGCTAGTG
GAGGAGGAGATGGAAGAAGAATGGGACAGCCAGGCAGAGGAGGAAGAATGGG
AGGAGGAGAGTACAGAGGAGGAAGAATTGGAAGAGGTGGAAGAGGAGCAGGC
AACAGAGCAGCCCGTCGCCGCACCATCCGCGCCGGCAGCCCCGGCGGTCACGGA
TACAACCTCCGCAGCTCCGGCCAAGCCTCCTCGTAGATGGGATCGAGTGAAGGG
TGACGGTAAGCACGAGCGGCAGGGCTACCGATCATGGAGGGCCCACAAAGCCG
CGATCATCGCCTGCTTGCAAGACTGCGGGGGGAACATCGCTTTCGCCCGCCGCT
ACCTGCTCTTCCACCGGGGGTGAACATCCCCCGCAACGTGTTGCATTACTACCG
TCACCTTCACAGCTAAGAAAAAGCAAGTAAGAGGAGTCGCCGGAGGAGGAGGA
GGCCTGAGGATCGCGGCGAACGAGCCATTGACCACCAGGGAGCTGAGGAACCG
GATCTTCCCCACTCTTTATGCCATTTTTCAGCAGAGTCGAGGTCAGCAGCAAGAG
CTCAAAGTAAAAAATCGGTCTCTGCGCTCGCTCACCCGCAGTTGCTTGTACCACA
AAAACGAAGATCAGCTGCAGCGCACTCTCGAAGACGCCGAGGCTCTGTTCCACA

TABLE 7-continued

Nucleic Acid Sequences of Vectors

SEQ ID NO Sequence

AGTACTGCGCGCTCACTCTTAAAGACTAAGGCGCGCCCACCCGGAAAAAGGCG
GGAATTACCTCATCGCCACCACCATGAGCAAGGAGATTCCCACACCTTACATGT
GGAGCTATCAGCCCCAGATGGGCCTGGCCGCGGGCGCCTCCCAGGACTACTCCA
CCCGCATGAACTGGCTCAGTGCCGGGCCCTCGATGATCTCACGGGTCAACGGGG
TCCGTAACCATCGAAACCAGATATTGTTGGAGCAGGCGGCGGTCACCTCCACGC
CCAGGGCAAAGCTCAACCCGCGTAATTGGCCCTCCACCCTGGTGTATCAGGAAA
TCCCCGGGCCGACTACCGTACTACTTCCGCGTGACGCACTGGCCGAAGTCCGCAT
GACTAACTCAGGTGTCCAGCTGGCCGGCGGCGCTTCCCGGTGCCCGCTCCGCCC
ACAATCGGGTATAAAAACCCTGGTGATCCGAGGCAGAGGCACACAGCTCAACG
ACGAGTTGGTGAGCTCTTCGATCGGTCTGCGACCGGACGGAGTGTTCCAACTAG
CCGGAGCCGGGAGATCCTCCTTCACTCCCAACCAGGCCTACCTGACCTTGCAGA
GCAGCTCTTCGGAGCCTCGCTCCGGAGGCATCGGAACCCTCCAGTTTGTGGAGG
AGTTTGTGCCCTCGGTCTACTTCAACCCCTTCTCGGGATCGCCAGGCCTCTACCC
GGACGAGTTCATACCGAACTTCGACGCAGTGAGAGAAGCGGTGGACGGCTACG
ACTGAATGTCCCATGGTGACTCGGCTGAGCTCGCTCGGTTGAGGCATCTGGACC
ACTGCCGCCGCCTGCGCTGCTTCGCCCGGGAGAGCTGCGGACTCATCTACTTTGA
GTTTCCCGAGGAGCACCCCAACGGCCCTGCACACGGAGTGCGGATCACCGTAGA
GGGCACCACCGAGTCTCACCTGGTCAGGTTCTTCACCCAGCAACCCTTCCTGGTC
GAGCGTGACCGGGGCGCCACCACCTACACCGTCTACTGCATCTGTCCTACCCCG
AAGTTGCATGAGAATTTTTGCTGTACTCTGTGTGCTGAGTTTAATAAAAGCTAAA
CTCCTACAATACTCTGGGATCCCGTGTCGTCGCACTCGCAACGAGACCTTCAACC
TTACCAATCAGACTGAGGTAAAACTCAACTGCAGACCAGGGGACAAATACATCC
TCTGGCTCTTTGAGAACACTTCCTTCGCGGTCTCCAACACCTGCGCCAACGACGG
TATTGAAATACCCAACAACCTTACCAGTGGACTAACTTACACCACCAGAAAGAC
TAAGCTAGTACTCTACAATCCTTTTGTAGAGGGAACCTACCACTGCCAGAGCGG
ACCTTGCTTCCACACTTTCACTTTGGTGAACGTTACCGGCAGCAGCACAGCCGCT
CCAGAAACATCTAACCTTCTTTCTGATACTAACACTCCTAAAACCGGAGGTGAGC
TCTGGGTTCCCTCTCTAACAGAGGGGGGTAAACATATTGAAGCGGTTGGGTATTT
GATTTTAGGGGTGGTCCTGGGTGGGTGCATAGCGGTCGTGCTGTATTACCTTCCTTGC
TGGATCGAAATCAAAATCTTTATTTGCTGGGTCATACATTGTTGGGAGGAACCAT
GAAGGGGCTCTTGCTGATTATCCTTTCCCTGGTTGGGGGTGTACTGTCATGCCAC
GAACAGCCACGATGTAACATCACCACAGGCAATGAGAGGAGTGTGATATGCAC
AGTAGTCATCAAATGCGAGCATACATGTCCTCTCAACATCACATTCAAGAATAA
GACCATGGGAAATGCATGGGTGGGCGATTGGGAACCAGGAGATGAGCAGAACT
ACACGGTCACTGTCCATGGTAGCAATGGAAATACACACTTTCGGTTTCAAATTCAT
TTTTGAAGTCATGTGTGATATCACACTGCATGTGGCTAGACTTCATGGCTTGTGG
CCCCCTACCAAGGAGAACATGGTTGGGTTTTCTTTGGCTTTTGTGATCATGGCCT
GTGCAATGTCAGGTCTGCTGGTAGGGGCTATAATATGGTTCCTGAGGCACAAGC
CCAGGTATGGAAATCTGGAAAAGGAAAAATTGCTATAAATGTTTTTCTTTCCACA
GCATCATGAATACAGTGATCCGTATCGTGCTGCTCTCTCTTCTTGTAGCTTTTAGT
CAGGCAGGATTTCATACTATCAATGCTACATGGTGGGCTAATATAACTTTAGTGG
GACCCTCAGATACGCCAGTCACCTGGTATGATAAACAGGGAATGCAGTTCTGTG
ATGGAAATACAGTTAAGAATCCTCAAATAAGACATGAGTGTAATGAGCAAAACC
TTACACTAATTCATGTGAACAAAACCCATGAAAGGACATACATGGGTTATAATA
GACAGAGTACTCATAAGGAAGACTATAAAGTCATAGTTATACCGCCTCCTCCTG
CTACTGTAAAGCCACAGTCAGGTCCAGAGTATGTATATGTTAATATGGGAGAGA
ATAAAACATTAGTTGGACCTCCAGGAATACCAGTTACTTGGTATGACGGAGAAG
GAAATAAATTCTGCGATGGAAAAAAAGTTGAACATGCAGAATTTAATCATACAT
GTGACGTGCAAAATCTTACACTGTTGTTTATAAATCTTACACATGATGGGGCTTA
TCTTGGCTATAATCACCAGGGAACTAAAAGAACTTGGTATGAGGTTGTAGTGAC
AGATGGTTTTCCAAAATCAGGGGAGATGAAAATCGAAGATCAGAGTAGACAAA
CAGAACAAAAACAAACTGGGCAAAAACAAAATGAGCATAAACAGGGTGGGCAG
AAACAGGAGGGGCAAAAAGAGACAAGTCAAAAGAAAGCTAATGACAAACAGA
AGGCGACACACAGGAGGCCATCAAAACTAAAGCCGCACACACCTGAAGCAAAA
CTGATTACAGTTTCTAGTGGGTCTAACTTAACATTACTTGGGCCAGATGGAAAGG
TCACTTGGTATGATGATGATTTAAAAAGACCATGTGAACCTGGATATAAGTTAA
ACTGTAAGTGTGACAATCAAAACCTAACCCTAATCAATGTAACTAAACTTTATG
AGGGAGTTTACTATGGTACTAATGACGGAGGCAACGGCAAAAGATACAGAGTA
AAAGTAAACACTACGAATTCTCAAAATGTGAAAATTCAGCCGTACACCAGGCCT
ACTACTCCTGATCAGAAACACAGATTTGAATTGCAAATTGATTATAATCAAGAC
AATGACAAAATTCCATCAACTACTGTGGCAATCGTGGTGGGTGTGATTGCGGGC
TTCATAACTCTGATCATTGTCATTCTGTGCTACATCTGCTGCCGCAAGCGTCCAA
GGGCATACAATCATATGGTAGACCCACTACTCAGCTTCTCTTACTGAGACTCAGT
CACTTTCATTTCAGAACCATGAAGGCTTTCACAGCTTGCGTTCTGATTAGCATAG
TCACACTTAGTTCAGCTGCAATGATTAATGTTAATGTCACTAGAGGTGGTAAAAT
TACATTGAATGGGACTTATCCACAAACTACATGGACAAGATATCATAAAGATGG
ATGGAAAATATCTGTGAATGGAATGTTACAGCCTATAAATGCTTCAGTAATGG
AAGCATTACAATTACTGCCACTGCTAATATTACTTCTGGCACAATCAAGGCAGA
AAGCTATAAAAATGAAATGAAAAAAATGGTATATAAAAATAACAAGACAACAT
TTGAAGATTCTGGAAATTATGAGTATCAGAAATTATCTTTTTATAATCTGACAAT
TATTGAGCTGCCAACTACTAAGGCTCCCACAGTTAGGACAACGCAGCCTACCAC
TGTACCCACTACACATCCAACCACCACAGCCAGTACAACTACTGAGACCACAAC
TCACACTACAGTGCAGAATAGTACTGTATTGGTTAGGTATTTGTTAAGAGAGGA
AAGTACTACTGAACAGACAGAGGCTACCTCAAGTGCCTTCAGCAGCACTGCAAA
TTTAACTTCGCTTGCTTGGACTAATGAAACCGGAGTATCATTGATGCATGGCCAG
CCTTACTCAGGTTTGGATATTCAAATTACTTTTCTGGTTGTTTGTGGGATCTTTAT

TABLE 7-continued

Nucleic Acid Sequences of Vectors

| SEQ ID NO | Sequence |
|---|---|
| | TCTTGTGGTTCTTCTGTACTTTGTCTGCTGCAAAGCCAGAGAAAAATCTAGGAGA |
| | CCCATCTACAGGCCAGTAATCGGGGATCCTCAGCCTCTCCAAGTGGAAGGGGGT |
| | CTAAGGAATCTTCTCTTCTCTTTTTCAGTATGGTGATTCAGCCATGATTCCTAGGT |
| | TCTTCCTATTTAACATCCTTTTCTGTCTATTCAACGTGTGCGCTGCCTTCGCGGCC |
| | GTCTCGCACGCCTCGCCCGACTGTCTCGGGCCCTTCCCCACCTACCTCCTCTTTGC |
| | CCTGCTCACCTGCACCTGCGTCTGCAGCATTGTCTGCCTGGTCGTCACCTTCCTGC |
| | AGCTCATCGACTGGTGCTGCGCGCGCTACAATTATCTCCACCACAGTCCCGAATA |
| | CAGGGACGAGAACGTAGCCAGAATCTTAAGGCTCATTTGACCATGCAGACTCTG |
| | CTCATACTGCTATCCCTCCTCTCCCCTGCCCTCGCTGATGATGATTACTCTAAGTG |
| | CAAATTTGTGGAGCTATGGAATTTCTTAGACTGCTATGATGCTAAAATGGATATG |
| | CCATCCTATTACTTGGTGATTGTGGGGATAGTCATGGTCTGCTCCTGCACTTTCTT |
| | TGCCATCATGATCTACCCCTGTTTTGATCTCGGCTGGAACTCTGTTGAGGCATTC |
| | ACATACACACTAGAAAGCAGTTCACTAGCCTCCACGCCACCACCCACACCTCCT |
| | CCCCGCAGAAATCAGTTTCCCCTGATTCAGTACTTAGAAGAGCCCCCTCCCCGAC |
| | CCCCTTCCACTGTTAGCTACTTTCACATAACCGGCGGCGATGACTGACCACCTGG |
| | ACCTCGAGATGGACGGCCAGGCCTCCGAGCAGCGCATCCTGCAACTGCGCGTCC |
| | GTCAGCAGCAGGAGCGGGCCGCCAAGGAGCTCCTTGATGCCATCAACATCCACC |
| | AGTGCAAGAAGGGCATCTTCTGCCTGGTCAAACAGGCAAAGATCACCTACGAGC |
| | TCGTGTCCGGCGGCAAGCAGCATCGCCTCGCCTATGAGCTGCCCCAGCAGAAGC |
| | AGAAGTTCACCTGCATGGTGGGCATCAACCCCATAGTCATCACCCAGCAGTCGG |
| | GCGAGGCCAGCGGTTGCATCCACTGCTCCTGCGAAAGCCCCGAGTGCATCTACT |
| | CCCTCCTCAAGACCCTTTGCGGACTCCGCGACCTTCTCCCCATGAACTGATGTTG |
| | ATTAAAAATCCCAGAAACCAATCAGCCCCTTACCCCATTCCCCTCCCACAATTACT |
| | CATAAGAATAAATCATTGGAATTAATGATTCAATAAAGATCACTTACTTGAAAT |
| | CTGAAAGTATGTCTCTGGTGTAGTTGTTCAGCAGCACCTCGGTACCCTCCTCCCA |
| | GCTCTGGTACTCCAGTCCTCGGCGGGCGGCGAACTTCCTCCACACCTTGAAAGG |
| | GATGTCAAATTCCTGGTCCACAATTTTCATTGTCTTCCCTCTCAGATGTCAAAGA |
| | GGCTCCGGGTGGAAGATGACTTCAACCCCGTCTACCCCTATGGCTACGCGCGGA |
| | ATCAGAATATCCCCTTCCTTACTCCCCCCTTTGTCTCATCCGATGGATTCAAAAA |
| | CTTCCCACCTGGGGTCCTGTCACTCAAACTGGCTGACCCAATCGCCATCACTAAT |
| | GGGGATGTCTCACTCAAGGTGGGAGGGGGACTAACTGTGGAACAAGATAGTGG |
| | AAACCTAAGTGTAAACCCTAAGGCTCCATTGCAAGTTGGAACAGACAAAAAACT |
| | GGAATTGGCTTTAGCACCTCCATTTGATGTCAGAGATAACAAGCTAGCTATTCTA |
| | GTAGGAGATGGATTAAAGGTAATAGATAGATCAATATCTGATTTGCCAGGTTTG |
| | TTAAACTATCTTGTAGTTTTGACTGGCAAAGGAATTGGAAATGAAGAATTAAAA |
| | AATGACGATGGTAGCAATAAAGGAGTCGGTTTATGTGTGAGAATTGGAGAAGGA |
| | GGTGGTTTAACTTTTGATGATAAAGGTTATTTAGTAGCATGGAACAATAAACATG |
| | ACATCCGCACACTTTGGACAACTTTAGACCCTTCTCCAAATTGTAAGATAGATAT |
| | AGAAAAAGACTCAAAACTAACTTTGGTACTGACAAAGTGCGGAAGTCAGATTTT |
| | GGCAAATGTATCTCTAATTATAGTCAACGGAAAGTTCAAGATCCTTAATAACAA |
| | AACAGACCCATCCCTACCTAAATCATTTAACATCAAACTACTGTTTGATCAAAAT |
| | GGAGTTCTATTGGAAAATTCAAACATTGAAAAACAGTACCTAAACTTTTAGAAGT |
| | GGAGACTCTATTCTTCCAGAGCCATATAAAAATGCAATTGGATTTATGCCTAATT |
| | TACTAGCTTATGCTAAAGCTACAACTGATCAGTCTAAAATTTATGCAAGGAACA |
| | CTATATATGGAAATATCTACTTAGATAATCAGCCATATAATCCAGTTGTAATTAA |
| | AATTACTTTTAATAATGAAGCAGATAGTGCTTATTCTATCACTTTTAACTATTCAT |
| | GGACCAAGGACTATGACAATATCCCTTTTGATTCTACTTCATTTACCTTCTCCTAT |
| | ATCGCCCAAGAATGAAAGACCAATAAACATGTTCTCATTTGAAAATTTTCATGTA |
| | TCTTTATTGATTTTTACACCAGCACGGGTAGTCAGTCTCCCACCACCAGCCCATT |
| | TCACAGTGTAAACAATTCTCTCAGCACGGGTGGCCTTAAATAGGGGAATGTTCT |
| | GATTAGCACGAGAACTGGATTTAGTGTCTATAAGCCACACAGTTTCCTGGCGAG |
| | CCAAACGGGGGTCGGTGATTGAGATGAAGCCGTCCTCTGAAAAGTCATCCAAGC |
| | GGGCCTCGCAGTCCAAGGTCACAGTCTGGTGGAACGAGAAGAACGCACAGATTC |
| | ATACTCGGAAAACAGGATGGGTCTGTGCCTTTCCATCAGCGCCCTCAACAGTCTC |
| | TGCCGCCGGGGCTCGGTGCGGCTGCTGCAGATGGGATCGGGATCACAAGTCTCT |
| | CTGACTATGATCCCCACAGCCTTCAGCATCAGTCTCCTGGTGCGTCGGGCACAGC |
| | ACCGCATCCTGATCTCTGCCATGTTCTCACAGTAAGTGCAGCACATAATCACCAT |
| | GTTATTCAGCAGCCCATAATTCAGGGTGCTCCAGCCAAAGCTCATGTTGGGGAT |
| | GATGGAACCCACGTGACCATCGTACCAGATGCGGCAATATATCAGGTGCCTGCC |
| | CCTCATGAACACACTGCCCATATACATGATCTC |
| SEQ ID NO: 1442 | CATCATCAATAATATACCCCACAAAGTAAACAAAAGTTAATATGCAAATGAGCT |
| | TTTGAATTTGGGGCGGGGCCGCCGCTGATTGGCTGTTGGGAGAGCCGTTACTGA |
| | CGTCACGACGCACGGCGTCAACGGTCGGCGCGGAGGCGTGGCCTAGCCCGGAA |
| | GCAAGTCGCAGCCCTGATGACGTATAAAAAAGCGGACTTTAGACCCGGAAATGG |
| | CCGATTTTCCCGCGGCTACGCCCGGATATGAGGTAATTCTGGGCGGATGCAAGT |
| | GAAATTAGGTCATTTTGGCGCGAAAACTGAATGAGGAAGTGAAAAGTGAAAAA |
| | TACCGGGCCCGCCCAGGGCGGAATATTTACCGAGGGCCGAGAGACTTTGACCGA |
| | TTACGTGGGGGTTTCGATTGCGGTGTTTTTTTCGCGAATTTCCGCGTCCGTGTCAA |
| | AGTCCGGTGTTTATGTCACAGATCAGCTGATCCACAGGGTATTTAAACCAGTCGA |
| | GCCCGTCAAGAGGCCACTCTTGAGTGCCAGCGAGTAGAGATTTCTGAGCTCC |
| | GCTCCCAGAGTCTGAGAAAAATGAGACACCTGCGCCTTCTACCTTCAACTGTGCC |
| | CGGCGACCTGGCTGTGATAATGCTGGAGGACTTTGTGAATACAGTTCTGGAGGA |
| | CGAACTGCATCCAAGTCCGTTCGAGCTGGGACCCACACTTCAGGACCTCTATGAT |
| | CTGGAGGTAGATGCCCATGATGACGACCCTAACGAAGAGGCTGTGAATTTAATA |
| | TTTCCAGAATCTATGATTCTCCAGGCTGACATAGCCAGCGAAGCTATAGTTACTC |

TABLE 7-continued

Nucleic Acid Sequences of Vectors

SEQ ID NO Sequence

CACTTCATACCCCGACTCTGCCACCAATACCTGAATTGGAAGAGGAGGACGAGC
TAGACCTTCGGTGTTATGAGGAAGGTTTTCCTCCCAGCGATTCAGAGGACGAAC
AGGGTGAGCAGAGCATGGCTCTAATCTCAGACTATGCTTGTGTGGTTGTGGAAG
AGCATTTTGTGTTGGACAATCCTGAGGTGCCCGGGCAAGGCTGTAGATCCTGCC
AATATCACCGGGATAAGACTGGAGATCCTAGTGCCTCCTGCGCTCTGTGTTACAT
GAAAAAGAACTTCAGCTTTATTTACAGTAAGTGGAGTGAATGTGAGAGAGGCTG
AGTGCTTAACACATAACTGTAATGCTTGAACAGCTGTGCTAAGTGTGGTTTATTT
TTGTTACTAGGTCCGGTGTCAGAGGATGAGTCATCACCCTCAGAAGAAGACCAC
CCGTCTCCCCCTGAGCTGTCAGGCGAAACGCCCCTGCAAGTGTTCAGACCCACCC
CAGTCAGAGCCAGTGGAGAGAGGCGAGCAGCTGTTGAAAAAATTGAGGACTTG
TTACATGACATGGGTGGGGATGAACCTTTGGACCTGAGCTTGAAACGCCCCAGG
AACTAGGCGCAGATGCGCTTAGTCATCTGTAAATAAAGTTGTACAATAAAAGTA
TATGTGACGCATGCAAGGTGTGGTTTATGACTCATGGGCGGGGCTTAGTCCTATA
TAAGTGGCAACACCTGGGCACTTAGGCACAGACCTTCAGGGAGCTCCTGATGGA
GGTGTGGACTATCCTTGCGGACTTTAACAAGACACGCCGGCTTGTAGAGGATAG
TTCAGACGGGTGCTCCGGTTTCTGGAGGCACTGGTTTGGATCTCCTCTATCTCGC
CTGGTGTACACTGTTAAGAAGGATTATCAGGAGGAATTTGAAAATCTTTTTGCCG
ATTGCTCTGGCCTGCTTGATTCACTGAATCTCGGCCACCAGGCTCTTTTCCAGGA
AAGGGTACTCCACAGCCTTGATTTTTCCAGCCCAGGCCGCACTACAGCCGGTGTT
GCATTTGTGGTGTTTCTGGTTGACAAATGGAGCCAGCAAACCCACCTAACCAGG
GATTACATCCTGGACTTCACGGCCATGCACCTGTGGAAGGCCTGGGTCAGGCAG
CGGGGACAGAGAATCTTGAACTACTGGCTTCTACAGCCAGCAGCTCCGGGTCTT
CTTCGTCTACACAGACAAACATCCATGTTGGAGGAAGAGATGAGGGAGGCCATG
GACGAGAACCCGAGGAGCGGCCTGGACCCTCCGTCGGAAGAGGAGCTGGATTG
AATCAGGTATCCAGCCTGTATCCAGAGCTTAGCAAGGTGCTGACAACCATGCC
AGGGGAGTGAAGAGGGAGAGGAGCGATGGGGGCAATACCGGGATGATGACCGA
GCTGACAGCCAGCCTGATGAATCGCAGGCGACCTGAGCGCATTACCTGGCACGA
GCTACAGCAGGAGTGCAGGGATGAGATAGGCCTGATGCAGGATAAATATGGCCT
GGAGCAGATAAAAACCCACTGGTTGAACCCAGATGAGGATTGGGAGGAGGCCA
TTAAGAAATATGCCAAGATAGCCCTGCGCCCAGATTGCAAGTACAGGGTGACCA
AGACGGTGAATATCAGACATGCCTGCTACATCTCAGGGAACGGGGCAGAGGTGA
TCATTGATACCCTGGATAAGGCTGCCTTCAGGTGTTGCATGATGGGAATGAGAG
CCGGTGTGATGAATATGAATTCCATGATCTTCATGAACATCAAGTTCAATGGAG
AGAAGTTTAATGGGGTGCTGTTCATGGCCAACAGCCATATGACCCTGCATGGCT
GTAATTTCTTTGGCTTTAACAACATGTGTGCAGAAGTCTGGGGTGCTTCCAAGAT
CAGGGGATGTAAGTTTTTTGGCTGCTGGATGGGAGTGGTCGGAAGGCCCAAGAG
CGAGATGTCTGTGAAGCAGTGTGTGTTTGAGAAGTGCTACCTGGCCGTGTCTACC
GAGGGCAATGCTAGAGTGAGACATTGCTCTTCCATGGAGACGGGTTGCTTCTGC
CTGGTGAAGGGTACAGCCTCGATCAAGCATAATGTGATCAAGGGGTGTACTGAT
GAGCGCATGTATAACATGCTGACCTGCGACTCGGGGGTCTGCCATATCCTGAAG
AACATCCATGTGACCTCCCACCCCAGGAAGAGGTGGCCATCATTTGAAAATAAT
GTCCTGATCAAGTGCCACGTGCACCTGGGAGCCAGAAGGGGCACCTTCCAGCCG
TACCAGTGCAACTTTAGCCAGACCAAGCTGCTGCTGGAGAACGATGCCTTCTCC
AGGGTGAACCTGAACGGCATCTTTGACATGGATGTCTCGGTGTACAAGATCCTG
AGATACGATGAGACCAGGTCCAGGGTGCGCGCTTGCGAGTGCGGGGCAGGCA
CACCAGGATGCAGCCTGTGGCCCTGGATGTGACAGAGGAGCTGAGACCAGACCA
CCTGGTGATGGCCTGTACCGGAACCGAGTTCAGCTCCAGCGGGGAGGACACAGA
TTAGAGGTAGGTTGAGTGAGTAGTGGGCGTGGCTAAGGTGACTATAAAGGTGGG
TGTCTTACGAGGGTCTTTTTGCTTTTCTGCAGACATCATGAACGGGACCGGCGGG
GCCTTCGAAGGGGGGCTTTTTAGCCCTTATTTGACAACCCGCCTGCCGGGATGGG
CCGGAGTTCGTCAGAATGTGATGGGATCGACGGTGGACGGGCGCCCAGTGCTTC
CAGCAAATTCCTCGACCATGACCTACGCGACCGTGGGGACGAGCTCGTCGCTCG
ACAGCACCGCCGCAGCCGCGGCAGCAGCAGCCGCCATGACAGCGACGAGACTG
GCCTCGAGCTACATGCCCAGCAGCGGTAGCAGCCCCTCCGTCCCCAGTTCCATCA
TCGCCGAGGAGAAACTGCTGGCCCTGCTGGCTGAGCTGGAAGCCCTGAGCCGCC
AGCTGGCCGCCCTGACCCAGCAGGTGTCCGATCTCCGCGAGCAACAGCAGCAAA
ATAAATGATTCAATAAACACAGATTCTGATTCAAACAGCAAAGCATCTTTATTAT
TTATTTTTTCGCGCGCGGTAGGCCCTGGTCCACCTCTCCCGATCATTGAGAGTGC
GGTGGATTTTTTCCAGGACCCGGTAGAGGTGGGATTGGATGTTGAGGTACATGG
GCATGAGCCCGTCCCGGGGATGGAGGTAGCACCACTGCATGGCCTCGTGCTCTG
GGGTCGTGTTGTAGATGATCCAGTCATAGCAGGGGCGCTGGGCGTGGTGCTGGA
TGATGTCCTTGAGGAGGAGACTGATGGCCACGGGAGCCCCTTGGTGTAGGTGT
TGGCAAAGCGGTTGAGCTGGGAGGGATGCATGCGGGGGGAGATGATGTGCAGT
TTGGCCTGGATCTTGAGGTTGGCGATGTTGCCGCCCAGATCCCGCCGGGGGTTCA
TGTTGTGCAGGACCACCAGGACGGTGTAGCCCGTGCACTTGGGGAACTTGTCAT
GCAACTTGGAAGGGAATGCGTGGAAGAATTTGGAGACGCCCTTGTCCCGCCCA
GGTTTTCCATGCACTCATCCATGATGATGGCAATGGGCCCGTGGGCTGCGGCTTT
GGCAAAGACGTTCCTGGGATCAGAGACATCATAATTATGCTCCTGGGTGAGATC
ATCATAAGACATTTTAATGAATTTGGGCGGAGGGTGCCAGACTGGGGACGAT
GGTTCCCTCGGGCCCCGGGGCGAAGTTCCCCTCGCAGATCTGCATCTCCCAGGCT
TTCATCTCGGAGGGGGGATCATGTCCACCTGCGGGGCGATGAAAAAGACGTT
TCCGGGCGGGGTGATGAGCTGCGAGGAGAGCAGGTTTCTCAACAGCTGGGAC
TTGCCGCACCCGGTCGGGCCGTAGATGACCCCGATGACGGGTTGCAGGTGGTAG
TTCAAGGAGATGCAGCTGCCGTCGTCCCGAGGAGGGGGGCCACCTCGTTAAGC
ATGTCCCTGACTTGGAGGTTTTCCCGGACGAGCTCGCCGAGAAGGCGGTCCCCG
CCCAGCGAGAGGAGCTCTTGCAGGGAAGCAAAGTTTTTCAGGGGCTTGAGCCCG

TABLE 7-continued

Nucleic Acid Sequences of Vectors

SEQ ID NO Sequence

```
TCGGCCATGGGCATCTTGGCGAGGGTCTGCGAGAGGAGTTCCAACCGGTCCCAG
AGCTCGGTGACGTGCTCTACGGCATCTCGATCCAGCAGACTTCCTCGTTTCGGGG
GTTGGGACGACTGCGACTGTAGGGCACGAGACGATGGGCGTCCAGCGCGGCCA
GCGTCATGTCCTTCCAGGGTCTCAGGGTCCGAGTGAGGGTGGTCTCCGTCACGGT
GAAGGGGTGGGCCCCGGGCTGGGCGCTTGCAAGGGTGCGCTTGAGACTCATCCT
GCTGGTGCTGAAACGGGCACGGTCTTCGCCCTGCGCGTCGGCGAGATAGCAGTT
GACCATGAGCTCGTAGTTGAGGGCCTCGGCGGCGTGGCCCTTGGCGCGGAGCTT
GCCCTTGGAAGAGCGCCCGCAGGCGGGACAGAGGAGGGATTGCAGGGCGTAGA
GCTTGGGCGCGAGAAAGACGGACTCGGGGGCGAAGGCGTCCGATCCGCAGTGG
GCGCAGACAGTCTCGCACTCGACGAGCCAGGTGAGCTCGGGCTGCTCGGGGTCA
AAAACCAGTTTTCCCCCGTTCTTTTTGATGCGCTTCTTACCTCGCGTCTCCATGAG
TCTGTGTCCGCGCTCGGTGACAAACAGGCTGTCGGTGTCCCCGTAGACGGACTTG
ATGGGCCTGTCCTGCAGGGGCGTCCCGCGGTCCTCCTCGTAGAGAAACTCGGAC
CACTCTGAGACGAAGGCGCGCGTCCACGCCAAGACAAAGGAGGCCACGTGCGA
GGGGTAGCGGTCGTTGTCCACCAGGGGGTCCACTTTTTCCACCGTGTGCAAGCAC
ATGTCCCCCTCCTCCGCATCCAAGAAGGTGATTGGCTTGTAGGTGTAGGTCACGT
GACCGGGGGTCCCCGACGGGGGGGTATAAAAGGGGGCGGGTCTGTGCTCGTCCT
CACTCTCTTCCGCGTCGCTGTCCACGAGCGCCAGCTGTTGGGGTAAGTATTCCCT
CTCGAGAGCGGGCATGACCTCGGCACTCAGGTTGTCAGTTTCTAGAAACGAGGA
GGATTTGATGTTAGCCTGCCCCGCCGCGATGCTTTTGAGGAGACTTTCATCCATC
TGGTCAGAAAAGACTATTTTTTTATTGTCAAGCTTGGTGGCGAAGGAGCCATAG
AGGGCGTTGGAGAGGAGCTTGGCGATGGATCTCATGGTCTGATTTTTGTCACGGT
CGGCGCGCTCCTTGGCCGCGATGTTGAGCTGGACATACTCGCGCGCGACGCACT
TCCATTCGGGGAAGACGGTGGTGCGCTCGTCGGGCACGATCCTGACGCGCCAGC
CGCGGTTATGCAAGGTGACCAGGTCCACGCTGGTGGCCACCTCGCCGCGCAGGG
GCTCATTCGTCCAGCAGAGGCGCCCGCCCTTGCGCGAGCAGAAAGGGGGCAACA
CATCAAGCAGGTGCTCGTCAGGGGGGTCCGCATCGATGGTGAAGATGCCCGGAC
AGAGTTCCTTGTCAAAATAATCGATTTTTGAGGATGCATCATCCAAGGCCATCTG
CCCACTCGCGGGCGGCCAGCGCTCGCTCGTAGGGGTTGAGGGGCGGACCCCAGGG
CATGGGATGCGTGAGCGCGGAGGCGTACATGCCGCAGATGTCATAGACATAGAT
GGGCTCCGAGAGGATGCCGATGTAGGTGGGATAACAGCGCCCCCCGCGGATGCT
GGCGCGCACGTAGTCATACAACTCGTGCGAGGGTGCCAAGAAGGCGGGGCCGA
GATTGGTGCGCTGGGGCTGCTCGGCGCGGAAGACGATCTGGCGAAAGATGGCAT
GCGAGTTGGAGGAGATGGTGGGCCGTTGGAAGATGTTAAAGTGGGCGTGGGGC
AAGCGGACCGAGTCGCGGATGAAGTGCGCGTAGGAGTCTTGCAGCTTGGCGACG
AGCTCGGCGGTGACGAGGACATCCATGGCGCAGTAGTCGAGCGTTTCGCGGATG
ATGTCATAACCCGGCTCTCCTTTCTTCTCCCACAGCTCGCGGTTGAGGGCGTACT
CCTCGTCATCCTTCCAGTACTCCCGGAGCGGGAATCCTCGATCGTCCGCACGGTA
AGAGCCCAGCATGTAGAATTGGTTCACGGCCTTGTAGGGACAACAGCCCTTCTC
CACCGGGAGGGCGTAAGCTTGAGCGGCCTTGCGGAGCGAGGTGTGCGTCAGGGC
GAAGGTGTCCCTGACCATGACTTTCAAGAACTGGTACTTGAAGTCCGAGTCGTC
GCAGCCGCCGTACTCCCAGAGCTCGAAATCGGTGCGCTTCTTCGAGAGGGGGTT
AGGCAGAGCGAAAGTGACGTCATTGAAGAGAATCTTGCCTGCTCGCGGCATGAA
ATTGCGGGTGATGCGGAAGGGGCCAGGCACGGAGGCTCGGTTGTTGATGACCTG
GGCGGCGAGGACGATCTCGTCGAAGCCATTGATGTTGTGCCCGACGATGTAGAG
TTCCATGAACCGCGGCGGCCTTTGATGTGCGGCAGCTTTTTGAGCTCCTCGTAG
GTGAGGTCCTCGGGGCATTGCAGACCGTGCTGCTCGAGCGCCCACTCCTGGAGA
TGTGGGTTGGCTTGCATGAAGGAAGCCCAGAGCTCGCGGGCATGTGGGTCTGG
AGCTCGTCGCGAAAGAGGCGGAACTGCTGGCCCACGGCCATCTTTTCGGGGGTG
ACGCAGTAGAATGTGAGAGGGTCCCGCTCCCAGCGATCCCAGCGTAAGCGCACG
GCGAGATCGCGAGCGAGGGCGACCAGCTCGGGGTCCCCTGAGAATTTCATGACC
AGCATGAAGGGGACGAGCTGCTTGCCGAAGGACCCCATCCAGGTGTAGGTTTCT
ACATCGTAGGTGACAAAGAGCCGCTCCGTGCGAGGATGAGAGCCGATTGGGAA
GAACTGGATTTCCTGCCACCAGTTGGACGAGTGGCTGTTGATGTGATGAAAGTA
GAAATCCCTCCGGCGAACCGAGCACTCGTGCTGATGCTTGTAAAAGCGTCCGCA
GTACTCGCAGCGCTGCACGGGCTGTACCTCATCCACGAGATACACAGCGCGTCC
CTTGAGGAGGAACTTCAGGAGTGGCGGCCCTGGCTGGTGGTTTTCATGTTCGCCT
GCGTGGGACTCACCCTGGGGCTCCTCGAGGACGGAGAGGCTGACGAGCCCGCGC
GGGAGCCAGGTCCAGATATCGGCGCGGCGGGGGCGGAGAGCGAAGACGAGGGC
GCGCAGTTGGGAGCTGTCCATGGTGTCGCGGAGATCCAGGTCCGGGGCAGGGT
TCTGAGGTTGACCTCGTAGAGGCGGGTGAGGGCGTGCTTGAGATGCAGATGGTA
CTTGATTTCTACGGGTGAGTTGGTAGCCGTGTCCACGCATTGCATGAGCCCGTAG
CTGCGCGGGGCCACGACCGTGCCGCGCTTTAGAAGCGGTGTCGCGGACGCGCTC
CCGGCGGGCAGCGGCGGTTCCGGCCCCGCGGGCAGGGGCGGCAGAGGCACGTCG
GCGTGGCGCTCGGGCAGGTCCGGTGCTGCGCCCTGAGAGCGCTGGCGTGCGCG
ACGACGCGGCGGTTGACATCCTGGATCTGCCGCCTCTGCGTGAAGACCACGGGC
CCCGTGACTTTGAACCTGAAAGACAGTTCAACAGAATCAATCTCGGCGTCATTG
ACGGCGGCCTGACGCAGGATCTCTTGCACGTCGCCCGAGTTGTCCTGGTAGGCG
ATCTCGGACATGAACTGCTCGATCTCCTCCTCCTGGAGATCGCCGCGGCCCGCGC
GCTCGACGGTGGCGGCGAGGTCATTCGAGATGCGACCCATGAGCTGCGAGAAGG
CGCCCAGGCCGCTCTCGTTCCAGACGCGGCTGTAGACCACCTCCCCGTCGGCGTC
GCGCGCGCGCATGACCACCTGCGCGAGGTTGAGCTCCACGTGCCGCGTGAAGAC
GGCGTAGTTGCGCAGGCGTTGGAAGAGGTAGTTGAGGGTGGTGGCGATGTGCTC
GGTGACGAAGAAGTACATGATCCAGCGGCGCAGGGGCATCTCGCTGATGTCGCC
GATGGCCTCCAGCCTTTCCATGGCTTCGTAGAAATCCACGGCGAAGTTGAAAAA
CTGGGCGTTGCGGGCCGAGACCGTGAGCTCGTCTTCCAGGAGCCTGATGAGCTC
```

TABLE 7-continued

Nucleic Acid Sequences of Vectors

SEQ ID NO Sequence

GGCGATGGTGGCGCGCACCTCGCGCTCGAAATCCCCAGGGGCCTCCTCCTCTTCC
TCTTCTTCTTCCATGACGACCTCTTCTATTTCTTCCTCTGGGGGCGGTGGTGGTGG
CGGGGCCCGACGACGACGGCGACGCACCGGGAGACGGTCGACGAAGCGCTCGA
TCATCTCCCCGCGGCGGCGACGCATGGTTTCGGTGACGGCGCGACCCCGTTCTCG
AGGACGCAGCGTGAAGACGCCGCCGGTCATCTCCCGGTAATGGGGCGGGTCCCC
GTTGGGCAGCGAGAGGGCGCTGACTATGCATCTTATCAATTGCGGTGTAGGGGA
CGTGAGCGCGTCGAGATCGACCGGATCGGAGAATCTTTCGAGGAAAGCGTCTAG
CCAATCGCAGTCGCAAGGTAAGCTCAGACACGTAGCAGCCCTGTGGACGCTGTT
AGAATTGCGGTTGCTGATGATGTAATTGAAGTAGGCGTTTTTGAGGCGGCGGAT
GGTGGCGAGGAGGACCAGGTCCTTGGGTCCCGCTTGCTGGATGCGGAGCCGCTC
GGCCATGCCCCAGGCCTGGCCCTGACACCGGCTCAGGTTCTTGTAGTAGTCATGC
ATGAGCCTCTCGATGTCATCACTGGCGGAGGCGGAGTCTTCCATGCGGGTGACC
CCGACGCCCCTGAGCGGCTGCACGAGCGCCAGGTCGGCGACGACGCGCTCGGCG
AGGATGGCCTGTTGCACGCGGGTGAGGGTGTCCTGGAAGTCGTCCATGTCGACG
AAGCGGTGGTAGGCCCCGGTGTTGATGGTGTAGGTGCAGTTGGCCATGAGCGAC
CAGTTGACGGTCTGCAGGCCGGGCTGCACGACCTCGGAGTACCTGAGCCGCGAG
AAGGCGCGCGAGTCGAAGACGTAGTCGTTGCAGGTGCGCACGAGGTACTGGTAG
CCCACGAGGAAGTGCGGCGGCGGCTGGCGGTAGAGGGGCCAGCGCTGGGTGGC
CGGCGCGCCCGGGGCCAGGTCCTCGAGCATGAGGCGGTGGTAGCCGTAGAGGTA
GCGGGACATCCAGGTGATGCCGGCGGCGGTGGTGGAGGCGCGCGGGAACTCGC
GGACGCGGTTCCAGATGTTGCGCAGCGGCAGGAAATAGTCCATGGTCGGCACGG
TCTGGCCGGTGAGACGCGCGCAGTCATTGACGCTCTAGAGGCAAAAACGAAAGC
GGTTGAGCGGGCTCTTCCTCCGTAGCCTGGCGGAACGCAAACGGGTTAGGCCGC
GCGTGTACCCCGGTTCGAGTCCCTGCTCGAATCAGGCTGGAGCCGCGACTAACG
TGGTATTGGCACTCCCGTCTCGACCCGAGCCCGATAGCCGCCAGGATACGGCGG
AGAGCCCTTTTTGCAGGCCGCGCGGGGTCGCTAGACTTGAAAGCGGCCGAAAAT
CCCGCCGGGTAGTGGCTCGCGCCCGTAGTCTGGAGAAGCATCGCCAGGGTTGAG
TCGCGGCAGAACCCGGTTCGCGGACGGCCGCGGCGAGCGGGACTTGGTCACCCC
GCCGATTTAAAGACCCACAGCCAGCCGACTTCTCCAGTTACGGGAGCGAGCCCC
CTTTTTTCTTTTTGCCAGATGCATCCCGTCCTGCGCCAAATGCGTCCCACCCCCC
GGCGACCACCGCGACCGCGGCCGTAGCAGGCGCCGGCGCTAGCCAGCCACAGA
CAGAGATGGACTTGGAAGAGGGCGAAGGGCTGGCGAGACTGGGGCGCCGTCC
CCGGAGCGACACCCCGCGTGCAGCTGCAGAAGGACGTGCGCCCGGCGTACGTG
CCCGCGCAGAACCTGTTCAGGGACCGCAGCGGGGAGGAGCCCGAGGGAGATGCG
CGACTGCCGGTTTCGGGCGGGCAGGGAACTGCGCGAGGGTCTGGACCGCCAGCG
CGTGCTGCGCGACGAGGATTTCGAGCCGAACGAGCAGACGGGGATCAGCCCCGC
GCGCGCGCACGTGGCGGCGGCCAACCTGGTGACGGCCTACGAGCAGACGGTGA
AGCAGGAGCGCAACTTCCAAAAGAGTTTCAACAACCACGTGCGCACCCTGATCG
CGCGCGAGGAGGTGGCCCTGGGCCTGATGCACCTGTGGGACCTGGCGGAGGCCA
TCGTGCAGAACCCGGACAGCAAGCCTCTGACGGCGCAGCTGTTCCTGGTGGTGC
AGCACAGCAGGGACAACGAGGCGTTCAGGGAGGCGCTGCTGAACATCGCCGAG
CCCGAGGGTCGCTGGCTGCTGGAGCTGATTAACATCTTGCAGGAGCATCGTAGTG
CAGGAGCGCAGCCTGAGCCTGGCCGAGAAGGTGGCGGCGATCAACTACTCGGTG
CTGAGCCTGGGCAAGTTTTACGCGCGCAAGATTTACAAGACGCCGTACGTGCCC
ATAGACAAGGAGGTGAAGATAGACAGCTTTTACATGCGCATGGCGCTCAAGGTG
CTGACGCTGAGCGACGACCTGGGCGTGTACCGCAACGACCGCATCCACAAGGCC
GTGAGCACGAGCCGGCGGCGCGAGCTGAGCGACCGCGAGCTGATGCTGAGTCTG
CGCCGGGCGCTGGTAGGGGCGCCACCGGCGGTGAGGAGTCCTACTTCGACATG
GGGGCGGACCTGCATTGGCAGCCGAGCCGGCGCGCCTTGGAGGCCGCCTACGGT
CCAGAGGACTTGGATGAGGATGAGGAAGAGGAGGAGGATGCACCCGTTGCGGG
GTACTGACGCCTCCGTGATGTGTTTTAGATGCAGCAAGCCCCGGACCCCGCCAT
AAGGGCGGCGCTGCAAAGCCAGCCGTCCGGTCTAGCATCGGACGACTGGGAGG
CCGCGATGCAACGCATCATGGGCCTGACGACCCGCAACCCCGAGTCCTTTAGAC
AACAGCCGCAGGCCAACAGACTCTCGGCCATTCTGGAGGCGGTGGTCCCCTCTC
GGACCAACCCCACGCACGAGAAGGTGCTGGCGATCGTGAACGCGCTGGCGGAG
AACAAGGCCATCCGTCCCGACGAGGCCGGGCTGGTGTACAACGCCCTGCTGGAG
CGCGTGGGCCGCTACAACAGCACGAACGTGCAGTCCAACCTGGACCGGCTGGTG
ACGGACGTGCGCGAGGCCGTGGCGCAGCGCGAGCGGTTCAAGAACGAGGGCCT
GGGCTCGCTGGTGGCGCTGAACGCCTTCCTGGCGACGCAGCCGGCGAACGTGCC
GCGCGGGCAGGACGATTACACCAACTTTATCAGCGCGCTGCGGCTGATGGTGAC
CGAGGTGCCCCAGAGCGAGGTGTACCAGTCGGGCCCGGACTACTTTTTCCAGAC
GAGCCGGCAGGGCCTGCAGACGGTGAACCTGAGCCAGGCTTTCAAGAATCTGCG
CGGGCTGTGGGGCGTGCAGGCGCCCGTGGGCGATCGGTCGACGGTGAGCAGCTT
GCTGACGCCCAACTCGCGGCTGCTGCTGCTGATCGCGCCCTTCACCGACAGC
GGCAGCGTGAACCGCAACTCGTACCTGGGCCACCTGCTGACGCTCTATAGGGAG
GCCATAGGCCAGGCGCAGGTGGACGAGCAGACCTTCCAGGAGATCACGAGCGT
GAGCCGCGCGCTGGGGCAGAACGACACCGACAGTCTGAGGGCCACCCTGAACTT
TTTGCTGACCAATAGACAGCAGAAGATCCCGCCGCAGTATGCGCTGTCGGCCGA
GGAGGAAAGAATCCTGAGATATGTGCAGCAGAGCGTAGGGCTGTTCCTGATGCA
GGAGGGGGCCACCCCCAGCGCCGCGCTGGACATGACCGCGCGCAACATGGAAC
CTAGCATGTACGCCGCCAACCGGCCGTTCATCAATAAGCTGATGACTACCTGC
ACCGCGCGGCGGCCATGAACTCGGACTACTTTACTAATGCTATACTAAACCCGC
ACTGGCTCCCGCCGCCGGGGTTCTACACGGGCGAGTACGACATGCCCGACCCCA
ACGACGGGTTCCTGTGGGACGACGTGGACAGCGCGGTGTTCTCGCCGACCTTTC
AAAAGCGCCAGGAGGCGCCGCCGAGCGAGGGCGCGGTGGGGAGAAGCCCCTTT
CCTAGCTTAGGGAGTTTGCATAGCTTGCCGGGCTCGGTGAACAGCGGCAGGGTG

TABLE 7-continued

Nucleic Acid Sequences of Vectors

SEQ ID NO Sequence

```
AGCCGGCCGCGCTTGCTGGGCGAGGACGAGTACCTGAACGACTCGCTGCTGCAG
CCGCCACGGGCCAAGAACGCCATGGCCAATAACGGGATAGAGAGTCTGGTGGA
CAAACTGAACCGCTGGAAGACCTACGCTCAGGACCATAGGGACGCGCCCGCGCC
GCGGCGACAGCGCCACGACCGGCAGCGGGGCCTGGTGTGGGACGACGAGGACT
CGGCCGACGATAGCAGCGTGTTGGACTTGGGCGGGAGCGGTGGGGCCAACCCGT
TCGCGCATCTGCAGCCCAGACTGGGGCGACGGATGTTTTAATGCAAATAAAAC
TCACCAAGGCCATAGCGTGCGTTCTCTTCCTTGTTAGAGATGAGGCGTGCGGTGG
TGTCTTCCTCTCCTCCTCCCTCGTACGAGAGCGTGATGGCGCAGGCGACCCTGGA
GGTTCCGTTTGTGCCTCCGCGGTATATGGCTCCTACGGAGGGCAGAAACAGCATT
CGTTACTCGGAGCTGGCTCCGCTGTACGACACCACTCGCGTGTACTTGGTGGACA
ACAAGTCGGCGGACATCGCTTCCCTGAACTACCAAAACGACCACAGCAACTTCC
TGACCACGGTGGTGCAGAACAACGATTTCACCCCCGCCGAGGCCAGCACGCAGA
CGATAAATTTTGACGAGCGGTCGCGGTGGGGCGGTGATCTGAAGACCATTCTGC
ACACCAACATGCCCAATGTGAACGAGTACATGTTCACCAGCAAGTTTAAGGCGC
GGGTGATGGTGGCTAGAAAAAGGCGGAAGGGGCTGATGCAGATGATAGAAGC
AAGGATATCTTAGAGTATGAGTGGTTTGAGTTTACCCTGCCCGAGGGCAACTTTT
CCGAGACCATGACCATAGACCTGATGAACAACGCCATCTTGGAAAACTACTTGC
AAGTGGGGCGGCAAAATGGCGTGCTGGAGAGCGATATAGGAGTCAAGTTTGAC
AGCAGGAATTTCAAGCTGGGCTGGGATCCGGTGACCAAGCTGGTGATGCCAGGG
GTCTACACCTACGAGGCCTTCCACCCGGACGTGGTGCTGCTGCCGGGCTGCGGG
GTGGACTTCACCGAGAGCCGCCTGAGCAACCTCCTGGGCATTCGCAAGAAGCAA
CCTTTCCAAGAGGGCTTCAGAATCATGTATGAGGATCTAGAAGGGGGCAACATC
CCCGCCCTCCTGGATGTCAAGCAATATTTGGATAGCAAAAAGAAGCTTGAGGAA
GCTACCCAGAATGCAACCAGGGCCGCTGGAGATATCAGAGGAGACACCTATGTT
CCAAGAGCTGTGGAACAAGCAGCTGAAAAGGATCTGGTCATTGTACCAGTAACA
CAAGATGAAAGCAAGAGAAGCTATAATGTCATAGATGGCACCCATGACACCCTG
TACCGAAGTTGGTACCTGTCCTATACCTACGGGGACCCCGAGAAGGGGTGCAG
TCGTGGACGCTGCTCACCACCCCGGACGTCACCTGCGGCGCGGAGCAAGTCTAC
TGGTCGCTGCCGGACCTCATGCAAGACCCCGTCACCTTCCGCTCCACCCAGCAAG
TCAGCAACTACCCCGTGGTCGGCGCCGAGTCATGCCCTTCCGCGCCAAGAGCTT
TTACAACGACCTCGCCGTCTACTCCCAGCTCATCCGCAGCTACACCTCCCTCACC
CACGTCTTCAACCGCTTCCCCGACAACCAGATCCTCTGCCGCCCGCCCGCGCCCA
CCATCACCACCGTCAGTGAAAACGTGCCTGCTCTCACAGATCACGGGACGCTAC
CGCTGCGCAGCAGTATCCGCGGAGTCCAGCGAGTGACCGTCACTGACGCCCGTC
GCCGCACCTGTCCCTACGTCTACAAGGCCCTGGGCATAGTCGCGCCGCGCGTGCT
CTCCAGTCGCACCTTCTAAAAAATGTCTATTCTCATCTCGCCCAGCAATAACACC
GGCTGGGGTCTTACTAGGCCCAGCACCATGTACGGAGGAGCCAAGAAGCGCTCC
CAGCAGCACCCCGTCCGCGTCCGCGGCCACTTCCGCGCTCCCTGGGCGCTTACA
AGCGCGGGCGGACTTCCACCGCAGCCGCCGTGCGCACCACCGTCGACGACGTCA
TCGACTCGGTGGTCGCCGACGCGCGCAACTACACCCCCGCCCCTCCACCGTGG
ACGCGGTCATCGACAGCGTGGTGGCCGACGCGCGCGACTATGCCAGACGCAAGA
GCCGGCGGCGACGGATCGCCAGGCGCCACCGGAGCACGCCCGCCATGCGCGCC
GCCCGGGCTCTGCTGCGCCGCGCCAGACGCACGGGCCGCCGGGCCATGATGCGA
GCCGCGCCGCCGCCGCCGCACCCACCCCCGCAGGCAGGACTCGCAGACGA
GCGGCCGCCGCCGCCGCGGCCATCTCTAGCATGACCAGACCCAGGCGCGGA
AACGTGTACTGGGTGCGCGACTCCGTCACGGGCGTGCGCGTGCCCGTGCGCACC
CGTCCTCCTCGTCCCTGATCTAATGCTTGTGTCCTCCCCCGCAAGCGACGATGTC
AAAGCGCAAATCAAGGAGGAGATGCTCCAGGTCGTCGCCCCGGAGATTTACGG
ACCCCCGGACCAGAAACCCCGCAAAATCAAGCGGGTTAAAAAAAAGGATGAGG
TGGACGAGGGGGCAGTAGAGTTTGTGCGCGAGTTCGCTCCGCGGCGGCGCGTAA
ATTGGAAGGGGCGCAGGGTGCAGCGCGTGTTGCGGCCCGGCACGGCGGTGGTGT
TCACGCCCGGCGAGCGGTCCTCGGTCAGGATGAAACGTAGCTATGACGAGGTGT
ACGGCGACGACGACATCCTGGACCAGGCGGCGGAGCGGGCGGGCGAGTTCGCC
TACGGGAAGCGGTCGCGCGAAGAGGAGCTGATCTCGCTGCCGCTGGACGAGAG
CAACCCCACGCCGAGCCTGAAGCCCGTGACCCTGCAGCAGGTGCTGCCCCAGGC
GGTGCTGCTGCCTAGCCGCGGGGTCAAGCGCGAGGGCGAGAGCATGTACCCGAC
CATGCAGATCATGGTGCCCAAGCGTCGGCGCGTGGAGGACGTGCTGGACACCGT
GAAAATGGATGTGGAGCCCGAGGTCAAGGTGCGCCCCATCAAGCAGGTGGCGC
CGGGCCTGGGCGTGCAGACCGTGGACATTCAGATCCCCACCGACATGGATGTCA
ACAAAAAACCCTCGACCAGCATCGAGGTGCAGACCGACCCCTGGCTCCCAGCTA
CTTCTACCGCCACCGCCTCTACATCCACCATGGCTACCGAGCCTCCAGGAGGCG
AAGATGGGGCGCCGCCAGCCGGCTGATGCCCAACTACGTGTTGCATCCTTCCAT
CATCCCGACGCCGGGCTACCGCGGCACCCGGTACTGCGCAGCCGCAGGCGCCC
AGCCGCCAAACGCCGCCGCCGCACCACCACCCGCCGCCGTCTGGCCCCCGCCCG
CGTGCGCCGCGTGACCACGCGCCGGGGCCGCTCGCTCGTTCTGCCCACCGTGCG
CTACCACCCCAGCATCCTTTAATCCGTGTGCTGTGATACTGTTGCAGAGAGATGG
CTCTCACTTGCCGCCTGCGCATCCCCGTCCCGAATTACCGAGGAAGATCCCGCCG
CAGGAGAGGCATGGCAGGCAGCGGCCTGAACCGCCGCCGGCGGCGGGCCATGC
GCAGGCGCCTGAGTGGCGGGTTTCTGCCCGCGCTCATCCCCATAATCGCCGCGG
CCATCGGCACGATCCCGGGCATAGCTTCCGTTGCGCTGCAGGCGTCGCAGCGCC
GTTGATGTGCGAATAAAGCCTCTTTAGACTCTGACACACCTGGTCCTGTATATTT
TTAGAATGGAAGACATCAATTTTGCGTCCCTGGCTCCGCGGCACGGCACGCGGC
CGTTCATGGGCACCTGAACGAGATCGGCACCAGCCAGCTGAACGGGGGCGCCT
TCAATTGGAGCAGTGTCTGGAGCGGGCTTAAAAATTTCGGCTCGACGCTCCGGA
CCTATGGGAACAAGGCCTGGAATAGTAGCACGGGGCAGTTGTTAAGGGAAAAG
CTCAAAGACCAGAACTTCCAGCAGAAGGTGGTGGACGGGCTGGCCTCGGGCATT
```

TABLE 7-continued

Nucleic Acid Sequences of Vectors

SEQ ID NO Sequence

```
AACGGGGTGGTGGACATCGCGAACCAGGCCGTGCAGCGCGAGATAAACAGCCG
CCTGGACCCGCGCCCGCCCACGGTGGTGGAGATGGAAGATGCAAGCCATCCTCC
GCCCAGGGGCGAGAAGCGGCCGCGGCCCGACGCGGAGGAGACTACCCTGCAGG
TGGACGAGCCGCCCTCGTACGAGGAGGCCGTCAAGGCCGGCATGTCCACCACGC
GCATCATCGCGCCACTGGCCACGGGTGTGATGAAACCCGCCACCCTAGACCTGC
CTCCACCACCCGCGCCCGCTCCACCGAAGGCAGCTCCCGCGGTCGTGCAGCCTC
CTCCGGTGGCGACCGCCGTGCGCCGCGTCCCCGCCCGCCGCCAGGCCCAGAACT
GGCAGAGCACGCTGCACAGTATCGTGGGCCTGGGAGTGAAAAGTCTGAAGCGCC
GCCGATGCTTTTAAGAGAGAAAGGACACTAAAGGGAGAGCTTAACTTGTATGTG
CCTTACCGCCAGAGAACGCGCGAAGATGGCCACCCCCTCGATGATGCCGCAGTG
GGCGTACATGCACATCGCGGGCAGGACGCCTCGGAGTACCTGAGCCCGGGTCT
GGTGCAGTTTGCCCGCGCCACCGACACGTACTTCAGCCTGGGCAACAAGTTTAG
GAACCCCACGGTGGCTCCCACCCACGATGTGACCACGGACCGGTCCCAGCGTCT
GACGCTGCGCTTCGTGCCCGTGGATCGCGAGGACACCACGTACTCGTACAAGGC
GCGCTTCACTCTGGCCGTGGGCGACAACCGGGTGCTAGACATGGCCAGCACTTA
CTTTGACATCCGCGGCGTCCTGGACCGCGGTCCCAGCTTCAAACCCTACTCGGGC
ACGGCTTACAACAGCCTGGCCCCCAAGGGCGCCCCCAACTCCAGTCAGTGGGAT
GCTGAAGAGAAAAAAGATACGCAGGGAAATGAGATGGTCACCAAGACACATAC
ATATGGCGTGGCACCAATGGCAGGAACAAATATAACAAAGAAAGGATTGTTGCT
TGGAACAGATGAAACTGCCGAGGCTGGTAAAAAAGATATCTATGCAGATGAAA
CATATCAGCCAGAACCACAGGTAGGAGAAGAAAACTGGCAAGAAAATGAAGCC
TTCTATGGAGGCAGGGCTCTCAAAAAAGAAACAAAAATGAAGCCCTGCTATGGC
TCATTTGCCAGACCTACCAATGAAAAAGGCGGACAAGCTAAATTTAAGCCAGTG
GAAGAGGGGCAGCAACCTAAAGACCTTGACATTACATTGGCTTTCTTTGACACA
CCTGGTGGAACATTGAATGGAAGTGGAACTGAAGAATATAAGGCAGACATTGTG
ATGTACACTGAAAATGTAAATCTGGAAACTCCAGATACCCATGTGGTGTACAAA
CCAGGAACTTCAGATGACAGTTCAGAAATCAATCTAGTTCAGCAGTCCATGCCC
AACAGACCAAACTACATTGGATTCAGAGACAACTTTGTGGGGCTCATGTATTAC
AACAGCACTGGCAATATGGGCGTGCTGGCCGGTCAGGCCTCTCAGTTGAATGCT
GTGGTGGACTTGCAAGACAGAAACACTGAGCTGTCTTACCAGCTCTTGCTAGATT
CTCTGGGTGACAGAACCAGATACTTTAGCATGTGGAACTCTGCGGTGGACAGCT
ATGATCCCGATGTCAGGATCATTGAGAATCACGGTGTGGAAGATGAACTTCCAA
ACTATTGTTTCCCATTGGATGGCTCTGGAACTAATTCTACATACCAGGGTGTGAA
AGTTACAACTAATGAAGGAGCTTTGGAAAGCGAATGGGGTAAAGATGAAAGTG
TTGCGAGACAAAATCAAATTTGCAAGGGCAACATCTATGCCATGGAGATCAACC
TCCAGGCCAACCTGTGGAAGAGTTTTCTGTACTCGAACGTGGCCTTGTACCTGCC
CGACTCCTACAAGTACACGCCGGCCAACGTCAAGCTGCCCGCCAACACCAACAC
CTACGAGTACATGAACGGCCGCGTGGTGGCCCCCTCCCTGGTGGACGCCTACAT
CAACATCGGCGCCCGCTGGTCGCTGGACCCCATGGACAATGTCAACCCCTTCAA
CCACCACCGCAACGCGGGCCTGCGCTACCGCTCCATGCTCCTGGGCAACGGCCG
CTACGTGCCCTTCCACATCCAAGTGCCCCAAAAGTTCTTTGCCATCAAGAACCTG
CTTCTGCTCCCGGGCTCCTACACCTACGAGTGGAACTTCCGCAAGGACGTCAACA
TGATCCTGCAGAGTTCCCTTGGCAACGACCTGCGCGTCGACGGCGCCTCCGTCCG
CTTCGACAGCGTCAACCTCTACGCCACCTTCTTCCCCATGGCGCACAATACCGCC
TCCACCCTGGAAGCCATGCTGCGCAACGACACCAACGACCAGTCCTTCAACGAC
TACCTCTCGGCCGCCAACATGCTCTACCCCATCCCGGCCAAGGCCACCAACGTGC
CCATCTCCATCCCTCGCGCAACTGGGCTGCCTTCCGCGGCTGGAGTTTCACCCG
GCTCAAGACCAAGGAAACTCCCTCCCTCGGCTCGGGTTTCGACCCCTACTTTGTC
TACTCGGGCTCCATCCCCTACCTCGACGGGACCTTCTACCTCAACCACACCTTCA
AGAAGGTCTCCATCATGTTCGACTCCTCGGTCAGCTGGCCCGGCAACGACCGGC
TGCTCACGCCGAACGAGTTCGAGATCAAGCGCAGCGTCGACGGGAGGGCTACA
ACGTGGCCCAATGCAACATGACCAAGGACTGGTTCCTCGTTCAGATGCTCTCCCA
CTACAACATCGGCTACCAGGGCTTCCACGTGCCCGAGGGATACAAGGACCGCAT
GTACTCCTTCTTCCGCAACTTCCAGCCCATGAGCAGGCAGGTGGTTGATGAGATC
AACTACAAGGACTACAAGGCCGTCACCCTGCCCTTCCAGCACAACAACTCGGGC
TTCGTCGGCTACCTCGCACCCACCATGCGCCAGGGGCAGCCCTACCCCGCCAACT
TCCCCTACCCGCTCATCGGCTCCACCGCAGTGCCCTCCGTCACCCAGAAAAAGTT
CCTCTGCGACAGGGTCATGTGGCGCATCCCCTTCTCCAGCAACTTCATGTCCATG
GGCGCCCTCACCGACCTGGGTCAGAACATGCTCTATGCCAACTCGGCCCACGCG
CTCGACATGACTTTCGAGGTGGACCCCATGGATGAGCCCACCCTCCTCTATCTTC
TCTTCGAAGTTTTCGACGTGGTCAGAGTGCACCAGCCGCACCGCGGCGTCATCG
AGGCCGTCTACCTGCGCACGCCCTTCTCCGCCGGAAACGCCACCACATAAGCAT
GAGCGGCTCCAGCGAACGAGAGCTCGCGGCCATCGTGCGCGACCTGGGCTGCGG
GCCCTACTTTTTGGGCACCCACGACAAGCGCTTCCCGGGCTTCCTCGCCGGCGAC
AAGCTGGCCTGCGCCATCGTCAACACGGCCGGCCGCGAGACCGGAGGCGTGCAC
TGGCTCGCCTTCGGCTGGAACCCGCGCTCGCGCACCTGCTACATGTTCGACCCCT
TCGGGTTCTCGGACCGCCGGCTCAAGCAGATTTACAGCTTCGAGTACGAGGCCA
TGCTGCGCCGAAGCGCCCTGGCCTCCTCGCCCGATCGCTGTCTCAGCCTCGAGCA
GTCCACCCAGACCGTGCAGGGGCCCGACTCTGCCGCCTGCGGACTCTTCTGTTGC
ATGTTCTTGCATGCCTTCGTGCACTGGCCCGACCGACCCATGGACGGAAACCCCA
CCATGAACTTGCTGACGGGGGTGCCCAACGGCATGCTACAATCGCCACAGGTGC
TGCCCACCCTCCGGCGCAACCAGGAGGAGCTCTACCGCTTCCTCGCGCGCCACTC
ACCCTACTTTCGCTCCCACCGCGCCGCCATCGAACACGCCACCGCTTTTGATAAA
ATGAAACAACTGCGTGTATCTCAATAAACAGCACTTTTATTTTACATGCACTGGA
GTATATGCAAGTTATTTAAAAGTCGAAGGGGTTCTCGCGCTCGTCGTTGTGCGCC
GCGCTGGGGAGGGCCACGTTGCGGTACTGGTACTTGGGCTGCCACTTGAACTCG
```

TABLE 7-continued

Nucleic Acid Sequences of Vectors

SEQ ID NO Sequence

GGGATCACCAGTTTGGGCACTGGAGTCTCGGGGAAGGTCTCGCTCCACATGCGC
CGGCTCATCTGCAGGGCGCCCAGCATGTCCGGGGCTGAGATCTTGAAATCACAG
TTGGGACCGGTGCTCTGCGCACGCGAGTTGCGGTACACGGGGTTGCAGCACTGG
AACACCATCAGACTGGGATGCTTGACGCTGGCCAGCACGCTCTTGTCGCTGATCT
GATCCTTGTCCAGGTCCTCTGCGTTGCTCAGGCCGAACGGGGTCATCTTGCACAG
CTGGCGGCCCAGGAAGGGCACGCTGTGGGGCTTGTGGTTACACTCGCAGTGCAC
GGGCATCAGCATCATTCCCGCGCCGCGCTGCATATTCGGGTAGAGGGCCTTGAC
GAAGGCCGTGATCTGCTTGAAAGCTTGCTGGGCCTTGGCCCCCTCGCTGAAGAA
CAGACCGCAGCTCTTCCCGCTGAACTGGTTATTCCCGCAGCCGGCATCCTGCACG
CAGCAGCGCGCGTCATGGCTGGTCAGTTGCACCACGCTTCTCCCCCAGCGGTTCT
GGGTCACCTTGGCCTTGCTGGGCTGTTCCTTCAACGCGCGCTGACCGTTCTCGCT
GGTCACATCCATCTCCACCACGTGGTCCTTGTGGATCATCACCGTCCCGTGCAGA
CACTTGAGCTGGCCTTCCACCTCGGTGCAGCCGTGGTCCCACAGGGCGCTGCCG
GTGCATTCCCAGTTCTTGTGCGCGATCCCGCTGTGGCTGAAGATGTAACCTTGCA
ACAGGCGGCCCATCACGGTACTAAAGCTCTTCTGGGTGGTGAAGGTCAGTTGCA
GGGCGCGGGCCTCCTCGTTCAGCCAGGTCTGGCACATCTTCTGGAAGATCTCGGT
CTGCTCGGGCATGAGCTTGTAAGCATCGCGCAGGCCGCTTTCGACGCGGTAGCG
TTCCATCAGCACGTTCATGGCATCCATGCCCTTCTCCCAGGACGAGACCAGAGGC
AGACTCAGGGGGTTGCGCACGTTCAGAATACCGGGGGTCGCGGGCTCGACAATG
CGTTTTCCGTCCTTGCCTTCCTTCAACAGAACCGGCGGCTGGCTGAATCCCACTC
CCACGATCACGGCATCTTCTTCCTGGGGCATCTCTTCGTCGGGGTCTACCTTGGT
CACATGCTTGGTCTTCCTGGCTTGCTTCTTTGGCAGTTTTGGAGGGGTGTCTACG
GGGACCACGTCCTCTTCGGAAGACCCGGAGCCCACCCGCTGGTACTTTCGGCGC
TTGGTGGGCAGAGGAGGTGGCGGCGAGGGGCTCCTCTCCTGCTCCGGCGGATAG
CGCGCCGACCCGTGGCCCCGGGGCGGAGTGGCCTCTCGGTCCATGAACCGGCGC
ACGTCCTGACTGCCGCCGGCCATTGTTTCCTAGGGGAAGATGGAGCAGCCGCGT
AAGCAGGAGCAGGAGGAGGAGAACTTAACCACCCACGAGCAACCCAAAATCGA
GCAGGACCTGGGCTTGGAAGATCGTCTAGAACCCCCACAGGATGAACAGGAGC
ACGAGCAAGACGCAGGCCAGGAGGAGACCGACGCTGGGCTCGAGCATGGCTAC
CTGGGAGGAGGAGATGTGCTGCTGAAACACCTGCAGCGCCAGTCCCTCATCCTC
CGGGACGCCCTGGCCGACCGGAGCGAAACCCCCCTCAGCGTCGAGGAGCTGTGT
CGGGCCTACGAGCTCAACCTCTTCTCGCCGCGCGTGCCCCCAAACGCCAGCCC
AACGGCACCTGCGAGCCCAACCCGCGTCTCAACTTCTACCCCGTCTTCGCGGTCC
CCGAGGCCCTCGCCACCTATCACATCTTTTTCAAGAACCAAAAGATCCCCGTCTC
CTGCCGCGCCAACCGCACCCGCGCCGACGCGCTCCTCGCTCTGGGGCCCGGCGC
GCGCATACCTGATATCGCTTCCCTGGAAGAGGTGCCCAAGATCTTCGAAGGGCT
CGGTCGGGACGAGACGCGCGCGGCGAACGCTCTGAAAGAAACAGCAGAGGAAG
AGGGTCACACTAGCGCCCTGGTAGAGTTGGAAGGCGACAACGCCAGGCTGGCCG
TGCTCAAGCGCAGCGTCGAGCTCACCCATTTCGCCTACCCCGCCGTCAACCTCCC
GCCCAAGGTCATGCGTCGCATCATGGATCAGCTCATCATGCCCCACATCGAGGC
TCTCGATGAAAGTCAGGAGCAGCGCCCCGAGGACGCCCGGCCCGTGGTCAGCGA
CGAGATGCTCGCGCGCTGGCTCGGGACCCGCGACCCCCAGGCCCTGGAGCAGCG
GCGCAAGCTCATGCTGGCCGTGGTGTTGGTAACCCTCGAGCTGGAATGCATGCG
CCGCTTCTTCAGCGACCCCGAGACCCTGCGCAAGGTCGAGGAGACCCTGCACTA
CACTTTCAGGCACGGGTTCGTCAGGCAGGCCTGCAAGATCTCCAACGTGGAGCT
GACCAACCTGGTCTCCTGCCTGGGGATCCTGCACGAGAACGCCTGGGGCAGAC
CGTGCTCCACTCGACCCTGAAGGGCGAGGCGCGGCGGGACTATGTCCGCGACTG
CGTCTTTCTCTTTCTCTGCCACACCTGGCAAGCGGCCATGGGCGTGTGGCAGCAG
TGTCTCGAGGACGAGAACCTGAAGGAGCTGGACAAGCTTCTTGCTAGAAACCTC
AAAAAGCTGTGGACGGGCTTCGACGAGCGGACCACCGCCGCCGACCTGGCCGA
GATCGTTTTCCCCGAGCGCCTGAGGCAGACGCTGAAAGGCGGTCTGCCCGACTT
CATGAGCCAGAGCATGATACAAAACTACCGCACTTTCATTCTCGAGCGATCTGG
GATGCTGCCCGCCACCTGCAACGCCTTCCCCTCCGACTTTGTCCCGCTGAGCTAC
CGCGAGTGTCCCCCGCCGCTGTGGAGCCACTGCTACCTCTTGCAGCTGGCCAACT
ACATCGCCTACCACTCGGACGTGATCGAGGACGTGAGCGGCGAGGGGCTGCTCG
AGTGCCACTGCCGCTGCAACCTGTGCTCCCCGCACCGCTCCCTGGTCTGCAACCC
CCAGCTCCTGAGCGAAACCCAGGTCATCGGTACCTTCGAGCTGCAAGGTCCGCA
GGAGTCCACCGCTCCGCTGAAACTCACGCCGGGGTTGTGGACTTCCGCGTACCT
GCGCAAATTTGTACCCGAGGACTACCACGCCCACGAGATAAAGTTCTTCGAGGA
CCAATCGCGCCCGCAGCACGCGGATCTCACGGCCTGCGTCATCACCCAGGGCGC
GATCCTGCCCAATTGCACGCCATCCAAAAATCCCGCCAAGAGTTTCTTCTGAAA
AAGGGTAGAGGGGTCTACCTGGACCCCCAGACGGGCGAGGTGCTCAACCCGGGT
CTCCCTCAGAATGCCGAGGAAGAAGCCGCTAGTGGAGGAGGAGGTGATGGAAG
AAGAATGGGACAGCCAGGCAGAGGAGGACGACTGGGAGGAGGAGGAGAGTAC
AGAGGAGGAAGAATTGGAAGAGGTGGAAGAGGAGCAGGCAACAGAGCAGCCC
GTCGCCGCACCATCCGCGCCGGCAGCCCCGGCGGTCACGGATACAACCTCCGCT
CCGGCCAAGCCTCCTCGTAGATGGGATCGAGTGAAGGGTGACGGTAAGCACGAG
CGGCAGGGCTACCGATCATGGAGGGCCCACAAAGCCGCGATCATCGCCTGCTTG
CAAGACTGCGGGGGAACATCGCTTTCGCCCGCCGCTACCTGCTCTTCCACCGCG
GGGTGAACATCCCCCGCAACGTGTTGCATTACTACCGTCACCTTCACAGCTAAGA
AAAAATCAGAAGTAAGAGGAGTCGCCGGAGGAGGAGGAGGCCTGAGGATCGCG
GCGAACGAGCCCTCGACCACCAGGGAGCTGAGGAACCGGATCTTCCCCACTCTT
TATGCCATTTTTCAGCAGAGTCGAGGTCAGCAGCAAGAGCTCAAAGTAAAAAAT
CGGTCTCTGCGCTCGCTCACCCGCAGTTGCTTGTACCACAAAAACGAAGATCAG
CTGCAGCGCACTCTCGAAGACGCCGAGGCTCTGTTCCACAAGTACTGCGCGCTC
ACTCTTAAAGACTAAGGCGCGCCCACCCGGAAAAAAGGCGGGAATTACCTCATC

TABLE 7-continued

Nucleic Acid Sequences of Vectors

SEQ ID NO Sequence

```
GCCACCACCATGAGCAAAGAGATTCCCACACCTTACATGTGGAGCTATCAGCCC
CAGATGGGCCTGGCCGCGGGCGCCTCCCAGGACTACTCCACCCGCATGAACTGG
CTCAGTGCCGGGCCCTCGATGATCTCACGGGTCAACGGGGTCCGTAACCATCGA
AACCAGATATTGTTGGAGCAGGCGGCGGTCACCTCCACGCCCAGGGCAAAGCTC
AACCCGCGTAATTGGCCCTCCACCCTGGTGTATCAGGAAATCCCCGGGCCGACT
ACCGTACTACTTCCGCGTGACGCACTGGCCGAAGTCCGCATGACTAACTCAGGT
GTCCAGCTGGCCGGCGGCGCTTCCCGGTGCCCGCTCCGCCCACAATCGGGTATA
AAAACCCTGGTGATCCGAGGCAGAGGCACACAGCTCAACGACGAGTTGGTGAG
CTCTTCGATCGGTCTGCGACCGGACGGAGTGTTCCAACTAGCCGGAGCCGGGAG
ATCCTCCTTCACTCCCAACCAGGCCTACCTGACCTTGCAGAGCAGCTCTTCGGAG
CCTCGCTCCGGAGGCATCGGAACCCTCCAGTTCGTGGAGGAGTTTGTGCCCTCGG
TCTACTTCAACCCCTTCTCGGGCTCGCCAGGCCTCTACCCGGACGAGTTCATCCC
GAACTTCGACGCGGTCAGCGAATCGGTGGACGGCTACGACTGAATGTCCTATGG
TGACTCGGCTGAGCTCGCTCGGTTGAGGCATCTGGACCACTGCCGCCGCCTGCGC
TGCTTCGCCCGGGAGAGCTGCGGCCTCATCTACTTTGAGCTGCCCGAGGAGCAC
CCCAACGGCCCTGCACACGGAGTGCGGATCACCGTAGAGGGCACCACCGAGTCT
CACCTGGTCAGGTTCTTCACCCAGCAACCCTTCCTGGTCGAGCGGGACCGGGGC
GCCACCACCTACACCGTCTACTGCATCTGTCCCCAGCCGAAGTTGCATGAGAATT
TTTGTTGTACTCTTTGTGCTGAGTTTAATAAAAGCTGAAATAAGAATCTTCTCTG
GACCTTGTCATCGACCTCGGAACACCACCGTTTTACTCACCAATCAGACCAAGGT
TCGTCTGAACTGTACAACCAGCAGGAAGTACCTTCTCTGGACTTTTCAAAACACC
TCACTCGCTGTTGTCAACGCCCGTGACGACGACGGTGTTTTAATCCCCAATAACC
TCACCAGTGGACTTACTTTCAGCACCAGAAAAACTAAGCTCGTCCTCCACAAAC
CTTTTGTAGAGGGAACCTACCAGTGCCGACACGGACCTTGTGTTCACAACTTCCA
TTTGGTGAACCTTACCAGCAGCAGTACAGTTGCTCCTGAAACAACTAACCTTTCT
TCTGATACTAACAAACCTCGTGTCGGAGGTGAGCTTTGGGTTCCCTCTCTAACAG
AGGGTGGGAGTCATATTGAAGTGGTCGGGTATTTGATTTTAGGGGTGGTCCTGG
GTGGGTGCATAGCGGTGCTATATCACCTTCCTTGCTGGGTCGAAATCAGAGTCTT
TATCTGCTGGGTCAGACATTGTGGGGAGGAACCATGAAGGGGCTCTTGCTGATT
ATCCTTTCCCTGGTGGGGGGTTTACTGGCCTGCCACGAACAGCCACGATGTAACA
TCACCACAGGCAATGAGAGGAACGACTGCTCTGTAGTGATCAAATGCGAGCACC
AGTGTCCTCTCAACATTACATTCAAAAATAAGACCATGGGAAATGTATGGGTGG
GATTCTGGCAACCAGGAGATGAGCAGAACTACACGGTCACTGTCCATGGTAGCG
ATGGAAATCACACTTTCGGTTTCAAATTCATTTTTGAAGTCATGTGTGATATCAC
ACTGCATGTGGCTAGACTTCATGGCTTGTGGCCCCCTACCAAGGAGAACATGGTT
GGGTTTTCTTTGGCTTTTGTGATCATGGCCTGCTTGATGTCAGGTCTGCTGGTAGG
GGCTCTAGTGTGGTTCCTAAAGCGCAAGCCCAGGTACGGAAATGAGGAGAAGG
AAAAATTGCTATAAATCTTTTTCTCTTCGCAGAACCATGAATACTTTGACCAGTG
TCGTGCTGCTCTCTCTTCTTGTGGTTTTTAGTCAGGGAAAAATAGATAGTGAAGA
TATTATTGGTCATTGGGGTAAAAATATAACACTAGTTGGACCGACAGAAAAACC
TATTGAATGGCATGGACCAAGAGTTCAGCTTTGCGATGGTCCAAAAATTTTACAT
ACAGAATTTAATCACACCTGTAATGAACAGAATCTCACTCTGATATTCTTGAACA
ACACTTTTAATGGGAAGTACTATGGTATTAGAAAGGATGGGTTTGGAATGAAAC
AGTACAATCTTAAGGTTATTGCACCAAAAGCTTCTACTCGCAAACCTCTTTCCCC
ACCTCAGCAAATTAATGTCAGAATGGGACAAAATGTAACTCTAGTTGGGCCAGT
AGATACTCCAGTTAATTGGCATGGACCAAAACATGAACTGTGTAGAGGAAATCA
AAAAATACATCCAGAAGTTAATCATACATGCAATGAACAGAACCTCACATTGCT
GTTTGTTAACTACACTTTCTGGGGAGCATACTTTGGATTTAACAGATATGGTACT
GACAGAGTGCATTATGAGGTTACAATAATAGATGGCTTCGAAAATGCGGGGCAG
CAAAAAGATGATGAGCCAAGTCAGCACAAGCCTAGCAGTAAAGATAGGCCAAA
TCCAAAAGTAAAAAATCCTCAGAAACAAAACACACAAGACAAACATGCAGA
ACAAAAAGGATATTGATAAAGATTTTCCAAGAGGATCTAATCAAACTCTTGTGG
GACCTCCTGGTTCAAAAGTTGACTGGTATGAAGGAAAAAATGGTGACCTTGTAA
AACTCTGCGATGGAAAGTCTGGTTTAAAGGTTTCATGCAATGATCAAAACATCA
CTTTGATTGATGTGAATGAAACCTATGCTGGAACTTATTATGGCTCTAACAATGA
CGACCATAGACAGTATAGAGTTACTGTCTATACAATACCGCGTAATAAAACTGT
TAAAATTCAACCTCATACCACAAAAGGAACCACAGGGGGTACCACAGTTAATGA
ACAGTTTGCTCTGCATCAAGGTAATGATGAAACCAATCAAGATGATGAACAAAT
TCCATCAACTACTGTGGCAATCGTGGTGGGAGTGATTGCGGGCTTCATAACTCTG
ATCATTGTCATTCTGTGCTACATCTGCTGCCGCAAGCGTCCCAGGGCTTACAATC
ATATGGTAGACCCACTACTCAGCTTCTCTTACTGAGACTCAGTCACTCTCATTTC
AGAACCATGAAGGCTTTCACAGCTTTTGTTCTGATTAGCCTAGTCACACTTAGTT
CAACTGCTGCGGCTGCTTGTTATCATAAGCTTAATCTTACTAGAGGAGAAACAT
TACACTAACAGGTGCAGGAATTAATAATACATGGTCAGTATATCACCATGATGG
ATCAAAGAATGGATATCAAGAAGTATGTCCATGGAATGACGGTCGCTATGTCTG
TAATGGAGATAGCAGTACTATTACTAATCTTACAGTTGTAGCTAATGCAAATTTA
ACAAGCAGAAAATTTAAATCATATAGTTATAACAATAATGATGTATGAAACT
GTTAAGTTATGTATTTATGAGATTACAATCATTGAAATTCCAACAACCAAAGCTC
CAACCACAGTTAGGACAACTAGGGAAACAACCACACAGTTAACTACTAGAGAA
ACAACGCAGCCTACCACTGTGCCCACCACACATACTGAAACCACTACTCAAACT
ACACAGCTATACACAACAGTGCAGAATAGTACTGTGATTGTTAGGTATCTGTTG
AGGGAGGAAAGTACTACTGAACAGACAGAGGCTACCTCAAGTGCCTTCAGCAGC
ACTGCAAATTTAACTTCGCTTGCTTCGGTTAATGAAACCGTCATCGCATTGAAAC
TGGATCAAGATCGAGGTTTGGATATGCAAATTACTTTTCTAATTGTCTGTGGGAT
CTTTATTCTTGCGGTTCTTCTCTACTATGTCTTTTGCAAGGCCAGATCAAAGTCTC
ATAGAACAATCTACAGGCCAGTAATCGGGGATCCTCAGCCACTCCAAGTGGAAG
```

TABLE 7-continued

Nucleic Acid Sequences of Vectors

| SEQ ID NO | Sequence |
|---|---|
| | GAGGTCTAAGGAATCTTCTCTTCTCTTTTTCAGTATGGTGATCAGCCATGATTCCT<br>AGGTTCTTCCTATTTAACATCCTCTTCTGTCTCTTCAACGTGTGCGCTGCCTTCGC<br>GGCCGTCTCGCACGCCTCGCCCGACTGTCTCGGGCCCTTCCCCACCTACCTCCTC<br>TTTGCCCTGCTCACCTGCACCTGCGTCTGCAGCATTGTCTGCCTGGTCGTCACCTT<br>CCTGCAGCTCATCGACTGGTGCTGCGCGCGCTACAATTATCTCCACCACAGTCCC<br>GAATACAGGGACGAGAACGTAGCCAGAATCTTAAGGCTCATCTGACCATGCAGA<br>CTCTGCTCATACTGCTATCCCTATTCTCCCATACCCTCGCTGATGATTACTCTAAG<br>TGCAAATTTGTAGAGCTATGGAATTTCTTAGACTGCTATGATGCTAAAATGGACA<br>TGCCTTCCTATTACTTGGTGATTGTGGGGATAGTCATGGTTTGCTCCTGCACTTTC<br>TTTGCCATTATGATCTACCCCTGTTTTGATCTCGGCTGGAACTCTGTTGAGGCATT<br>CACATACACACTAGAAAGCAGTTCACTAGCCTCCACGCCACCACCCACACCGCC<br>TCCCCGCAGAAATCAGTTCCCCCTGATTCAGTACTTAGAAGAGCCCCCTCCCCGA<br>CCCCCTTCCACTGTTAGCTACTTTCACATAACCGGCGGCGATGACTGACAACCAC<br>CTGGACCTCGAGATGGACGGCCAGGCCTCCGAGCAGCGCATCCTGCAACTGCGC<br>GTCCGTCAGCAGCAGGAGCGGGCCGCCAAGGAGCTCCTCGATGCCATCAACATC<br>CACCAGTGCAAGAAGGGCATCTTCTGCCTGGTCAAACAGGCAAAGATCACCTAC<br>GAGCTCCTGTCCGGCGGCAAGCAGCATCGCCTCGCCTATGAGCTGCCCCAGCAG<br>AAGCAGAAGTTCACCTGCATGGTGGGCGTCAACCCCATAGTCATCACCCAGCAG<br>TCGGGCGAGACCAGCGGCTGCATCCACTGCTCCTGCGAAAGCCCCGAGTGCATC<br>TACTCCCTCCTCAAGACCCTTTGCGGACTTCGCGACCTCCTCCCAATGAACTGAT<br>TGATTAAAGCCCATAAACCAATCAATCCCCTTCCCCATCACCTCAATAAACAATC<br>ATTGGAAATAAACATTCAATAAAGATCACTTACTTGAAATCTGAAAGTATGTCTC<br>TGGTGTAGTTGTTCAGCAGCACCTCGGTCCCCTCCTCCCAGCTTTGGTACTCCAG<br>TCCCCGGCGGGCGGCAAACTTCCTCCACACCTTGAAAGGGATGTCAAATTCCTG<br>GTCCACAATTTTCATTGTCTTCCCTCTCAGATGTCAAAGAGGCTCCGGGTGGAAG<br>ATGACTTCAACCCCGTCTACCCCTATGGCTACGCGCGGAATCAGAATATCCCCTT<br>CCTCACTCCCCCTTTGTCTCCTCCGATGGATTCCAAAACTTCCCCCCTGGGGTCC<br>TGTCACTCAAACTGGCTGACCCAATAGCCATTGACAATGGGAATGTCTCACTCA<br>AGGTGGGAGGGGGCTCACTGTGGAACAAGATAGTGGAAAGTTAATTGTGAATC<br>CTAAGGCTCCCTTGCAAGTTGCAAATGGGCAATTGGAATTAGCATATGATGCTCC<br>ATTTGATGTTAAAAACAACATGCTTACTATTAAAGCAGGCCATGGCTTAGCAGT<br>GGTAACAAAAGACAATACTAGTTTACAACCACTACTGGGTACCCTTGTTGTGTTA<br>ACTGGCAAAGGCATTGGCACTGGCACAAGTGCTCACGGTGGAACCATAGATGTG<br>AGAATAGGGAAAAACGGAAGTCTTGCATTTGACAAAGATGGGAGATTTGGTGGCC<br>TGGGACAACGAAAACGACAGGCGCACTCTATGGACAACTCCAGACACATCTCCA<br>AATTGCAAAATGAGTAAAGAAAAAGATTCAAAGCTTACTCTTACCCTAACAAAA<br>TGTGGAAGCCAAATTCTAGGAAGTGTATCTTTATTAGCGGTCAGTGGGGAATAT<br>CTAAATATGACCACAAACACTAATAGAACAATAACAATTAAATTGTTGTTCGAT<br>GCTAAGGGTGTCTTATTGACTTCTTCTTCAATTAGTGGTGATTACTGGAACTTCA<br>GAAATAATAACTCCACTGTGTCGAATAAATATGAAAATGCAGTGGCGTTTATGC<br>CTAATTTAACTGCATATCCTAAACCAACTACAACGAAAAGTTATGCTAGGAGCT<br>ACATTTATGGAAACGTTTATTTGGGAGCACTATCTTACCAACCAGTTATTATAAA<br>GATAAGTTTTAATCAGGAAAAAGATGTAAACTGTGCATACTCTATTACATTTGAG<br>TATACTTGCACTAAGGATTATGCTAATCAGCAATTTGATGTGAGTTCCTTTACCT<br>TCTCCTATATTGCCCAAGAATGAAAGACCAATAAACGTGTTTTCATTTGAAAATT<br>TTCATGTATCTTTATTGATTTTTACACCAGCACGGGTAGTCAGTCTCCCACCACC<br>AGCCCATTTCACAGTGTAAACAATTCTCTCAGCACGGGTGGCCTTAAATAGGGC<br>AATGTTCTGATTAGTGCGGGAACTGGACTTGGGGTCTATAATCCACACAGTTTCC<br>TGGCGAGCCAAACGGGGGTCGGTGATTGAGATGAATCCGTCCTCTGAAAAGTCA<br>TCCAAGCGGGCCTCACAGTCCAAGGTCACAGTCTGGTGGAATGAGAAGAACGCA<br>CAGATTCATACTCGGAAAACAGGATGGGTCTGTGCCTCTCCATCAGCGCCCTCA<br>ACAGTCTCTGCCGCCGGGGCTCGGTGCGGCTGCTGCAGATGGGATCGGGATCGC<br>AAGTCTCTCTGACTATGATCCCCACAGCCTTCAGCATCAGTCTCCTGGTGCGTCG<br>GGCACAGCACCGCATCCTGATCTCTGCCATGTTCTCACAGTAAGTGCAGCACATT<br>ATCACCATGTTATTCAGCAGCCCATAATTCAGGGCGCTCCAGCCAAAGCTCATGT<br>TGGGGATGATGGAACCCACGTGACCATCGTACCAGATGCGGCAGTATATCAGGT<br>GCCTGCCCCTCATGAACACACTGCCCATATACATGATCTCTTTGGGCATGTTTCT<br>ATTCACAATCTGACGGTACCAGGGGA |
| SEQ ID NO: 1443 | CATCATCAATAATATACCTTACACTGGATTTGAGCCAATATTAAAATGAAGTGG<br>GCGGAGTGAATAGTTAATTGACCGTAGGCGTGGTTTGCAAGTTTGCCGAAGCCG<br>GATGTGACGCGTGTGGGAGCCGGGCGCGCCGGATGTGACGCGTTAGTCGCCATT<br>TTTATCGGAAATGACATGTTTTTTGGGCGTTGTTGTGTAAGTTTTGTGTTTTTGGC<br>GGTAAAAGTGATTTGCGGAAGTGAAAACTGTTTACGTCAGTTTTATTATAGGCG<br>AGTAATATTTACCGAGGGCAAAGTGAACTTTGAGCCACTACGTGGTGGTTTCGA<br>TACGTGAGCGATAGGGAAACTCCACGTTGGTGTCCAAAGGACACGTTTATTGTT<br>CTGTCAGCTGGGTATTTAATCCCGCTGCGTTTGTCAAGAGGCCACTCTTGAGTGC<br>CAGCGAGAAGAGTTTTCTCTGCGAGCTGACATACGGCGCCATTATGAGAACTGA<br>AATAACTCCTTTGGTGTTGTCCTATGAAGAAGCCGATGACATATTGGAGCATTTG<br>GTGGAGAACTTTTTTAACGAGGTACCCAGCGATGATGATTTTTATGTTCCCTCGC<br>TTCACGAACTGTATGATATTGATGTGGAGTCTGCCGGTGAGGATTCTAATGAACA<br>GGCTGTGAATGATTTTTTCCGGAATCGTTTATTTTAGCTGCTGCTGAAGGGGTA<br>ATATTACCGGAGCCCCCTGTGCTTTCTCCTATTTGTGAACCTATTGGTGGTGAAT<br>GTATGCCACAGTTGTGTTCTGAAGATATGGATTTGTTGTGTTATGAGGCGGCTTT<br>TCCCTGTAGCGACTCTGAAGGTGAGCAAGACGAAAACGGAATGGCGCATGTTTC<br>TGCAGCTGCAGCGGCGGCTGCTGCTAATAGAGAACGTGAGGAGTTTCAGTTAGA |

TABLE 7-continued

Nucleic Acid Sequences of Vectors

SEQ ID NO Sequence

```
CCATCCGGAGTTGCCTGGACATGATTGTAAGTCCTGCGAGTACCACCGGAATAG
TACTGGAAACACTGACTTAATGTGCTCTTTGTGTTATCTGCGAGCCTACAGCATG
TTTATTTACAGTAAGTGCGCTATTTGGACGGTGGGAGGTGTATTTTTATTTGTTC
TTAGCAGTAAAGACTTTTTTGTTTTTAGGTCCTGTTTCTGACAATGAACCGGAAC
CGGACAGCACTACGGATGACAATGAGAGACCGTCGCCCCCAGAACTGGGAGAT
GTAGTTCCGGAAGGAGTAGTGAAACCTGTACCTCAGCGGGTGACTGGGAGGCGA
CGTGCTGTGGAAAGTATTTTGGATTTGATCCAAGAGGAAGAATGTGAACAAACA
GTGCCTGTTGATTTGTCAGTGAAACGCCCTAAATGTAATTGATGAACTTTGCACA
CCTGGCAATAAAATGGGAGTTTTGTGTGAGTCACGTATAATAAACTGTTTGCGTG
TTTTATTTGGGCGTGGTTAGTAGGCATATAAAGGTGGGTTGGCGCTGCCTAGCAT
GAGATAGTGAAGAATGGAGCTAGAAGCTGTGTTGCAAAGTTTTCAGAGCGTTCG
TCAGCTTCTGCAGTATACCTCTAAAAACACTTCAGGTTTTTGGAGATATCTGTTT
GGTTCTACTTTCAGCAAGGTGGTACATAGGGTGAAGGAAGATTACAGAGAGGAA
TTTGAAAACATATTGACCGACTGTCCAGGGCTTTTAGCTTCATTAGATCTTTGCC
ACCACTCTGTTTTTCAGGAAAGAGTGGTCAGATCTTTAGATTTTTCATCTTCTGGC
CGAACGGTTGCTTCTATTGCCTTTTTGGTAACCGTGTTGGATAAATGGAGCGAGA
GGTCCCACCTGAGCTGGGATTACATGCTGGATTACATGGCAATGCATTTGTGGA
GGGCATGGCTGAAGAGGAGGGTTTGCATTTACTCGCTGGCGCGGCCTCTAACCA
TGCCGCCGTTGCAGGAGGAGCAGCAGAACACTACGACGGAGGAGTAAACATGG
AACCACAGGTGCAAGAAGGCCATGAACCTGACCCCGACGAAGGGCCTAGTTGTG
CAGATGTTAAAAAGCGGGAAAGAAAAGAAAGTTTAAAGGAAGCTGTCCTTAAT
AGGCTGACTGTTAACCTAATGTCTCGCCCGCGCTTGGAAACTGTATATTGGCAGG
AATTGCAGGATGAATTTAAGCAGGGACACATGCATCTACAATACAAGTACAGTT
TTGAGCAGCTAAAAACCCACTGGCTAGAACCATGGGAGGATTTAGAGTGTGCTA
TTAAAGCTTTTGCTAAAGTAGCTTTACGCCCTGACTGTACTTATAATATCTCTAA
GACAGTAACTATTACGTCATGTACGTACATTATAGGCAATGGGGCAGTAGTTGA
GGTGGACACTAATGATAGAGTTGCTTTTAGGTGTCGTATGCAGGGCATGGGACC
GGGGGGTGGTAGGTTTGGATGGCATTACATTTATGAATGTTAGGTTTGCTGGAGA
AAAATTTAAGGGCATTATGTTTGAGGCTAACACAAGTGTTGTGTTGCATGGTGTG
TACTTTCTTAACTTCAATAACACGTGTGTAGAGTGTTGGAATAAGGTATCTGCCA
GGGGTTGCACTTTTTATGGGTGTTGGAAGGCCTTGGTAGGTAGGCCCAAAAGTA
AAATGTCTGTAAAAAAGTGCTTGTTTGAGAAATGTGTGCTTGCTTTAATTGTAGA
AGGGGATGCACACATTAGACATAATGCAGCTTCAGAAAATACCTGTTTTATTCTA
CTGAAGGGAATGGCTATTTTAAAGCACAATATGGTTTGCGGGTTGTCTGATCAG
ACAATGCGACGGTTTGTTACCTGTGCTGATGGAAATTGCCACACTTTGAAAACTG
TTCATATTGTGAGTCATGCTAGATATTGTTGGCCTGTGTGTGACCATAACATGTT
TATGCGCTGCACAATACATTTGGGTCTACGGCGGGGTGTGTTTAGACCTTCCCAG
TGTAACTTTAGTCATTCAAATGTTTTGCTGGAGCCCGAGGCGTTTTCCAGAGTGA
GTTTAAATGGGGTGTTTGATTTATCTGTGGAATTATACAAGATTATCAGGTATGA
CGATGCTGCCCGTCATCGCTGCCGGCAGTGCGAATGTGGCAGTAGTCATCTAGA
ACTTCGCCCCGTCATGCTGAATGTAACTGAGGAGCTAAGAAGTGACCATCTTAC
CCTGTCTTGTCTGCGAACCGACTATGAGTCTAGCGATGAAGACAACTAAGGTAA
GTGGGCGGAGCTATGTGGGACTATAAAATGCTTAAAGGAATTGTAAAGTTGTTT
TTGTTATTTTGGCAGCGCAATGAACGGAACTGCTGGGGACAACGCTGTGCTTTTT
GATGGAGGGGTTTTCAGCCCTTATTTGACGTCAAGGTTACCGTATTGGGCCGGAG
TGCGTCAGAATGTGGTAGGATCTACTCCAGACGGACGACCTGTAGCGCCTGCAA
ATTCGTCAACGTTAACCTATGCAACTGTGGGACCTTCGCCGTTGGATACCGCCGC
CGCCGCTGCAGCTTCTGCGGCGGCTTGTACGGCTCGTAATATGGCAGCTGATTTT
AGTCTCTACAGCCAATTGACATCGAATGCCGCAATGCGCACTGCAGTCCGAGGA
GACATTTTAACTGTTATGCTTGCAAAGCTTGAGACCTTAACTGCTCAGCTAGAGG
AGCTGTCGCACAAGGTCGAAGAATTAGCTGATGCTACCACTCCCACCCTACCAC
AACCTGTTAGTCAATAAAAAAGCTTTAAATTGTATGCTGTTTGACTGTTTATTGA
TGTTTGTTTTTCTGACATGGTAAGCTCTGGACCATCGTTCCCTATCATTAAGAAC
ACGGTGAATGTATTCCAATATTTTGTAAAGGTGGGCTTGTATGTTAAGGTACATT
GGCATAAGACCATCTGTGGGATGCAGGTAGGACCACTGTAGGGCTTCTTGCTCA
GGGGTGGTGTTGTAAATAATCCAATCGTAGCAACAGCGCTGGGCATGGTGGTGA
AATATATCTTTAAGCAACAAGCTGATTGCTAAGGGAAGACCTTTAGTGTAGGTA
TTTATAAAGCGGTTAAGCTGGGTGGGGTGCATACGGGGGGACATAATATGTAGT
TTTGATTGTATTTTGAGATTGGCAATATTTCCTGCCAGATCTCTCCTTGGATTCAT
GTTGTGGAGAACCACAAAAACAGTGTAGCCAGTGCATTTGGGGAATTTATCATG
AAGTTTGGAAGGAAAGGCATGAAAAAATTTGGAGACGCCTTTGTGGCTTCCCAG
ATTTTCCATACACTCATCCATTATTATAGCAATTGGCCCGCAAGCGGCAGCTTTA
GCAAAAATGTTTTTTGGATCAGAAACATCATAGTTGTGGTCTAACGTTAAATCAT
CGTACGAGAGCTTAACAAATTTAGGGCAGAGCGTTCCGGACTGTGGGATAATGG
TTCCCTGGGGTCCTGGGGCATAATTTCCCTCACAAATTTGCATTTCCCAAGATTT
AATTTCCGAAGGCGGAATCATGTCCACTTGGGGAACAATAAAAAAAACAGTTTC
TGGAGCAGGTGTGACCAGCTGGGCGGAAAGCAAGTTACGCAACAACTGAGATTT
CCCACATCCAGTAGGTCCATAAATCACCCCAATAACTGGCTGCAAGTGATAGTTT
AACGAGGTGCAGCTGCCGTCGTCGCGGAGAAGCGGAGCCACATCGTTCATCATT
TGCTTGACTTGCATGTTTTGCTTGACAAGTTCCCTCAGAAGGCGTTCACCGCCCA
AGGAGAGCAACTCTTGCAAAGAGTTGAAAGTTTTTAATGGTTTTAGACCGTCAG
CCATTGGCATGTGGTCCAGGGTTTGTTTTAACAGTTGCAAGCGGTCCCATAGCTC
AGTTATATTTTCTATTCCATCTCGATCCAACAGACTTCCTCGTTGCGGGGATTGG
GCTGGCTGTTGCTGTAAGGAACAAGGCGATGAGCATCCAAGTGCACCAGGGTTT
TGTCCTTCCATGGACGTAAGGTGCGTGTCAGGGTTGTTTCGGTCACGGTGAACGG
ATGCGCCCCTGGTTGGGCGCTGGCCAGCGTGCGCTTTAAGCTGGTGCGGCTGGT
```

TABLE 7-continued

Nucleic Acid Sequences of Vectors

SEQ ID NO Sequence

```
GCTGAAGTGTGTGTCTTCTCCCTGTGCTTCGGCAAGGTAGCATTTTAACATGAGT
TCATAAGATAAGGCATCCGTGGCGTGACCTTTAGCCCGTATTTTCCCCTTTGAAG
TGCTGCCACAATCAGAACACTGAAGGCATTTAAGGGCGTACAGTTTCGGAGCCA
AAAAAACAGACTCTGGAGCGTAAGCATCTGCACCGCAGTTAGCACAAACAGTTT
CGCATTCCACCGACCAGGTCAGCTCAGGATAAGATGGATCAAAAACAAGTTTCC
CTCCATACTTTTTGATGCGTTTCTTACCTTGCGACTCCATAAGGCGGCGTCCTTTC
TCTGTGACAAAAAGACTGTCTGTGTCTCCGTATACAGATTTAATGGGTCTGTCCT
TTAGGGCTATTCCACGGTCCTCCTCGTAGAGAAACTCTGACCACTCTGACACAAA
GGCCCTAGTCCAAGCCAGTACAAACGAGGCCACATGGGAAGGGTACCGATCGTT
ACTAATTAAAGGGTTGGAACTTTCCAAGGTGTGCAAGCACATGTCCTCTTCTTCA
GCATCTATGAATGTGATTGGTTTGTAGGTGTAAGTCACGTGATCAGAGTTCCCTG
GTGGGGGCTATAAAAAGGGGTGGGACACTGATCTTCATCGCTGTCTTCGGCTT
CGCTGTTTACGAGCGCCAGCTGTTGGGGTGAGTACGCGCGCTGAAAGGCAGGCA
ACACATCTGTACTCAAAGTATCAGTTTCTATAAACGATGAGGATTTGATGTGCAA
ACGGCCTGCTGCAATTTCTTTTATGAGCCCCTCTTCCATTTGATCAGAAAAACA
ATTTTTTTGTTATCTAATTTTGTAGCAAAGGATCCGTACAGGGCGTTTGAAAGTA
ACTTGGCTATAGATCTTAGCGTTTGGTTTTTGTCCCTGTCTGCCCGTTCTTTTGCG
GCGATATTGAGTTGTACATATTCACGAGCAATGCATTTCCAAGTGGGAAAAACG
GTGGTACGTTCGTCTGGTAATAATCGCAGACGCCACCCGCGATTATGCAGTGTA
ACTAAGTCTACACTGGTGACCACTTCGCCGCGCAAGCTCTCATTAGTCCAGGCTA
AACGACCGCCTTTTCGAGAGCAAAAAGGAGGAAGAACATCTAGCTGGTTCTCAT
CTGGAGGATCAGCATCCACAGTAAAAATACCAGGACATAAAATTTTATCAAAAT
AATCAATTTTGGAAGTATGATTTTCAAGTGCCACCTGCCATTGCCGTACGGCTAA
TGCTCTCTCGTAAGGGTTAAGGGGAGGACCCCAAGGCATAGGGTGTGTAAGGGC
TGATGCATACATGCCACAAATATCATATACATATATGGGTTCCTGTATAACACCT
ATATAGGTAGGATAACACCTGCCGCCGCGAATGCTTGCGCGAACATAGTCGTAT
AGTTCGTGCGAAGGCGCCAAAAGGTTAGGGCCTAAATGTGTGCGTTTTGGTTTCT
CTGCGCGATACAAAATTTGTCTGAAAAGCGCATGAGAGTTAGAGGAGATGGTGG
GACGTTGAAACACATTGAAGTGTGCCTGCTGAAGACCCACCGACTGATTAACAA
ACTGGGCGTAGGAACTGCGCAGTTTTTCTACCAATAAGGTCGTAACGATGACAT
CCAGGGCGCAATAGTTTAAAGTTTCCAGAATAAGATTGTAATTTTTTCTCCTTTT
TTTTTCCATAGTTCTTGGTTTAGGAGGTATTCCTGTTTATCCTTCCAATACTCCTC
TAAAGGGAAACCATCTGCATCAGCGCGGTAAGAACCAAGCATGTAAAATTGATT
TATGCCTTGTAGGGACAACAACCTTTTTCTACAGGCAGGGCATAAGCTTCAGC
GGCCTTTCTTAAAGATGTATGAGTTAAAGCAAAAGTGTCCCTGACCATTACTTTT
AAATACTGATATTTAAAGTCCTGGTCGTCACATCCTCCTTGCTCCCACAGCAGGA
AGTCAGTGCGCTTTTTGTAGTAAGGATTAGGAAGAGCAAAAGTTATGTCATTAA
ATAAAATTTTACCAGCTCTTGGAATAAAATTTCTAGAGATTTTAAATGGCGCAGG
TACATCTGACCGATTGTTTATGACCTGCGCGGCAAGAACTATTTCGTCAAATCCA
TTAATATTGTGCCCCACTATGTATAACTCTAGAAATCTTGGCTGCCCCTTAATGA
CAGGAGCTTTTTTAAGCTGTTCAAAGGTCAGATCGTCAGGACTAACTAGACCATT
TTGCTGTTGCGCCCACTGATGCAACTGCGGATTGTTTTGTAAAAAAGTATTCCAG
AGGTTAGCGGCTAAAGACGTTTGCAAGCGATTTCTGTAGGTACGGAATTGCTGA
CCGACCTTCATTTTTTCTGGGGTAATACAATAGAAAGTAGAGGGAGTCTTTCTCCC
ATTGGTCCCATCCAAGTTCTAAGGCAAGTTGTAATGCGTGCGCTACGAGACTACT
GTCCCCAGACAGTTTCATTACCAGCATAAATGGTACAAGTTGCTTTCCAAACGAG
CCCATCCAGGTGTAGGTTTCTATGTCATAGGTAATAAAAAGACGTTCAGTGCGA
GGATGCGAACCGACCGGGAAAAACTGGATCTCCTGCCACCAGTTGGAAGAGTGG
GCGTTAATGTGGTGGAAGTAGAAATCTCGCCGGCGAGCAGAGCATTCATGTCGA
TGTTTGTAAAAGCGTGCGCAGTATTCGCATCGTTGCATGGGCTGTATGTGTTGAA
TGAGGTGCACCTGACGACCGCGCACCAAAAAGCGCATGGGAAATGGATGCCA
CTTCTTGGCAATTGCCGTTCGTTGTCTTCCTGTTCTGTTGCATTGTTGTCACCGTTT
GGATCCTTGAAAGTGAAAACGGAAAGGGTAACGGCGCCTCGACCGCTGCACGTC
CATATTTCGGCTCGAGCGGGGCTGAAGCAGGAAATCAAAGCTTGCAGTCTGGAA
CTGTCCATGGTATCACTCATAAAGGAAAGCGCGTCTGCGGGGAAAGCTTGCAAG
TTAACTTCGCAAAGGCGGGTAAGAGCAGGCCGTAGGTGAAGGTGATACTTAATT
TCAAGAGGAGTGCCATTGGTAGAATCTATTGCGTGCAGTGTGCCGTAAGCCCGA
GGTGCAATTACTGTTCCGCGGTGAGCAACACGCCTGCTTAAAAGCGACGGCGCG
CAGGAACTGGGACTTCCGCTTCTGCGGGGGCATGAGGCAGCCGTATGTCGGCCT
GACGTTCTGGTAGTGGAAGGTGCTGAGCCCGTAGTTGACTGGCATGGGCGACGA
CCCGACGATTGATGTTCTGAATTTGTCGACGTTGTGTAAACACCACCGGTCCCGT
TGTTTTGAACCTGAAAGAAAGTTCAACAGAATCAATTTCAGCGTCATTTACTGCA
GCCTGCCTCAGAATTTCCTGAATATCCCCTGAGTTATCTTGGTAGGCAATTTCTG
CCATTAGTTGATCAATTTCTTCCTCTTGGAGATCTCCATGACCCGCTCGTTCAATG
GTAGCTGCAAGGTCATTAGAGATGCGTCCCATAAGCTGTGAAATGCGTTGAGT
CCAATTTCGTTCCAGACGCGGCTGTACACAACTCCTCCGTCGCTGTCTCTGGCAC
GCATAACCACTTGCGCCAAGTTAAGTTCCACAAAGCGCGCAAACACACCGTAGT
TGCGTAAACGCTGAAACAGGTAGTTTAAGGTAGTAGCTATGTGTTCTGAAACAA
AAAAATAAAGAATCCACCGACGAAGCGTGAGCTCGTTGATGTCTCCCAGAGCTT
CCAAACGTTCCATGGCTTCGTAAAAGTCAACTGCAAAAGTAAAAAACTGGGAGT
TTCGAGCCGCAACAGTTAATTCTTCTTCTAAAAGACGAATAATTTCAGCCACCGT
GTGGCGCACTTCAAGCGCAAAAGCCTCCGGGGCTTCTTCTTCCTGTTCCTCTTCT
ACTTCCATTGTTTCTTCTTGAACCGCGGGCGGAGAGGGTAGCCTTCTTCGTCGCC
GGCGAACGGGCAACCTGTCCACAAATCTTTCAATCATTTCGCCCCGGCGGCGGC
GCATAGTTTCCGTCACTGCTCGACCATTTTCACGTGGGCGAAGCTCGAAAAGTCC
ACCCCTTAGTTCTAGGGTAGGAAATGCGTTGCGAGGTGTGTTGGTAGCGACAC
```

TABLE 7-continued

Nucleic Acid Sequences of Vectors

SEQ ID NO Sequence

```
AGCGCTTACTATGCATTTTATGATTTGCTGCGTAGGAACTCCGCGCCAGGACCTA
AGCGACTGCATATCTACTGGGTCTGAAAACCTTTCAAGGAAGGCGTCAATCCAG
TCACAGTCACAAGGTAGGCTAAGTTTTGTTTGCTGTGAATCACCGGGATGTTGAA
CGATGTTGCTAATCATGTAATTAAAATAGGCTGTTTTAAGTCTGCGGATGGTTTT
AAGAAGCACCACGTCTTTTGGTCCGGCTTGTTGAACTCGCAGGCGGTCTGCCATT
CCCCACACACTACTTTGACAACGTCCAAGATCTTTGTAGTAGTCATGCATGAGCC
TTTCCACTGGTACTTCGCGGTCTTGGCGATCAGCCATGTGCGTTGCACCATAGCC
TTGTAATGGTTGCAATAAAGCTAAATCTGCAACTACCCGTTCAGCAAGTACTGCC
TGCTGTATTTGGGTAAGAGTATTTTCAAAGTCATCCATATCTACAAAGCGGTGGT
AAGCTCCTGTGTTAATGGTGTAACTGCAGTTGGTCATTACTGACCAATTAACAGT
GTGGATGCCTGGCTGTATGGTTTCTGTGTATCGTAAGCGCGAGTAAGCTCGAGA
GTCAAAAACATAATCGTTGCAAGTGCGCACCAAATACTGATAGCCCACTAGAAA
ATGAGGAGGAGGTTCTCGATATAACGGCCACCGAAGTGTAGCCGCCGCACCGGG
AGCAAGATCTTCTAACATGAGGCGGTGGTATTCATATATGTATCTGGACATCCAC
GTGATGCCGGCGGCAGTGGTTGTTGCCCGGGCAAACTCGCGAACTTGGTTCCAA
ATGTTGCGCAGGGGTAAAAAGCGTTCAATGGTTGGGACGTTTGACCGGTGAGG
CGTGCGCAGTCTTGAATGCTCTAGATGTAAAGAAAATGAAAGTCTGTAAGCGAC
TCCCCTCTGTGGCCTGGCGGAAAAGTCACAAGGGTACCACAGCGAGGAACCCCG
GTTCGAAACCGGCAGGATCCGCTGTGAGCGTATATAGGGCGTCTGCGCGTGGAA
CCCAGCCAAAGACCCCCAGACACGGAGAGGAGTCTTTTGTTTTTTTTAGATGCA
TCCCGTCCTGCGACAGATGCGACCTCAATCCAGGGCACCCACGCCCTCAGGACC
AATAGCGCTTGGGGGCTCTGGCGAACCTGAAGAGCCTCCCACGTTGGAGTTGGA
AGAAGGAGAAGGCTTAGCCCGTCTGGGCGCTCACTCTCCTGAGCGACACCCAAG
GGTGCAGCTTACTCGCGATAGTCGTGCGGCGTTTGTGCCTCGGCAAAATATGTTT
CGAGATAACAGCGGGCAGGAGGCTGAGGAAATGAGAGACTGTAGATTCAGGGC
CGGTCGCGAGCTGCGTTGCGGACTTAATCGCGAGCGACTGCTGCGAGAGGAAGA
CTTTGAGCCGGATGAACGTTCTGGGATTAGTCCCGCGCGAGCTCATGTTTCCGCG
GCCAACTTAGTGTCAGCCTATGAACAAACCGTTACAGAGGAACGTAATTTTCAA
AAAAGCTTTAATAATCACGTGCGCACGCTAATTGCACGTGAAGAAGTGGCTATT
GGTTTAATGCATCTTTGGGACTTTGTGGAAGCGTATGTGCATAATCCAGCAAGCA
AACCTTTGACCGCCCAGCTCTTCTTGATAGTACAACATAGTAGAGATAATGAAA
CGTTTAGAGACGCAATGCTTAACATTGCTGAGCCACAGGGTCGGTGGCTACTTG
ATTTAATTAATATCTTGCAAAGTATTGTGGTTCAGGAACGCAGTCTTAGTTTAGC
AGACAAAGTGGCTGCGGTTAATTATTCCATGTTAAGTTTGGGAAAGTTCTATGCT
CGCAAGATATACAAAAGTCCATATGTTCCCATTGACAAGGAAGTAAAAATAGAC
AGTTTTTACATGCGCATGGCACTAAAGGTACTAACATTGAGCGACGATTTGGGA
GTATACCGCAATGATCGAATCCACAAAGCGGTGAGCGCAAGTCGTCGAAGAGA
ACTTAGTGACAAGGAACTTATGCACAGCCTGCAAAGGGCGCTAACTGGAGCCGG
AACAGAGGATGAGGCCTTTTTTGATATGGGCGCAGATCTAAAGTGGCAGCCAAG
CGCCCGCGCCCTGGAGGCGGCTGGCCAGGATGATGATGATGATGACGAAGA
CCAGTATGAGGACTGACCGGGCCGTACCTTTTGTTAGATGCAGCGACCGGCTAT
CATCACGGACGGGGCCCGTAACCTGGATCCCGCGGTCACGGCGGCCATGCAAAG
TCAGCCTTCTGGAGTTACGGCTTCAGATGACTGGACAGCGGCCATGGATCGTATT
ATGGCTTTAACGGCGCGCAGTCCTGAGGCTTTTCGCCAGCAGCCGCAAGCTAAT
CGGTTTTCTGCCATTTTGGAAGCAGTAGTGCCGTCTCGAACTAATCCCACCCACG
AGAAAGTGCTAACCATAGTGAACGCTCTGTTGGACAGCAAAGCTATTCGTAAAG
ATGAGGCTGGCCTAATATACAACGCTCTTCTGGAGCGTGTGGCGCGCTACAACA
GTACCAACGTACAGGCTAACTTGGACCGGATGGGTATGGATGTAAAGGAGGCGC
TTGCGCAACGAGAGCGATTTCATCGCGACGGCAATCTTGGCTCCCTGGTTGCGCT
AAATGCTTTTTAAGCACTCAGCCGGCTAATGTTCCGCGTGGTCAAGAAGATTAT
ACAAACTTTATAAGCGCTTTGCGCCTGATGGTTACTGAAGTTCCACAAAGCGAA
GTGTATCAGTCTGGTCCCGACTATTTTTTTCAGACTTCCAGGCAGGGGTTGCAAA
CCGTAAATTTAAGCCAGGCTTTTAAGAATTTGCAAGGCCTGTGGGGGTACGCG
CTCCTGTGGGTGATCGCTCAACTGTCTCCAGTCTGTTAACGCCAAATTCTCGGTT
ATTATTGTTGTTAATCGCTCCTTTTACCAACAGCGATAGTTTAAGTAGGGATTCG
TACCTAGGTCACTTAATTACTTTATATCGCGAAGCCATTGGTCAAGCGCAGGTAG
ATGAGCAAACGTATCAAGAAATAACCAGCGTGAGTCGCGCTCTGGGACAGGAG
GATACAGGCAGTTTGGAAGCCACGCTGAACTTTTTACTAACAAACCGCCGTCAA
CAAGTGCCTCCGCAATACAGTTTGAATGCAGAAGAAGAGCGCATACTGCGCTAC
ATTCAGCAATCAGTGAGCTTGTATCTAATGCGCGAAGGCGCAACGCCCAGTGCC
GCTTTAGATATGACTGCGCGCAACATGGAGCCGTCATTCTACTCTTCCAATAGAG
CATTTATTAATCGTTTAATGGATTACCTTCACCGAGCCGCGGCTATGAACGGAGA
ATACTTTACCAATGCGATTTTAAATCCGCATTGGTTACCACCTCCTGGTTTTTACA
CTGGAGAATTTGATTTACCGGAGGGAAACGATGGCTTTTTGTGGGATGATGTTAC
AGACAGTCTCTTCAGCCCGGCAGCCATTGGTCACCATGGTAAAAAGGAGGGAGC
AGATGAAGGTCCGTTACTGAGCTCTCGGGCAAGTTCTCCGTTTCCCAGCCTAAGC
AGTATTAACAGCGGTCGTACAACAAGACCGAAACTATCAGGAGAAAGCGAGTA
TTTAAATGATCCCCTGTTACGTCCAGCACGCGACAAAAATTTTCCAAATAATGGC
ATAGAGAGCTTAGTAGACAAAATGTCTCGTTGGAAAACGTATGCGCAAGAGCGG
CATGAATGGAAGAGAGACAACCCAAACCAGTGCCCCTCCGAGACAACGCTG
GCAACGCGTAAAAAGGAGCGCATGCGCTTGACGAAGGAAGCGATGACTCAG
CAGATGACAGTAGTGTGCTAGACCTAGGAGGGACAGGGAACCCATTTGCTCATT
TGCGTCCGCAAGGTCAACTAGGGCCGTTGTATTGAACAAAATAAAAGCACTCTT
ACCAAAGCCATGGCGACCAGCGTTCGTCTTATTTGTTTTTTCCGTTAGCTGCAAA
ATGAGGCGCGCGGTGGAACTGCAGACAGTGGCTTTTCCCGAGGCACCACCACCC
TCTTACGAAACCGTGATGGCAGCAGCTCAGACTTCCGCACTGGAAGCTCCCTAC
```

TABLE 7-continued

Nucleic Acid Sequences of Vectors

SEQ ID NO Sequence

GTGCCTCCCCGCTATTTGGCTCCTACGGAGGGAAGAAATAGCATCCGTTATTCAG
AGTTGTCACCTTTATACGATACCACTCGAGTGTACCTAGTGGACAACAAGTCTTC
TGACATCGCTTCTTTAAACTACCAAAATGATCACAGCAACTTTCTAACCACTGTA
GTCCAAAACAACGACTATTCCCCTATAGAAGCCGGTACACAAACTATTAATTTTG
ACGAAAGGTCCCGATGGGGCGGTGATTTGAAAACTATTTTGCATACCAACATGC
CCAACGTAAATGATTTTATGTTTACAACTAAATTTAAGGCCAGGGTAATGGTGTC
TAGAAAAAAAGATAGTGAAGACCAGTCCAAAGACATTTTGAAATACGAGTGGG
CAGAATTTGTGTTACCCGAAGGTAACTACTCGGAAACCATGACTATCGACTTAAT
GAACAACGCAATCATCGAGCATTACTTGCGAGTTGGCCGTCAGAACGGCGTGCT
AGAAAGCGACATTGGAGTTAAGTTTGACACCAGAAACTTTCGCCTGGGTTGGGA
CCCCGAAACTAAATTAGTAACTCCGGGAGTGTATACTAACGAGGCTTTTCATCCA
GATATAGTATTGCTACCAGGATGCGGAGTGGACTTCACGGAGAGCAGATTAAGC
AACATGCTGGGAATCAGAAAAAGACAGCCTTTTCAGGAGGGTTTTGTTATCATG
TATGAAGACTTAGAAGGGGGAAATATCCCAGCGCTTTTAGATGTTAAAAAATAC
GAAGACAGCTTGCAGCCAGACGGCACCGTAAGAGGTGACAACTTTATTGCCTTA
AACAAGGCCGCAAAAATCGAAGCAGTCGAGGCTGATTCCAAAGGCCGAAGTTA
CAACTTGCTTCCCGACAAAAAAAATACTAAGTACCGTAGCTGGTATTTGGCATA
CAACTATGGAGATCCAGAAAAAGGTGTTCGTTCTTGGACTCTTCTAACAACCCCA
GACGTGACAGGCGGTTCCGAGCAGGTCTATTGGTCGCTTCCCGATATGATGCAA
GATCCGGTGACTTTTCGCTCCTCGCGTCAAGTCAGCAACTATCCGGTAGTTGCGG
CCGAACTAATGCCGGTTCACGCCAAAAGCTTCTACAACGAACAAGCCGTCTACT
CACAGCTTATCCGCCAGTCAACCGCGCTTACACACGTGTTTAATCGCTTTCCCGA
GAACCAGATACTAGTGCGTCCACCAGCTGCTACCATCACTACCGTCAGTGAAAA
CGTTCCCGCTCTCACAGATCACGGGACCCTGCCGCTGCGTAGCAGTATCAGTGG
AGTTCAGCGAGTCACCATCACTGACGCCCGCCGCCGGACCTGTCCTTACGTTTAC
AAAGCACTGGGCATAGTTTCTCCACGAGTACTTTCTAGTCGCACTTTCTAAAAAG
TGTACAAACATGTCCATCTTGGTTTCGCCAAGTAACAACACGGGCTGGGGATTG
GGAGCTGGCCGCATGTACGGAGGAGCTAAAACCAGGTCCAGCCAACATCCAGTT
CGCGTCCGCGGACACTATCGAGCGCCATGGGGAGCACATACCCGCGGACGCACT
GGTCGCACCACTGTGGACGATGTTATCGACTCGGTCGTAGCCGATGCTCGGAAA
TACCGTCCACCAGCCAATACAGCAGGGTCTACCGTTGATGCGGTCATTGATGAG
GTAGTGGCAAACGCACGAGCTTATGCCAGACGTCGCAGAAGGCCGCGTCGGCGC
CGACCTACTGCTGCTGTGCGTGCGGCTAGAGCGTTAGTGCGACGCGCTAGACGC
GTCGGACGACGAGCTATGCTGCGAGCAGCCAGGCAGGCTGTAACGCCTGCCGGT
AGAGCGCGGAGACAGGCCGCAGCTGCGGCCGCAACAGCTATTGCCAACCTAGCC
GCTCCCAGACGAGGAAATGTGTACTGGGTGCGCGACGCGGTAACTGGGACTCGA
GTCCCGGTTCGTACGCGTCCACCTCACCCTTAGAAGACAAAGAGTTGATTGATA
ACCTGTTATGTATGCCCAGCATGACCAAACGCAAGTTCAAAGAAGAGCTGCTGC
AGGCCGTCGCGCCTGAAATATACGGCCCAGCGGATTACATTACCAAGCGCGAAA
TCAAGCATGTTAAAAAACTGGACCAAAAAAAAGAGGAAGAAATGGCCGCAGCG
CTAGCGGACGAAGTCGACTTCGTGCGCTCCTTTGCGCCCAGACGTAGAATACAG
TGGAAAGGGCGGTCAGTAAAGCGAGTTTTGCGACCCGGCACCACAATAGTTTTT
TCTCCTGGGGAGCGAACGGCTATGCGCCCCTCAAGCGCGAATACGATGAAGTG
TATGCCGATGATGACATTTTGGAACAGGCTGCCCAACAGGCTGGTGAATTCGCC
TATGGAAAAAGAAGCCGTTACGACGACAAAATTGCTATTCCTTTGGACGAGGGA
AATCCCACACCCAGTTTAAAGGCTGTCACTTTACAACAAGTATTACCTGTGCTCG
CGACCTCAGAAGAAAAGCGAGGCATAAAAAGGGAAGCTATGAATGACTTACAG
CCCACAATGCAACTTATGGTGCCTAAGCGGCAAAAGTTAGAGGACGTACTAGAG
TACATGAAGGTGGATCCCAACATTCAGCCGGACGTAAAAATACGTCCCATAAAA
AAAGTTGCCCCAGGATTAGGAGTCCAAACAGTGGACATCCAAATTCCCGTACAA
GCTGCGCAAAGTAAAACTATGGAAACCCAGACTTCGCCAATAAAAACAGCAGTG
GACAGCGGCATGCAAACCGAGCCTTGGTACCCGCCAACTTTTACAAGAAAAAA
CGCCACTACAAACAAACAAACGCGCTCTTGCCAGAATACGTGCTACATCCTTCC
ATTGTGCCCACGCCGGGGTATCGCGGGTCAACTTTCCAGCGCAGAGCCCTAGTTT
ATAGCCGCAGAAGAACTCCGTCGCGACGCAGACGTCGACGCAGAGCCAATTTAG
CTCCAGCATCAGTACGCCGCGTTGTACGAAAAGGGCGCACACTGACGCTTCCAT
CTGTGCGTTACCACCCTAGCATACTCTAATAAGCTGCGCTGCCGTTTTACAGATG
GCTCTTACTTGCCGAATGCGCATACCCATTCCAGGATACAGAGGAAGATCTCATC
GGAGGAGAGGGCTGACCGGGAACGGTCGATTTCGGCGACGTAGCGCGCGCAGG
CGCATGAAGGGCGGGGTACTTCCCCTGCTAATTCCACTTATTGCCGCGGCCATCG
GAGCCGTACCCGGAATTGCTTCAGTTGCCTTGCAGGCTTCTGAAAAAATTAAAT
TAAAATCAAAAGAAATAAAAAAGGAATAACTTCCAACTTATTACTGGTACTGTG
ACTGTTTTATGCAGACTAAATGGAAGACATCAATTTTTCGTCGTTGGCCCCGCGA
CACGGCACGCGGCCGTATATGGGCACCTGGAACGAGATCGGCACCAGCCAGCTG
AACGGGGCGCCTTCAATTGGAACAGTATCTGGAGCGGTCTTAAAAATTTTGGT
TCCACAATTAAGACATATGGCTCCAAGGCGTGGAACAGCCAAACCGGCCAGATG
CTAAGGGACAAGTTAAAAGACCAGAACTTCCAACAAAAAGTGGTAGACGGTCT
GGCTTCTGGAATCAATGGAGTTGTAGACATAGCTAATCAAGCTGTGCAAAAACA
AATTGCCAACCGTTTAGAGCCGCGACCCGACGAAGTAATGGTAGAGGAAAAGTT
ACCGCCTCTGGAAACGGTGCCCGGATCAGTTCCGTCCAAAGGAGAAAAGCGGCC
GCGGCCAGATGCAGAGGAAACTCTAGTCACGCACACCATAGAGCCCCCCTTCCTA
TGAGGAAGCAGTTAAACAAGGAGCAGCTTTGGCACCTACTACTTATCCCATGAC
CAAGCCTATTCTACCCATGGCTACCAGGGTGTATGGGAAAAATGAAAATACGCC
TATGACTCTCGAGATTCCTCCCTTGCCAGAACCTACTGTTGCGGAACCTGTGGTT
ACTGCTCCCATTGTTTCAACTGTATCGCGTCCAGAAGTGCGGCCTGTTGCCGTAG
CAAGCTCACGAAACCCGCGATCCGCTAATTGGCAAAGCACCCTAAACAGCATTG

TABLE 7-continued

Nucleic Acid Sequences of Vectors

SEQ ID NO Sequence

TGGGACTGGGAGTAAAGTCTTTAAAACGCAGACGCTGCTATTAACATTAAACAA
AACATAGTGTTAACTCCCGTCTGTATACGCCTCTATGTTAGCGCAGAGGACCAA
CGCTCGAATTGCAGTTATTACCAGCGCTTTCAAGATGGCCACTCCCTCGATGATG
CCGCAGTGGTCTTACATGCACATCGCCGGTCAGGACGCCTCGGAGTACCTGAGT
CCCGGTCTGGTGCAATTCGCCCGCGCCACGGACACCTACTTCACCCTGGGAAAC
AAGTTTAGGAATCCCACTGTGGCTCCCACCCATGATGTCACCACCGACCGCTCGC
AGCGATTGACGCTGCGTTTTGTGCCCGTGGATCGGGAAGATACTGCTTATTCTTA
CAAGGCTCGCTTTACGCTGGCTGTGGGGGACAATCGCGTGCTGGACATGGCTAG
TTCTTACTTTGATATTAGAGGGGTGCTGGATCGCGGTCCCAGTTTTAAGCCTTAT
TCGGGTACCGCCTATAACTCACTGGCGCCAAAAGGCGCCCCTAATGCTTCACAG
TGGTCTGATAATAATAAGGTGAACACTTTTGGGCAGGCTCCGTATCTTAGTGACT
CTATTACTGCCGATGGTATTAAAGTTGGAACAGATACCGCCCAAGCAGGGGCGG
CGGTTTACGCTGACAAAAAATACCAGCCTGAGCCGCAGGTAGGGGCAAGTGAAT
GGAATACCAGTATTACAAACGTTAAAGCAGGGGGTAGGGCATTAAAACAAACG
ACTGCCATGCAGCCGTGCTACGGCTCATATGCTCGCCCGACCAACGAAAAAGGG
GGACAAACCAAGGACAATAACGTAGAACTTCGGTTTTTTGACACAGCCAACAAT
GCAGCCACTCCTCAAGTTGTGTTTTACACTGAAGATGTAAATCTAGAAATGCCGG
ACACCCATCTTGTGTTTAAGCCGGCTGTTCCTAATGGAACAATTGCGTCCGAGTC
CTTGTTGGGACAGCAAGCAGCGCCAAATAGAGCAAATTACATTGCATTCAGAGA
TAACTTTATTGGATTAATGTACTACAACAGCACAGGGAACATGGGTGTCCTTGCC
GGACAAGCTTCACAGCTAAACGCAGTAGTGGACTTACAAGACAGAAATACGGA
GCTGTCTTACCAGTTAATGCTAGATGCTCTTGGCGACAGAGCGCGGTATTTCTCA
CTGTGGAATTCTGCAGTGGACAGTTACGACCCTGATGTTCGCATCATTGAGAATC
ATGGGGTTGAGGATGAACTCCCAAATTATTGCTTTCCTCTCAGCGCAGTGGGAG
ACATAAAGAGTTACAAAGGCATTAAGCAAAACAACGAGGGGGCGGTAACTGG
GCTGCGGACGACACTGTTGGCGACAAAAACGATATAGGCATTGGTAACATTGCC
GCTATGGAAATTAACTTGCAGGCCAATTTATGGAGAAGTTTTCTGTATTCAAATG
TGGGGCTGTATCTGCCTGACGACTTGAAATACACCCCCGGGAACATAAAACTTC
CAGAAAACAAAAACACCTACGAGTACATGAACGGGCGCGTGACTGTTCCCGGTT
TGGTAGATACCTACGTTAACATTGGCGCGCGCTGGTCTCCTGATGTAATGGATAA
CATAAACCCTTTTAACCACCACCGAAACGCAGGGTTGCGCTATAGGTCCATGTTA
CTGGGCAACGGTAGGTTTGTTCCGTTTCACATTCAGGTACCTCAGAAATTTTTCG
CTATTAAGAATTTGCTGCTGTTACCAGGGTCCTACACTTATGAGTGGAACTTCAG
AAAAGATGTAAACATGATACTTCAGAGCACCCTGGGCAATGATCTTAGAGTGGA
CGGAGCCAGCATTCGCTTTGACAACATTGCCCTGTATGCAAACTTCTTCCCCATG
GCTCACAATACAGCTTCTACATTGGAAGCCATGCTGCGAAATGACACCAATGAC
CAGTCTTTTAACGATTACTTGTGCGCGGCGAACATGTTGTATCCCATTCCAGCAA
ATGCCACCAGCGTGCCCATTTCAATACCTTCGCGAAATTGGGCAGCCTTCAGAG
GGTGGAGTTTTACTCGCCTTAAAACTAAAGAAACACCTTCTCTTGGTTCAGGGTT
TGACCCCTATTTTGTTTACTCTGGAACTATTCCCTACCTGGACGGGACTTTTTACC
TGAACCACACTTTTAAAAAGGTGTCAATCATGTTTGACTCCTCTGTCAGCTGGCC
TGGAAATGACAGGCTGTTAACACCAAATGAATTTGAAATAAAACGTTCTGTAGA
CGGGGAAGGCTACAATGTGGCCCAATGTAATATGACCAAAGATTGGTTTCTAAT
ACAAATGCTTAGTCATTATAATATTGGATACCAGGGTTTCTACGTTCCAGAGAGC
TACAAAGACCGCATGTATTCTTTCTTCAGAAACTTTCAGCCCATGAGCAGGCAGG
TTGTAGACACTACTGAATACAAAGAGTATAAAAAAGTAACCGTGGAATTCCAGC
ATAACAACTCAGGGTTTGTGGGATACCTGGGTCCTACTATGCGCGAGGGACAAG
CTTATCCTGCGAACTATCCCTATCCTCTCATTGGAAAAACAGCTGTACAGAGCGT
CACACAAAAAAAGTTTCTCTGTGACCGTGTGATGTGGCGCATTCCATTTCTAGC
AATTTTATGTCAATGGGGCGTTGACAGACCTCGGGCAAAATATGCTGTATGCA
AATTCGGCCCATGCGTTAGATATGACATTTGAAGTTGACCCCATGGAAGAGCCC
ACCCTTCTTTATGTTTTGTTTGAAGTTTTCGACGTGGTGCGCATTCATCAGCCACA
CCGCGGAGTCATTGAAGCGGTCTATCTGCGCACACCCTTCTCCGCGGGTAACGCC
ACCACCTAAAGAAGGCACTTTCCCAGATCGCTGTAATGGGTTCAAGCGAACAGG
AGCTGACGGCGATTGTTCGAGATCTAGGCTGTGGACCCTATTTTTTGGGCACCTT
TGACAAACGTTTTCCCGGTTTTGTGTCTCGCGACCGGTTATCATGCGCTATTGTTA
ACACTGCCGGTCGCGAAACTGGGGGCGTACACTGGCTGGCCTTTGCATGGAATC
CCAAATCGCACACTTGCTATTTATTTGATCCATTTGGATTTTCTGATCAGCGGCTC
AAACAAATCTATCAGTTTGAGTACGAAAGTCTGTTGCGTCGTAGTGCGCTAGCG
GCTACTAACGACCGATGCGTCACCTTAGAAAAGTCAACACAAACTGTACAAGGA
CCGTTTTCTGCAGCGTGCGGCCTGTTTTGTTGTATGTTCTTACATGCTTTTACTCA
CTGGCCTGACCATCCAATGGATAAGAATCCCACTATGAATCTACTGACTGGGGTT
CCAAATAGTATGTTACAAAGTCCGCAGGTGGAGGACACACTGCGGAGAAATCAG
CAAGAACTATATATTTTCTTAAACAAATTGTCACCTTACTTTCGCAACAACCGCC
AACGCATAGAAAAGCCACCTCTTTCACTAAAATGAAAAATTGATACAAATACC
CATGTACGTAATGCATTAATAAACAATTTTATTAGAGAATTGATTACAAGACTGT
TTTTTTTTTTTTATTTTATTAAAAATCAAACGGTTCCTCGCGAGAATCACCATGG
TTGGTGGGCAGGGCTATGTTTCTATACTGCAAACGCGGATGCCACTTGAACTCTG
GAATAACAAGCCGAGGAAGCGGGCCTTCGAAATTTTCTCCCCATAGCTGTCGCA
CAAGCTGCAATGCACCCATAACATCAGGAGCTGATATCTTGAAGTCGCAATTAG
GACCGGCGTTACCGCGCGCATTGCGATAAACTGGATTTGCGCACTGAAAAACCA
GCAAACATGGATACTTAATACTGGCTAGGGCTCCAGGGTCGGTGACTTCGTTAA
CGTCGATGTTTTCAACATTGCTGAGGTTAAATGGAGTAATTTTACACAGCTGACG
CCCCATGCGTGGCAGGCCATCTTGCTTGTTTAAACATTCACAACGAACTGGCATC
AGGAACCGCTTCTGCCCCTGTCGCATGTGAGGGTAGTCGGCCAACATGAAAGCT
TCAATTTGCCTAAAAGCCATTTGAGCCTTCGTTCCTTCTGAATAAACAAACCGC

TABLE 7-continued

Nucleic Acid Sequences of Vectors

| SEQ ID NO | Sequence |
|---|---|
|  | ATGACTTTCCGGAAAAGAATTATTTCCGCAGCCGACATCATTAAAACAGCAGC |
|  | GGGCGTCGTCATTTTTAATTTGAACTACATTACGCCCCCAGCGGTTTTGCACTAC |
|  | CTTGGCTTTAGATGGATTTTCTTTTAGTGCTCGCTGCCCGCTCTCGCTGGTTACAT |
|  | CCATCTCTATCAAGTGCTCTTTGCGCACCATTTCCATGCCGTGCAGGCATCTCAG |
|  | CTCCCCTTCGCGTTCAGTGCACTGGTGCTCCCATACACAGCAACCAGTTGGTTCC |
|  | CAGGTATTTTGTTGAACACCGGCATAGGCTTGCATATATCCTTGTAAGAAGCGTC |
|  | CCATAAGCTCCTGAAAGGTTTTCTGGGATGAAAAAGTTAGCTGCAACCCGCGTTT |
|  | TTCCTCATTTAGCCATGTTGTACAAATTTTTTTGTACACCGCTCCCTGATCTGGCA |
|  | AAAACCTAAAGCTGGCGCGCTCGTCGTGATCCACATGGTACTTCTCCATCAGCAT |
|  | AGCCATTGCCTCCATGCCTTTTCCCAAGCTGATATCAGAGGCTCGCTCGTGGGG |
|  | TTGCGAACTATTACTACGCCTTTTTGTTCTTTGCCTTCCATGTTTTGAGCAGCGGT |
|  | CTTCAAAATGCGCACCTGCCTTTCTTCCATTTTTTGGAAAGACTGAGAACCGTCT |
|  | GCATGATGCATAATGCGAACAGGGGGCATGCTGAAACCCATGACTCCTAACACT |
|  | GCCTTTGGCGGCTCGGTTTCTTCTTCTTTTTCGCTCTCCGGAGATAGAGGGATGGT |
|  | AGCCATGGACCTCCTGGCTTTTTTCTTTGGAGGCAAAGGCACAGCCTCCAGGTCT |
|  | TCTTCGCTTTCTGAGTCCAAAAAGTACCGACCCATTTTTGGAGGCGGCGGCTGAG |
|  | TGTTGCGGTCTGGGGTGCGCTCCCTCTGTGGGTGTTGATTGCTGGCCATTATTTA |
|  | ATCCTAGGCAAAGAAACACATCATGGATCCGCAGTCAAAGGAAAACTTAACCGC |
|  | CCCCACCGATACTGCTGTTGCTGCCATGGAAAAGAACAAATGTCTACTCATACCC |
|  | CAAGATGCACCGCTTGCGCAGGACTCGGGCTACGTGACTCCCCCGAGGAATTG |
|  | GAAGGCTCTCTTCTAATCCAAGAGCAACCAAATAAGGAACAGGCAGAAAGCAA |
|  | TGAGCAAAACGCTGGGCTCCATGACTACCTAGACAAGGGAGATGTCTTGCTTAA |
|  | ACATTTACAGCGACAAAGCATTATTGTTCGCGACGCCGTAGCTGACCGCTCTTTA |
|  | TTGCCAGTTTCAATCGCGGAACTTTCTTGCGCATACGAACGCAACCTCTTTTCTC |
|  | CCCGTGTGCCACCCAAACGACAAGCCAATGGTACCTGCGAACCAAATCCTCGGC |
|  | TGAACTTTTACCCGGTTTTTGCGATACCAGAAGCTCTGGCAACATATCACATTTT |
|  | TTTCAAAAATCATAGAATACCTCTGTCTTGCCGAGCCAACCGCAGTCGCGCAGAT |
|  | AAGCTCCTTACCCTTAGCGGTGGTGCTTCCATACCTGGTATAGTGTCCTTGGAAG |
|  | AGGTGCCTCGGATTTTCGAAGGCTTGGATCGCGACGAAAAGCGAGCAGCAAACG |
|  | CCCTACAAACAGAAAACAAGCAAAATCAAAGTGCGCTCATAGAACTAGAAGGG |
|  | GACAATGCCCGTTTGGCCATTTTAAAACGCAATGTTGAAGTAACTCACTTCGCAT |
|  | ACCCGGCAGTGAATCTTCCGCCAAAGGTTATGAGCGCAGTAATGAATCAACTAC |
|  | TAATTAAGCGCGCCCAGCCCATTGACAAAGATGCAAACTTGCAAGATTCAGAGG |
|  | CATCAGATGATGGAAAACCAGTTGTAAGCGACGAACAGCTAATTAAATGGCTGG |
|  | GAACAGACGACCCCGCCAAACTACAGCAGCGGCGTAAACAAATGATGGCGGCA |
|  | GTACTTGTAACGGTGGAACTGGAGTGCATGCACCGTTTTTTTTCCAACGTTAGCA |
|  | CGTTGCGCAAAATTGAAGAATGTCTCCACTACACCTTTCGGCATGGTTATGTGCG |
|  | CCAAGCCTGCAAAATTTCCAATGTGGAGCTAAGCAACCTTATCTCATACATGGGT |
|  | ATTTTGCACGAAAACAGATTGGGACAAAGTGTGCTACATTCAACGCTCCGCGAC |
|  | GAAGCGCGCAGAGATTACGTGCGGGACTGTATTTATCTTTTTTTGCTACATACTT |
|  | GGCAAACCGGAATGGGGGTGTGGCAACAATGTTTGGAAGAAACTAACCTCAGA |
|  | GAACTCAACAAACTGCTTGACAGAGCGTTGAAATCACTATGGACAGGTTTCGAC |
|  | GAAAGAACGGTAGCGGCAGATCTGGCCAACATCATTTTTCCAGAACGGCTCATG |
|  | ATAACCTTGCAAAATGGTCTGCCTGACTTTATGAGTCAAAGTATGCTGCATAATT |
|  | ACCGTTCTTTCATATTGGAGCGATCTGGCTTGTTACCTAGCATGTGCTGTGCGCTT |
|  | CCTTCAGATTTTGTGCCCATACATTTTAGAGAATGTCCCCCTCCTCTGTGGAGTC |
|  | ACTGCTACTTGTTCAAACTTGCCAATTACTTAGCTTACCACTCAGACCTTATGAC |
|  | GGATTCCAGCGGAGAAGGATTAATGGAGTGTCACTGTCGCTGCAATTTATGCAC |
|  | TCCTCACCGTTCGCTGGTGTGCAATACCGAACTGCTTAGTGAAAGCCAGGTTATT |
|  | GGTACGTTTGAAATGCAAGGGCCGCACTCTGATAGCAATCTCACCACAAACCTG |
|  | AGGCTGACACCTGGCCTTTGGACTTCCGCTTACCTGCGCAAATTTGAACCCCTAG |
|  | ATTACCACGCACACGTTATTAATTTTTATGAAGATCAGTTAAAGCCCCCTAAAGC |
|  | GCCACTAACGGCCTGCGTCATTACGCAGGGAAAAATTTTAGCCCAATTACAAGC |
|  | CATTAAACAAGCGCGCGAAGAATTCTTACTCACAAAAGGACGCGGAGTGTACCT |
|  | TGACCCCCAGACCGGCGAGGAACTGAACCTTCCATCACCTCTGTGTGCTACTGCA |
|  | TCCTCTCCCATTCGCAGCATGTCCCCGAAAACCGCAAAACAAGCTATTGCGCA |
|  | GCAACGCTCAAAGAAGCAGCTACAACAGCAGGAAATCTGGGAGGAAGATTCTT |
|  | GGGACAGTCAGGCACAGGAGGACCAGGACTTGGAAGAATGGGAGGAGGAAAGC |
|  | CTAGACGAGGATCCAGAGGAGGACGGTTCCAAGGACGGAGCGACCGCCGCAAA |
|  | ACCGTCGCTTTCAACCGAACCCTCTCCAGTGAAACACACTGTCAACAAATCTCAG |
|  | AAAGCGAGCCGTAGATGGGACACCACTGAAGCCAGCGTCGTAAACATGGGTAA |
|  | GAAATGCAAGCAGGTGCGGCGGGGCTACTGCTCATGGCGGGCTCATAAAAGTAA |
|  | TATTATAGCCTGCTTGCAACACTGCGGGGAAACATCTCATTTGCAAGGCGGTAT |
|  | CTGCTCTTTCACGATGGAGTGGCAATTCCTAGGAATGTTCTCCATTACTACCGTC |
|  | ATCTCTACAGCCCCTTCGAAGAGATCCACAAAGAATCGACGTCTTACGGACCAG |
|  | CAGGCCACTAGAAAACCGGCAGCAGCAACAAGGAAAGTCCAGAGGCGCGCGA |
|  | GTTAAGAAAACGCATTTTTCCCACTCTATATGCTATTTTTCAGCGAGCCGAGGC |
|  | CAAGAACACGAACTGAAAATAAAAAACAGATCCCTCCGTTCACTTACCCGCAGC |
|  | TGTCTCTACCTCAAAAGCGAAGACCAGTTGCAACGCACCTTGCAGGACGCTGAA |
|  | GCTCTGTTCAATAAATACTGCTCCCTCTCGCTTAAAGAGTAAAAAAGCCCGCGC |
|  | GCGGACTTCTGACAAGCGGGAAAGTGACGTCACATTTATAACGGATGAGTAA |
|  | GATATTCCCACGCCTTACATGTGGAGTTTTCAACCTCAAATGGGCTAGCGGCGG |
|  | GTGCGGCTCAAGACTACTCTACTAAAATGAATTGGTTGAGCGCCGGCCCACATA |
|  | TGATTTCCCAAGTAAATGGAATTCGCGCCCGGCGAAACCAAATGCTACTACAAC |
|  | AAGCCGCTCTCACCGCTACACCGCGTAACCAGCTTAACCCACCCTCTTGGCCCTC |
|  | TGCCCTATTGTACCAGGAAAGTCCCCCTCCTACAACGGTACTTTTGCCTCGCGAC |

TABLE 7-continued

Nucleic Acid Sequences of Vectors

SEQ ID NO Sequence

```
GCCCAGGCCGAAGTCCGCATGACTAATGCTGGCGCACAACTCGCGGGCGGCGCA
CGTCATAGTTTCAGGTATAAAGGTCGCCCTGGGCCGTACTCATCTTCTGCTATAA
AAACAATACGCATTAGAGGAAAAGGTATTCAGCTGAACGACGAGGCAACATCG
CCACTGGGACTCAGGCCCGACGGAGTGTTTCAGCTGGCAGGCTCCGGCCGCTCG
TCCTTCACTACTCGTCAAGCCTACCTAACACTTCAGAGTTCGTCAACAGCTCCAA
GATCCGGCGGGATTGGAACTCTTCAATTTGTGGAGGAATTTACTCCATCTGTTTA
CTTTAATCCCTTTTCGGGCTCGCCTGGACACTATCCTGACGCCTTCATACCCAACT
TTGACGCCGTGAGCGAATCTGTGGATGGTTATGATTAATGTCTAATGGAGCGGC
CGACAGAGCGCGGCTGCGACATTTAGACCACTGTCGCCAACCTCGCTGCTTTGCT
CGAGACATCTGCGTGTTTACTTACTTTGAGCTGCCAGAGGAACACCCTCAGGGA
CCAGCTCACGGCGTAAGGATAACAGTTGAAAAAGGAATTGATACACACCTCATT
AAATTTTTTACCAAACGTCCGCTATTGGTTGAAAAGGATCAAGGGAATACTGTAT
TAACTCTATATTGCATTTGTCCTGCCCCCGGATTACATGAAGATTTTTGCTGTCAT
TTGTGTGCTGAATTTAATCATTTGTAGTGGCGGTTTACCGCCTGAAGAAGAACCT
AACTGTCATCCGCCTCTCAGTAACATTAAAATTAACCTTTCAATCTCTGACATTA
CTCTTCGCTGCAATTTTTTCTCCACCCATCTCACCTGGAGTTTTAACGGAAAACCC
GTCGCCGAGGTAAAATTAAAGTTTGAGCTACACAAAGAAAACATCACTTTATTT
GCACCTATTCACCTGGGATACTACCGCTGCGCAGCTCCACCCTGTCAGCAAGCCT
TTTTCGTTTCTCCGATTATTAACAGAAAACCTGCTACAACAACACCTGTTACTCG
GCAAAACATCCAGACGACTTCTCCTACTAAAGGTATAGAGGAAATTGTGTACTT
TTCAAACTTTACAAACCACATACTTTTAAACTGTTCCTGCTCTAACTCCTTAATCT
CATGGTTTGCTAATAGCACTTTGTGTAAAGCTTTTTACCAACAAAAACTTTTGTA
TTCTGCCAATTTAACACTGTGTAACCAAACCACTTCTTCCCACCTTACTCTACTAC
CACCTTTTGTCGCTGGTCGTTATTTTTGCTTAGGAGCTGCCGGTACTAGCCCCTGT
CAACAGCATTGGAGATTAACTTATCGCCAACGCCAGTAACGCCTTCTGTAATA
ACAGAGGCTTTCACCTCTAATACCCTGCTTCTATATAGTGGTCTTGTGGCTCTTAC
TTTATTTCTAATTTCTAACTTGTTTCTAGTGCAGCATCTGTATTTGTACTAATCAT
GCTTAGTATTTTAGTCTTTGTTTTTTTACCTCTCCTCCTACATGCTCAAACATCTG
AGAAACCATTGAAAGTATTTGTGGAAGTTGGCCATAATGTAACCCTCCCCCATCT
CATGCCTGATTCACACGAAACAGGCCATGTGACTTGGCTAGTAGAAACATCAGA
TTACGGTGTAGCTTCTCCAAACAACTTTATTTTTAGTGGACAAAACTATGCCAG
TTTACTTCCAGAACTATGGTGTGGCCTTATGCCAATTTAGATTTTAACTGCGCTA
ATTACGACCTCCATTTGTTTCGGCTTAAGGTAGAAAATTCAGCAATTTACAATGT
TAAAAATACCATCAATGCATCTGAAATGAACATCTACTACCAATTAACAGTAAT
TGACATTCTTCCACCCAAATGCATCATTACTTCAAAGTACCTCACAAATAATTAT
TGTCACATTACCATTAACTGCACCAACTCAGTGTATCCAAACAAAGTTCAGTTTA
ATAATGTTAGTCGATTCTATTATGGATACGCCAAGGGAGGCCCAAACCTACCCA
ATTATTTTACCACTAATTTCAATGTATCAGGTATTACTAAAAGCTTTAACCACAG
TTACCCTTTTAATGAGCTGTGTGATGACCCCGTGTTCCAACCTCAGAATAATTTA
ACAAACACGGTAATTTTCTTAGTAATAATTGCATTTAGCGTTCTCATTATTATAG
CGGCCCTCACTTACCTGTGCTGTCACAAACAGACTTAAATCTTGCTTTTTTTTTT
CTTACAGTATGGTGAAGGTTCTTCTTATATTCTTATGCCTGCCAATCATTTTTTCT
TCTTCAACTTTTGCAGCAGTGAGTCACATTGATCCTGATTGTATAGCACCCTTTG
CGGTGTATTTGATTTTTACATTTGTGACCGCCACGTGCGTCTGCAGTCTTATAACT
TTACTTCTTACCTCGCTTCAATTTTTTGATTACTACTACGTGCGATACGTTTACCG
CAGACATCACCCTCGCTATCAAAACCCCCAAATTGCAGCTCTTCTTCATCTACAG
CCATGAAAGCAGCGTTAGCCATCTTCATGTTAACTCCAATGTTGGCCACTTCTTG
TAAGCTTCACGTGCCATGGACTTTCTTAGACTGCTACACCAAAGAGACAGATTAC
ATAGGCTGGGTGTATGGGATTATGTCTGTCTTAGTTTTTGTATCCTGTGTAGTTTC
CTTAAAACTTTATACGCTTATTAATTTTAGTTGGAATCAATACACTGATGATCTC
CCTGAGTACCCCCACCACCAGGATGATTTACCCCTAAACATTGTACTTCCACAGC
CCCCACGTCCTCCTTCGGTTGTTAGCTATTTTAAGTTCGCCGGTGAAGATGATTG
AACCAGACCTACAAATGGATGGAACAATGACCGAACAGAGGCTGCTTGCTGATC
GCGCTAGGCGTCGCCAACAGGATCAAAAAAATAAAGAGTTACTTGATTTACAAA
CCGTTCATCAGTGTAAAAAAGGACTTTTTTGCCTGGTAAAACAAGCCACCCTCCG
CTACGAGAGTTTACCAGGCAAAGAGCATCAACTCTGCTACACGCTGCCTGCTCA
GCGACAAAGCTTCACCGCAGTCGTGGGTTCGGTGCCTATTAAAGTGTCCCAACA
AGCAGGACAGCAAGAAGGCTCCATTTGCTGCCTATGTAACAGCCCTGAATGTTT
GTACACTTTAATAAAAACACTGTGCGGCATAAGAAATCTTTTACCAATGAATTA
AATAAATCACTCACCTGAAATTTAAAAATACATTGTGGTCTCCATGTACTCTTAC
AAAATTTCCTTCTTCCCAACTATCAAAGCCAATAGACTTGCAAACAGCAAATTTT
CTCCAAATTTTAAATGGAATGTCAGAATTTTCTTCCCAATTCCTACCCACCATCTT
CATCTTTTTTGATGAAGCGCAGCAGAACCCAGTACGCTGGAGAACCTGAAGAA
AATGACGACTTCAACCCCGTTTACCCTTTTGACCCATATGACACAGCGCATGTGC
CCTTTGTTACACCCCCTTTTACTTCTTCCAATGCTTTTCAAGAAAAACCACCCGGT
GTATTATCACTTAATTACAAAGATCCCATTGTTACTGAAAATGGATCCCTTACCC
TAAAGTTAGGGAACGGAATAAAGCTTAATTCACAAGGTCAACTTACAACCACTA
ACACTAAAGTACTAGAACCCCTTGCCCACACCTCACAGGGTCTTACACTTTCTTG
GAGCGCCCCATTATCAGTTAAGGCCAGTGCACTTACACTTAATACAATGGCACC
ATTCACAACAACAAACGAAAGCTTAAGCTTGGTCACTGCCCCTCCCATTACAGT
GGAAGCTTCACAATTGGGCTTAGCCACTGTAGCACCTCTAAGCTTAGACGGAGG
GGGAAACCTTGGTTTGGATCTTCTCGCTCCCTTAGTTGTAAACTCTAGCAACGCG
CTAACCCTATCTGCTTCAGATCCGTTAACTGTAAATTCCAATAGTTTAGGATTAA
ATATTACCAGTCCCATTACACTAATAAACGGATCCTTGGCTTTAGCCACATCCCC
TCCTCTGGACACCACAGGATCTACTTTAAATCTTTCTGTTGCTGCTCCTCTCAGTG
TTTCACAGAACGCACTCACTGTTTCAACCGGTAATGGTCTTCAAGTATCAGGATC
```

TABLE 7-continued

Nucleic Acid Sequences of Vectors

| SEQ ID NO | Sequence |
|---|---|
| | TCAATTAGTAACAAGAATAGGAGATGGTTTACGATTTGATAATGGGGTTATAAA<br>AGCATATGTTGCCGGGGGAATGAGACTCTCAGGGGGTAAAATAATTTTAGATGT<br>TAATTATCCCTTTGATGCAAGCAACAACCTTTCATTGAGGAGAGGATCAGGCCTC<br>ATATATAATGAGTCTACAAACTGGAACTTAACAACTGTATATCAGCACCGAAAAA<br>GGCCTAACGTTTAGTGGGAACCAAATAGCTATCAACGCAGGTCCAGGTCTCACG<br>TTTAATAACCGCAAGCTTCAGGTAAAATTGGGCGCGGGACTCACTTTTGATTCAA<br>ATGATAATATTGCCTTAAATAGTATTGCTACTCCGTATGATCCTTTAACGTTGTG<br>GACAACTCCGGATCCTCCGCCCAACTGCACTCTCAGACAAGAACTTGATGCAAA<br>ACTAACTTTGTGTTTAACAAAGAACGAATCTATTGTGAATGGCATAGTTAGTTTG<br>ATAGGTGTTAAGGGGGATCTCTTACATATTCAACCTACCACCACCACTGTGGGAC<br>TGCATTTAGTGTTTGATCGACAGGGACGATTGGTCACAACAACGCCCACTGCCTT<br>AGTTCCCCAGGCTTCCTGGGGATATAAACAAGGTCAATCGGTATCTAGCAGCGC<br>TGTTGCTAATGCTTTAGGATTCATGCCTAATGTAAGTGCTTACCCTAGACCAAAC<br>GCGGGTGAAGCCAAAAGTCAGATGTTAAGTCAGACATATTTACAGGGAGATACA<br>ACTAAACCTATTACAATGAAAGTTGTATTTAATGGCAATGCAACAGTGGATGGA<br>TACTCTCTAACATTTATCTGGACAGGTGTGTCAAACTATCTAAACCAACAGTTTT<br>CAACACCATCTTGTTCATTTTCGTATATTGCCCAAGAATAAAAAAAAACACAAATT<br>TGCATACCGTGATCATTTATTAATTCTTTTTTACAATACGAGTAGTTATACTGCCT<br>TCTTCCCATTTCACCTTGTATACCTCCCTCTCCCACTTTGTTGCGGAAAACAGCTG<br>CGCTTGAATGTTTCTACTTTGGTTTTTTGGTGTTAACGTCCACACGGTTTCCTTCT<br>GGGCAAAACGACAGTCGGTGATACAAACAAATCCTTCGCCCGCACAGTCTCTTA<br>AACTGCATTCCATTTTATCCTACAAAAGGTAACAACAGTCAGTGTCCATCAGCCG<br>CCCATGGGTTTTCTCGATGATTGTAATCTCCAAATAAAATTGCTTGATGATGCAT<br>AATAAGACCCTTTAGCAGTCGCTGACGATGGCCTTCGCACCAACTATGTTTTAGT<br>GGGCGAACAGTGTTCTCAGCAATTACTTTAACAACTTTTAACATTAATAGTCTGG<br>TACGACGAGCGCAACAGCGCATGCGTATTTCACTTAAGTCTTTGCAATAGTCACA<br>GCACAACACTAACATGTTATTTAAAATTCCATAATTAAAGGTACTCCATCCAAAA<br>CTAATCTTTTCTAGCGCTAACCAAGCATGGCCATCATACATAATTTTAACATAAA<br>TCAAATGGCGACCTCTAACAAAGGTGCTTCCCACATACATTATTTCTTTTGGCAT<br>AAAAATGGTTAACAACCTCCCGATACCAAAAACACCTTTTGTTAATTAATGTTCCA<br>TATACAGCCATTTTGAACCAGCGTCCTAAAAGCATCCCAGCTGACATACACTGTA<br>GTGAACCCGGACGCTGGCAATGACAATGTATTAGCCACCGCTCATAACCATGTA<br>ACAATTGAGTAATTTCAACATCTATGGTGGCACAACACAAACACACACTCATGT<br>ATTTTTTTAAAATAAACATCTCATAATTAGTTAAAATCATATCCCATGGTATTGG<br>CCATTCTTGCAATACAGTAAACCCTACACATGAAGGAATACCTCTTACCTCACTT<br>ACATTATGCAAAGTCAGACTATTACACTCAGGCCATGCAGAATTCTCTGACAAA<br>GTAGCTTTTGACTGCTGTTCACAAGGTGGTAGATGGTACTTGCTGTACGGCGCCA<br>GTCTGCAACCATACCGTCTGTCGCGCTGCATCGTACACCACAGACTTGCGAGCGT<br>CTTCGTACTTTGAATAACAAAACCACGTACGCCCACTGGTTACAGCGCCGCGTCC<br>CTTTTGCTTTCGACGTTGGCGTTCAGTCACAAACGCAAAATATAACCACTCTCGC<br>AGGCTTAATAGAATGTACTCAGCTTCAGGTGTGATCTTCAAATTATGCTCTTTAA<br>CAAAGCGGATAGTATCCACACAGGTCGCATGGGCCAAACCAAGCCATCCAATAC<br>AGGCAGCTGTATCCCGACATATGGGAGGTTGAGGAATACAAGGCAAAGGCATA<br>AAAGCTAATCAAGACGGTCAGCAAGTATTTGAATGCGTAAATCTCGCAGGTGGC<br>AGCGATCACCTCCGCTGTGCTGGTGAAAAATCACAGCCAGATCAAATTGTAAGC<br>GGTTTTCCAAATGTTCAACAACAGCATCTAAAAGAGCCACGGCTCTAATTTCCAC<br>AAACAAAAGTAAAGCAAATGCGTTATCATGAAACTCTTCTATCATCAGACTGCC<br>TGACTGAACCATTCCCAAATAATTTTCATTCTTCCACTGTTGTATTATTTGAACAC<br>ACTGATTTTGCAGGTTTAAGCCATGAATATTAAAAAGCTCTGTAAGGGCGCCCTC<br>CACCGCCATCCGCAGGCAGTACTTCATATTTGCTGAAAAAAGTCTGGATCTTCAA<br>ACACCTGCAGTAAATTCAGTAGATTTACATTAGGCTCCACACCTTGCTCTCGCAG<br>CTGACATCTTAAAGCCAGTTGTATAAAATCATGCAAATCAGAAGCCAG |
| SEQ ID NO: 1444 | CATCATCAATAATATACCCCACAAAGTAAACAAAAGTTAATATGCAAATGAGCT<br>TTTGAATTTTAACGGTTACGGGGCGGAGCCAACGCTGATTGGTCGAGAAACGGT<br>GATGCAAATGACGTCACGACACACGGCCGACGGTCGCCGCGGAGGCGTGGCCTA<br>GCCCGGAAGCAAGTAGCGGGGCTGATGACGTATAAAAAAGCGGACTTTAGACC<br>CGGAAACGGACGATTTTCCCGCGGCCACGCCCGGATATGAGGTAATTCTGGGCG<br>GATGCAAGTGAAATTGGGTCATTTTGGCGCGAAAACTGAATGAGGAAGTGAAAA<br>GTGAAAAATACCGGTCCCGCCCAGGGCGGAATATTTACCGAGGGCCGAGAGACT<br>TTGACCGATTACGTGGGGGTTTCGATTGCGGTGTTTTTTTCGCGAATTTCCGCGTC<br>CGTGTCAAAGTCCGGTGTTTATGTCACAGATCAGCTGATCCACAGGGTATTTAAA<br>CCAGTCGAGCCCGTCAAGAGGCCACTCTTGAGTGCCAGCGAGTAGAGATTTCTC<br>TGAGCTCCGCTCCCAGAGTGTGAGAAAAATGAGACACCTGCGCCTCCTGCCTGG<br>AACTGTGCCCTTGGACATGGCCGCATTATTGCTGGATGACTTTGTGAGTACAGTA<br>TTGGAGGATGAACTGCAACCAACTCCGTTCGAGCTGGGACCCACACTTCAGGAC<br>CTCTATGATTTGGAGGTAGATGCCCAGGAGGACGACCCGAACGAAGATGCTGTG<br>AATTTAATATTTCCAGAATCTCTGATTCTTCAGGCTGACATAGACAGCGAAGCTC<br>TACCTACTCCACTTCATACTCCAACTCTGTCACCCATACCTGAATTGGAAGAGGA<br>GGACGAGTTAGACCTCCGGTGTTATGAGGAAGGTTTTCCTCCCAGCGATTCAGA<br>GGACGAACAGGGTGAGCAGAGCATGGCCTCTAATTTCAGACTATGCTTGTGTGGT<br>TGTGGAAGAGCATTTTGTGTTGGACAATCCTGAGGTGCCGGGGAAGGCTGTAG<br>ATCCTGCCAATATCACCGGGATCAGACCGGAGACCCTAACGCCTCCTGCGCTCT<br>GTGTTACATGAAAAAGACTTTCAGCTTTATTTACAGTAAGTGGAGTGAATGTGA<br>GAGAGGCTGAGTGCTTAACACATATCTGTGATGCTTGAACAGCTGTGCTAAGTG<br>TGGTTTATTTTTGTTACTAGGTCCGGTGTCAGAGGATGAGTCATCGCCCTCAGAA |

TABLE 7-continued

Nucleic Acid Sequences of Vectors

SEQ ID NO Sequence

```
GACGACCACCCGTCTCCCCCCGATCTCACAGATGACACGCCCCTGCAAGTGATC
AGACCCACCCCAGTCAGACTCAGTGGCGAGAGGCGAATGGCTGTTGACAAAATT
GAGGACTTGTTGCAGGACATGGGTGGGGATGAACCTTTGGACCTGAGCTTGAAA
CGCCCCAGGAACTAGGCGCAGTTGCGTTTAGTCATGTGTAAATAAAGTTGTACA
ATAAAAGTATATGTGACGCATGCAAGGTGTGGTTTATGACTCATGGGCGGGGCT
TAATCCTATATAAGTGCTAACACCTGGGCACTCAGGCACAGACCTTCAGGGAGC
TCCTGATGGAGGTGTGGACTATCCTTGGAGACTTTAACAAGACACGCCGGCTTGT
AGAGGATAGTTCAGACGGGTGCTCCGGGTTCTGGAGACACTGGTTTGGAACTCC
TCTATCTCGCCTGGTGTACACAGTTAAGAAGGATTATAACGAGGAATTTGAAAA
TCTTTTTGCCGACTGCTCTGGCCTGCTTGATTCTTTGAATTTTGGCCACCAGTCCC
TTTTCCAGGAAAGGGTCCTCCACAGCCTTGATTTTTCCAGCCCAGGGCGCACTAC
AGCCGGGGTTGCTTTTGTGGTTTTTCTGGTTGACAAATGGAGCCAGAACACCCAA
CTGAGCAGGGGCTACATTCTGGACTTCGCGGCCATGCACCTGTGGAGGGCCTGG
GTCAGGCAGCGGGGACAGAGAATCTTGAACTACTGGCTTCTACAGCCAGCAGCT
CCGGGTCTTCTTCGTCTACACAGACAAACATCCATGTTGGAGGAAGAAATGAGG
CAGGCCATGTACGAGAACCCGAGGAGCGGCCTGGACCCTCCGTCGGAAGAGGA
GCTGGATTGAATCAGGTATCCAGCCTGTACCCAGAGCTTAGCAGGGTGCTGACA
TCCATGGCCAGGGGAGTGAAGAGGGAGAGGAGCGATGGGGGCAATACCGGGAT
GATGACAGAGCTGACGGCCAGTCTGATGAATCGCAAGCGCCCAGAGCGCATTAC
CTGGCACGAGCTACAGCAGGAGTGCAGGGATGAGATAGGCCTGATGCAGGATA
AATATGGCCTGGAGCAGATAAAAACCCACTGGTTGAACCCAGATGAGGATTGGG
AGGAGGCCATTAAGAAATATGCCAAGATAGCCCTGCGCCCAGATTGCAAGTACA
GGGTGACCAAGACCGTGAATATCAGACATGCCTGCTACATCTCAGGGAACGGGG
CAGAGGTGGTCATCGATACCCTGGACAAGGCCGCCTTCAGGTGTTGCATGATGG
GAATGAGAGCCGGAGTGATGAATATGAATTCCATGATCTTCATGAACATGAAGT
TCAATGGAGAGAAGTTTAATGGGGTGATGTTCATGGCCAACAGCCACATGACCC
TGCACGGATGCAGTTTCTTCGGCTTCAACAATATGTGTGCCGAGGTGTGGGCGC
TGCTAAGATCAGGGGATGTAAGTTTTATGGCTGCTGGATGGGCGTGGTCGGAAG
ACCCAAGAGCGAGATGTCTGTGAAGCAGTGTGTGTTTGAGAAATGCTACCTGGG
AGTCTCTACCGAGGGCAATGCTAGAGTGAGACATTGCTCTTCCTTGGAGACGGG
CTGCTTCTGCCTGGTGAAGGGCACAGCCTCTCTGAAGCATAATATGGTGAAGGG
CTGCACGGATGAGCGCATGTACAACATGCTGACCTGCGACTCGGGGGTCTGTCA
TATCCTGAAGAACATCCATGTGACCTCCCACCCCAGAAAGAAGTGGCCAGTGTT
TGAGAATAACCTGCTGATCAAGTGCCATATGCACCTGGGTGCCAGAAGGGGCAC
CTTCCAGCCGTACCAGTGCAACTTTAGCCAGACCAAGCTGCTGTTGGAGAACGA
TGCCTTCTCCAGGGTGAACCTGAACGGCATCTTTGACATGGATGTCTCGGTGTAC
AAGATCCTGAGATACGATGAGACCAAGTCCAGGGTGCGCGCTTGCGAGTGCGGG
GGCAGACACACCAGGATGCAGCCAGTGGCCCTGGATGTGACCGAGGAGCTGAG
ACCAGACCACCTGGTGATGGCCTGTACCGGGACCGAGTTCAGCTCCAGTGGGGA
GGACACAGATTAGAGGTAGGTTTGAGTAGTGGGCGTGGCTAAGGTGACTATAAA
GGCGGGTGTCTTACGAGGGTCTTTTTGCTTTTCTGCAGACATCATGAACGGGACC
GGCGGGGCCTTCGAAGGGGGCTTTTTAGCCCTTTATTTGACAACCCGCCTGCCGG
GATGGGCCGGAGTTCGTCAGAATGTGATGGGATCGACGGTGGACGGGCGCCCAG
TGCTTCCAGCAAATTCCTCGACCATGACCTACGCGACCGTGGGGAACTCGTCGCT
TGACAGCACCGCCGCAGCCGCGGCAGCCGCAGCCGCCATGACAGCGACGAGAC
TGGCCTCGAGCTACATGCCCAGCAGCAGCAGTAGCCCCTCTGTGCCCAGTTCCAT
CATCGCCGAGGAGAAACTGCTGGCCCTGCTGGCCGAGCTGGAAGCCCTGAGCCG
CCAGCTGGCCGCACTGACCCAGCAGGTGTCCGAGCTCCGCAACAGCAGCAGCA
AAATAAATGATTCAATAAACACAGATTCTGATTCAAACAGCAAAGCATCTTTAT
TTATTTTTTCGCGCGCGGTAGGCCCTGGTCCACCTCTCCCGATCATTGAGAGTGC
GGTGGATTTTTTCCAGGACCCGGTAGAGGTGGGATTGGATGTTGAGGTACATGG
GCATGAGCCCGTCCCGGGGGTGGAGGTAACACCACTGCATGGCCTCGTGCTCTG
GGGTCGTGTTGTAGATGATCCAGTCATAGCAGGGGCGCTGGGCGTGGTGCTGGA
TGATGTCCTTGAGGAGGAGACTAATGGCCACGGGGAGCCCCTTGGTGTAGGTGT
TGGCGAAGCGGTTGAGCTGGGAGGGATGCATGCGGGGGGAGATGATGTGCAGT
TTGGCCTGGATCTTGAGGTTGGCGATGTTGCCACCCAGATCCCGCCGGGGGTTCA
TGTTGTGCAGGACCACCAGGACGGTGTAGCCCGTGCACTTGGGGAACTTGTCAT
GCAACTTGGAAGGGAATGCGTGGAAGAATTTGGAGACGCCCTTGTGCCCGCCCA
GGTTTTCCATGCACTCATCCATGATGATGGCGATGGGCCCGTGGGCTGCGGCTTT
GGCAAAGACGTTTCTGGGGTCAGAGACATCGTAATTATGCTCCTGGGTGAGATC
ATCATAAGACATTTTAATGAATTTGGGCGGAGGGTGCCAGATTGGGGACGAT
CGTTCCCTCGGGCCCCGGGGCAAAGTTCCCCTCGCAGATCTGCATCTCCCAGGCT
TTCATCTCGGAGGGGGGGATCATGTCCACCTGCGGGGCGATGAAAAAAACGGTT
TCCGGGGCGGGGGTGATGAGCTGCGAGGAGAGCAGGTTTCTCAACAGCTGGGAC
TTGCCGCACCCGGTCGGGCCGTAGATGACCCCGATGACGGGTTGCAGGTGGTAG
TTCAAGGAGATGCAGCTGCCGTCGTCCCGGAGGAGGGGGCCACCTCGTTGAGC
ATGTCCCTGACTTGGAGGTTTTCCCGGACGAGCTCGCCGAGAAGGCGTCCCCG
CCCAGCGAGAGCAGCTCTTGCAGGGAAGCAAAGTTTTTCAGGGGCTTGAGCCCG
TCGGCCATGGGCATCTTGGCGAGGGTCTGCGAGAGGAGCTCGAGGCGGTCCCAG
AGCTCGGTGACGTGCTCTACGGCATCTCGATCCAGCAGACTTCCTCGTTTCGGGG
GTTGGGACGACTGCGACTGTAGGGCACAGAGACGATGGGCGTCCAGCGCTGCAG
CGTCATGTCCTTCCATGGTCTCAGGGTCCGCGTGAGCGTGGTCTCTGTCACGGTG
AAGGGGTGGGCCCCGGGCTGGGCGCTTGCAAGGGTGCGCTTGAGACTCATCCTG
CTGGTGCTGAAACGGGCACGGTCTTCGCCCTGCGCGTCGGCGAGATAGCAGTTG
ACCATGAGCTTGTAGTTAAGGGCCTCGGCGGCGTGGCCCTTGGCACGGAGCTTG
CCCTTGGAAGAGCGCCCGCAGGCGGGACAGAGGAGGGATTGCAGGGCGTAGAG
```

TABLE 7-continued

Nucleic Acid Sequences of Vectors

SEQ ID NO Sequence

```
CTTGGGTGCTAGAAAGACGGACTCGGGGGCGAAAGCATCCGCTCCGCAGTGGGC
GCAGACGGTCTCGCACTCGACTAGCCAGGTGAGCTCGGGCTGCTCGGGGTCAAA
AACCAGTTTTCCACCGTTCTTTTTGATGCGCTTCTTACCTCGCGTCTCCATGAGTC
TGTGTCCGCGCTCGGTGACAAACAGGCTGTCTGTGTCCCCGTAGACGGACTTGAT
GAGCCTGTCCTGCAGGGGCGTCCCGCGGTCCTCCTCGTAGAGAAACTCGGACCA
CTCTGAGACAAAGGCGCGCGTCCACGCCAAGACAAAGGAGGCCACGTGCGAGG
GGTAGCGGTCGTTGTCCACCAGGGGGTCCACTTTTTCCACGGTATGCAGACACAT
GTCCCCCTCCTCCGCATCCAAGAAGGTGATTGGCTTGTAGGTGTAGGCCACGTGA
CCGGGGGTCCCAGACGGGGGGGTATAAAAGGGGGCGGGTCTGTGCTCGTCCTCA
CTCTCTTCCGCGTCGCTGTCCACGAGCGCCAGCTGTTGGGGTAGGTATTCCCTCT
CGAGAGCGGGCATGACCTCGGCACTCAGGTTGTCAGTTTCTAGAAACGAGGAGG
ATTTGATGTTGGCTTGCCCTGCCGCGATGCTTTTTAGGAGACTTTCATCCATCTGG
TCAGAAAAGACTATTTTTTTATTGTCAAGCTTGGTGGCGAAGGAGCCATAGAGG
GCGTTGGAGAGAAGCTTGGCGATGGATCTCATGGTCTGATTTTTGTCACGGTCGG
CGCGCTCCTTGGCCGCGATGTTAAGCTGGACATACTCGCGCGCGACGCACTTCCA
TTCGGGGAAGATGGTGGTGCGCTCGTCGGCACGATCCTGACGCGCCAGCCGCG
GTTATGCAGGGTGACCAGGTCCACGCTGGTGGCCACCTCGCCTCGCAGGGGCTC
GTTGGTCCAGCAGAGTCTGCCGCCCTTGCGCGAGCAGAAAGGGGGCAGCACATC
AAGCAGGTGCTCGTCAGGGGGGTCCGCATCGATGGTGAAGATGCCTGGACAGAG
TTCCTTGTCAAAATAGTCTATTTTTGAGGATGCATCATCTAAGGCCATCTGCCAC
TCGCGGGCGGCCATTGCTCGCTCGTAGGGGTTGAGGGGCGGACCCCAGGGCATG
GGATGCGTGAGGGCGGAGGCGTACATGCCGCAGATGTCATAGACATAGATGGG
CTCCGAGAGGATGCCGATGTATGTGGGATAACAGCGCCCCCCGCGGATGCTGGC
GCGCACATAGTCATACAACTCGTGCGAGGGGGCCAAGAAGGCGGGGCCGAGAT
TGGTCCGCTGGGGCTGCTCGGCGCGGAAGACGATCTGGCGAAAGATGGCATGCG
AGTTTGAGGAGATGGTGGGCCGTTGGAAGATGTTAAAGTGGGCGTGCGGCAGGC
GGACCGAGTCGCGGATGAAGTGCGCGTAGGAGTCTTGCAGCTTGGCGACGAGCT
CGGCGGTGACGAGGACGTCCATGGCGCAGTAGTCCAGCGTTTCGCGGATGATGT
CATAACCCGTCTCTCCTTTCTTCTCCCATAGCTCGCGGTTGAGGGCGTACTCCTCG
TCATCCTTCCAGTACTCCCGGAGCGGGAATCCTCGATCGTCCGCACGGTAAGAG
CCCAGCATGTAGAAATGGTTCACGGCCTTGTAGGGACAGCAGCCCTTCTCCACG
GGGAGAGCGTAAGCTTGAGCGGCCTTGCGGAGCGAGGTGTGCGTCAGGGCGAA
GGTGTCCCTGACCATGACTTTCAAGAACTGGTACTTGAAATCCGAGTCGTCGCAG
CCGCCGTGCTCCCAGAGCTCGAAATCGGTGCGCTTCTTCGAGAGGGGGTTAGGC
AGAGCGAAAGTGACGTCATTGAAGAGAATCTTGCCTGCTCGCGGCATGAAATTG
CGGGTTATGCGGAAAGGGCCAGGCACGGAGGCTCGGTTGTTGATGACCTGGGCG
GCGAGGACGATCTCGTCGAAGCCGTTAATGTTGTGCCCGACGATGTAGAGTTCC
ATGAATCGCGGGCGGCCTTTGATGTGCGGCAGCTTTTTGAGCTCCTCGTAGGTGA
GGTCCTCGGGGCATTGCAGGCCGTGCTGCTCTAGCGCCCACTCCTGGAGATGTG
GGTTGGCTTGCATGAAGGAAGCCCAGAGCTCGCGGGCCATGAGGGTCTGGAGCT
CGTCGCGAAAGAGGCGGAACTGCTGGCCTACGGCCATCTTTTCGGGGGTGACGC
AGTAGAAGGTGAGGGGGTCCCGCTCCCAGCGATCCCAGCGTAAGCGCGCGGCG
AGATCGCGAGCGAGGGCGACCAGCTCGGGGTCACCCGAGAATTTCATGACCAGC
ATGAAGGGGACGAGCTGCTTGCCGAAGGACCCCATCCAGGTGTAGGTTTCTACA
TCGTAGGTGACAAAGAGCCGCTCCGTGCGAGGATGAGAGCCGATTGGGAAGAA
CTGGATTTCCTGCCACCAGTTGGACGAGTGGCTGTTGATGTGATGAAAGTAGAA
ATCCCGCCGGCGAACCGAGCACTCGTGCTGATGCTTGTAAAAGCGTCCGCAGTA
CTCGCAGCGCTGCACGGGCTGTACCTCATCCACGAGATACACAGCGCGTCCCTT
GAGGAGGAACTTCAGGAGTGGCGGCCCTGGCTGGTGGTTTTCATGTTCGCCTGC
GTGGGACTCACCCTGGGGCTCCTCGAGGACGGAGAGGCTGACGAGCCCGCGCGG
GAGCCAGGTCCAGATCTCGGCGCGGCGGGGGCGGAGAGCGAAGACGAGGGCGC
GCAGTTGGGAGCTGTCCATGGTGTCGCGGAGATCCAGGTCCGGGGGCAGGGTTC
TGAGGTTGACCTCGTAGAGGCGGGTGAGGGCGTGCTTGAGATGCAGATGGTACT
TGATTTCTACGGGTGAGTTGGTGGCCGTGTCCACGCATTGATGAGCCCGTAGCT
GCGCGGGGCCACGACCGTGCCGCGGTGCGCTTTTAGAAGCGGTGTCGCGGACGC
GCTCCCGGCGGCAGCGGCGGTTCCGGCCCCGGGCAGGGGCGGCAGAGGCAC
GTCGGCGTGGCGCTCGGGCAGGTCCCGGTGCTGCGCCCTGAGAGCGCTGGCGTG
CGCGACGACGCGGCGGTTGACATCCTGGATCTGCCGCCTCTGCGTGAAGACCAC
TGGCCCCGTGACTTTGAACCTGAAAGACAGTTCAACAGAATCAATCTCGGCGTC
ATTGACGGCGGCCTGACGCAGGATCTCTTGCACGTCGCCCGAGTTGTCCTGGTAG
GCGATTTCGGACATGAACTGCTCGATCTCCTCCTCCTGGAGATCGCCGCGGCCCG
CGCGCTCGACGTGGCGGCGAGGTCATTCGAGATGCGACCCATGAGCTGCGAGA
AGGCGCCCAGGCCGCTCTCGTTCCAGACGCGGCTGTAGACCACGTCCCCGTCGG
CGTCGCGCGCGCGCATGACCACCTGCGCGAGGTTGAGCTCCACGTGCCGCGCGA
AGACGGCGTAGTTGCGCAGGCGCTGGAAAAGGTAGTTGAGGGTGGTGGCGATGT
GCTCGGTGACGAAGAAGTACATGATCCAGCGGCGCAGGGGCATTTCGCTGATGT
CGCCGATGGCCTCCAGCCTTTCCATGGCCTCGTAGAAATCCACGGCGAAGTTGA
AAAACTGGGCGTTGCGGGCCGAGACCGTGAGCTCGTCTTCCAGGAGCCTGATGA
GCTCGGCGATGGTGGCGCGTACCTCGCGCTCGAAATCCCGGGGCCTCCTCCTC
TTCCTCTTCTTCCATGACGACCTCTTCTTCTATTTCTTCCTCTGGGGCGGTGGTG
GTGGCGGGGCCCGACGACGACGGCGACGCACCGGGAGACGGTCGACGAAGCGC
TCGATCATCTCCCCGCGGCGGCGACGCATGGTCTCGGTGACGGCGCGACCCCGT
TCGCGAGGACGCAGCGTGAAGACGCCGCCGGTCATCTCCCGGTAATGGGCGGG
TCCCCGTTGGGCAGCGAGAGGGCGCTGACGATGCATCTTATCAATTGCGGTGTA
GGGGACGTGAGTGCGTCGAGATCGACCGGATCGGAGAATCTTTCGAGGAAAGC
GTCTAGCCAATCGCAGTCGCAAGGTAAGCTCAAACACGTAGCAGCCCTGTGGAC
```

TABLE 7-continued

Nucleic Acid Sequences of Vectors

SEQ ID NO Sequence

GCTGTTAGAATTGCGGTTGCTGATGATGTAATTGAAGTAGGCGTTTTTGAGGCGG
CGGATGGTGGCGAGGAGGACCAGGTCCTTGGGTCCCGCTTGCTGGATGCGGAGC
CGCTCGGCCATGCCCCAGGCCTGGCCCTGACACCGGCTCAGGTTCTTGTAGTAGT
CATGCATGAGCCTTTCAATGTCATCACTGGCGGAGGCGGAGTCTTCCATGCGGGT
GACCCCGACGCCCCTGAGCGGCTGCACGAGCGCCAGGTCGGCGACGACGCGCTC
GGCGAGGATGGCCTGTTGCACGCGGGTGAGGGTGTCCTGGAAGTCGTCCATGTC
GACGAAGCGGTGGTAGGCCCCTGTGTTGATGGTGTAAGTGCAGTTGGCCATAAG
CGACCAGTTAACGGTCTGCAGGCCGGGCTGCACGACCTCGGAGTACCTGAGCCG
CGAGAAGGCGCGCGAGTCGAAGACGTAGTCGTTGCAGGTGCGCACGAGGTACT
GGTATCCGACTAGGAAGTGCGGCGGCGGCTGGCGGTAGAGCGGCCAGCGCTGG
GTGGCCGGCGCGCCCGGGGCCAGATCCTCGAGCATGAGGCGGTGGTAGCCGTAG
AGGTAGCGGGACATCCAGGTGATGCCGGCGGCGGTGGTGGAGGCGCGCGGGAA
CTCGCGGACGCGGTTCCAGATGTTGCGCAGCGGCAGGAAATAGTCCATGGTCGG
CACGGTCTGGCCGGTGAGACGCGCGCAGTCATTGACGCTCTAGAGGCAAAAACG
AAAGCGGTTGAGCGGGCTCTTCCTCCGTAGCCTGGCGGAACGCAAACGGGTTAG
GCCGCGTGTGTACCCCGGTTCGAGTCCCCTCGAATCAGGCTGGAGCCGCGACTA
ACGTGGTATTGGCACTCCCGTCTCGACCCGAGCCCGATAGCCGCCAGGATACGG
CGGAGAGCCCTTTTTGCCGGCCGAGTGGGGTCGCTAGACTTGAAAGCGGCAGAA
AATCCCGCCGGGTAGTGGCTCGCGCCCGTAGTCTGGAGAAGCATCGCCAGGGTT
GAGTCGCGGCAGAACCCGGTTCGCGGACGGCCGCGGCGAGCGGGACTTGGTCAC
CCCGCCGATTTAAAGACCCACAGCCAGCCGACTCTCCAGTTACGGGAGCGAGCC
CCCTTTTTTCTTTTTGCCAGATGCATCCCGTCCTGCGCCAAATGCGTCCCACCCCC
CCGGCGACCACCGCGACCGCGGCCGTAGCAGGCGCCGGCGCTAGCCAGCCACA
GCCACAGACAGAGATGGACTTGGAAGAGGGCGAAGGGCTGGCGAGACTTGGGG
CGCCGTCCCCGGAGCGACACCCCCGCGTGCAGCTGCAGAAGGACGTGCGCCGG
CGTACGTGCCTCCGCAGAACCTGTTCAGGGACCGCAGCGGGGAGGAGCCCGAGG
AGATGCGCGACTGCCGTTTTCGGGCGGGCAGGGAGCTGCGCGAGGGCCTGGACC
GCCAGCGCGTGCTGCGCGACGAGGATTTCGAGCCGAACGAGCAGACGGGGATC
AGCCCCGCGCGCGCACGTGGCGGCGGCCAACCTGGTGACGGCCTACGAGCAG
ACGGTGAAGCAGGAGCGCAACTTCCAAAAGAGTTTCAACAACCACGTGCGCACG
CTGATCGCGCGCGAGGAGGTGGCCCTGGGCCTGATGCACCTGTGGGACCTGGCG
GAAGCCATCGTGCAGAATCCGGACAGCAAGCCTCTGACGGCGCAGCTGTTCCTG
GTGGTGCAGCACAGCAGGGACAACGAGGCGTTCAGGGAGGCGCTGCTGAACAT
CGCCGAGCCCGAGGGCCGCTGGCTGCTGGAGCTGATTAACATCTTGCAGAGCAT
CGTAGTGCAGGAGCGCAGCCTGAGCCTGGCCGAGAAGGTGGCGGCGATCAACT
ACTCGGTGCTGAGCCTGGGCAAGTTTTACGCGCGCAAGATTTACAAGACGCCGT
ACGTGCCCATAGACAAGGAGGTGAAGATAGACAGCTTTTACATGCGCATGGCGC
TCAAGGTGCTGACGCTGAGCGACGACCTGGGCGTGTACCGCAACGACCGCATCC
ACAAGGCCGTGAGCACGAGCCGGCGGCGCGAGCTGAGCGACCGCGAGCTGATG
TTGAGCCTGCGCCGGGCGCTGGTAGGGGGCGCCGCTGGCGGCGAGGAGTCCTAC
TTCGACATGGGGGCGGACCTGCATTGGCAGCCGAGCCGGCGCGCCTTGGAGGCC
GCCTACGGTCCAGAGGACTTGGATGAGGATGAGGAAGAGGAGGAGGATGCACC
CGCTGCGGGGTACTGACGCCTCCGTGATGTGTTTTTAGATGTCCCAGCAAGCCCC
GGACCCCGCCATAAGGGCGGCGCTGCAAAGCCAGCCGTCCGGTCTAGCATCGGA
CGACTGGGAGGCCGCGATGCAACGCATCATGGCCCTGACGACCCGCAATCCCGA
GTCCTTTAGACAACAGCCGCAGGCCAACAGACTCTCGGCCATTCTGGAGGCGGT
GGTCCCCTCTCGGACCAACCCCACGCACGAGAAGGTGCTGGCGATCGTGAACGC
GCTGGCGGAGAACAAGGCCATCCGTCCCGACGAGGCCGGGCTGGTGTACAACGC
CCTGCTGGAGCGCGTGGGCCGCTACAACAGCACGAACGTGCAGTCCAACCTGGA
CCGGCTGGTGACGGACGTGCGCGAGGCCGTGGCGCAGCGCGAGCGGTTCAAGA
ACGAGGGCCTGGGCTCGCTGGTGGCACTGAACGCCTTCCTGGCGACGCAGCCGG
CGAACGTGCCGCGCGGGCAGGACGATTACACCAACTTTATCAGCGCGCTGCGGC
TGATGGTGACCGAGGTGCCCCAGAGCGAGGTGTACCAGTCTGGCCCGGACTACT
TTTTCCAGACGAGCCGGCAGGGCCTGCAGACGGTGAACCTGAGCCAGGCTTTCA
AGAACCTGCGCGGGCTGTGGGGCGTGCAGGCGCCCGTGGGCGACCGGTCGACG
GTGAGCAGCTTGCTGACGCCCAACTCGCGGCTGCTGCTGCTGATCGCGCCCT
TCACCGACAGCGGCAGCGTGAACCGCAACTCGTACCTGGGCCACCTGCTGACGC
TGTACCGCGAGGCCATAGGCCAGGCGCAGGTGGACGAGCAGACCTTCCAGGAG
ATCACGAGCGTGAGCCGCGCGCTGGGGCAGAACGACACCGACAGTCTGAGGGC
CACCCTGAACTTTTTGCTGACCAATAGACAGCAGAAGATCCCGGCGCAGTACGC
ACTGTCGGCCGAGGAGGAAAGGATCCTGAGATATGTGCAGCAGAGCGTAGGGC
TGTTCCTGATGCAGGAGGGCGCCACCCCCAGCGCCGCGCTGGACATGACCGCGC
GCAACATGGAACCTAGCATGTACGCCGCCAACCGGCCGTTCATCAATAAGCTGA
TGGACTACCTGCACCGCGCGGCGGCCATGAACACGGACTACTTTACTAATGCTA
TACTAAACCCGCACTGGCTCCCGCCGCCGGGGTTCTACACGGGCGAGTACGACA
TGCCCGACCCCAACGACGGGTTCCTGTGGGACGACGTGGACAGCGCGGTGTTCT
CCCCGACCTTGCAAAAGCGCAGGAGGCGGTGCGCACGCCCGCGAGCGAGGGC
GCGGTGGGTCGCAGCCCCTTTCCTAGCTTAGGGAGTTTGCATAGCTTGCCGGGCT
CGGTGAACAGCGGCAGGGTGAGCCGGCCGCGCTTGCTGGGCAGGACGAGTAC
CTGAACGACTCGCTGCTGCAGCCGCCACGGGTCAAGAACGCCATGGCCAATAAC
GGGATAGAGTCTGGTGGACAAACTGAACCGCTGGAAGACCTACGCTCAGGA
CCATAGGGATGCGCCCGCGCCGCGGCGACAGCGCCACGACCGGCAGCGGGGCC
TGGTGTGGGACGACGAGGACTCGGCCGACGATAGCAGCGTGTTGGACTTGGGCG
GGAGCGGTGGGGCCAACCCGTTCGCGCATCTGCAGCCCAAACTGGGGCGTCGGA
TGTTTTGAAATGCAAAATAAAACTCACCAAGGCCATAGCGTGCGTTCTCTTCCTT
GTTAGAGATGAGGCGCGCGGTGGTGTCTTCCTCTCCTCCTCCCTCGTACGAGAGC

TABLE 7-continued

Nucleic Acid Sequences of Vectors

SEQ ID NO Sequence

```
GTGATGGCGCAGGCGACCCTGGAGGTTCCGTTTGTGCCTCCGCGGTATATGGCTC
CTACGGAGGGCAGAAACAGCATTCGTTACTCGGAGCTGGCTCCGCAGTACGACA
CCACTCGCGTGTACTTGGTGGACAACAAGTCGGCGGACATCGCTTCCCTGAACT
ACCAAAACGACCACAGCAACTTCCTGACCACGGTGGTGCAGAACAACGATTTCA
CCCCCGCCGAGGCCAGCACGCAGACGATAAATTTTGACGAGCGGTCGCGGTGGG
GCGGTGATCTGAAGACCATTCTGCACACCAACATGCCCAATGTGAACGAGTACA
TGTTCACCAGCAAGTTTAAGGCGCGGGTGATGGTGGCTAGAAAAAAGGCGGAA
GGGGCTGATGCAAATGATAGGAGCAAGGATATCTTAGAGTATCAGTGGTTTGAG
TTTACCCTGCCCGAGGGCAACTTTTCCGAGACCATGACCATAGACCTGATGAAC
AACGCCATCTTGGAAAACTACTTGCAAGTGGGGCGGCAGAATGGCGTGCTGGAG
AGCGATATCGGAGTCAAGTTTGACAGCAGAAATTTCAAGCTGGGCTGGGACCCG
GTGACCAAGCTGGTGATGCCAGGGGTCTACACCTACGAGGCCTTCCACCCGGAC
GTGGTACTGCTGCCGGGCTGCGGGGTGGACTTCACCGAGAGCCGCCTGAGCAAC
CTCCTGGGCATTCGCAAGAAGCAACCTTTCCAAGAAGGCTTCAGAATCATGTAT
GAGGATCTAGAAGGGGGCAACATCCCCGCCCTCCTGAATGTCAAGGAGTATCTG
AAGGATAAGGAAGAAGCTGGCACAGCAGCAGGAAAAGAAATTGAGTTGAAGGC
CATTTTGAAAGATGATTCAGACAGAAGCTACAATGTGATCGAGGGAACCACAGA
CACCCTGTACCGCAGTTGGTACCTGTCCTATACCTACGGGGATCCCGAGAAGGG
AGTGCAGTCGTGGACACTGCTCACCACTCCGGACGTCACCTGCGGCGCGGAGCA
AGTCTACTGGTCGCTGCCGGACCTCATGCAAGACCCCGTCACCTTCCGTTCTACC
CAGCAAGTCAGCAACTACCCCGTGGTCGGCGCCGAGCTCATGCCCTTCCGCGCC
AAGAGCTTTTACAACGACCTCGCCGTCTACTCCCAGCTCATCCGCAGCTACACCT
CCCTCACCCACGTCTTCAACCGCTTCCCCGACAACCAGATCCTCTGCCGGCCGCC
CGCGCCCACCATCACCACCGTTAGTGAAAACGTGCCTGCTCTCACAGATCACGG
GACGCTACCGCTGCGCAGCAGTATCCGCGGAGTCCAGCGAGTGACCGTCACTGA
CGCCCGTCGCCGCACCTGTCCCTACGTCTACAAGGCCCTGGGCATAGTCGCGCCG
CGCGTGCTTTCCAGTCGCACCTTCTAAAAAATGTCTATTCTCATCTCGCCCAGCA
ATAACACCGGCTGGGGTCTTACTAGGCCCAGCACCATGTACGGAGGAGCCAAGA
AGCGCTCCCAGCAGCACCCCGTCCGCGTCCGCGGCCACTTCCGCGCTCCCTGGG
GCGCTTACAAGCGCGGGCGGACTTCCACCGCCGTGCGCACCACCGTCGACGACG
TTATCGACTCGGTGGTCGCCGACGCGCGCAACTACACCCCCGCCCCCTCCACCGT
GGACGCGGTCATCGACAGCGTGGTGGCCGACGCGCGCGACTATGCCAGACGCAA
GAGCCGGCGGCGACGGATCGCCAGGCGCCACCGGAGCACGCCCGCCATGCGCG
CCGCCCGAGCTCTGCTGCCGCGCGCCAGACGCACGGGTCGCCGGGCCATGATGC
GAGCGCGCGCCGCGCTGCCACTGCACCCACCCCCGCAGGCAGGACTCGCAGAC
GAGCGGCCGCCGCCGCCGCCGGCCATCTCTAGCATGACCAGACCCAGGCGCG
GAAACGTGTACTGGGTGCGCGACTCCGTCACGGGCGTGCGCGTGCCCGTGCGCA
CCCGTCCTCCTCGTCCCTGATCTAATGCTTGTGTCCTCCCCCGCAAGCGACGATG
TCAAAGCGCAAAATCAAGGAGGAGATGCTCCAGGTCGTCGCCCCGGAGATTTAC
GGACCCCCGGACCAGAAACCCCGCAAAATCAAGCGGGTTAAAAAAAAGGATGA
GGTGGACGAGGGGGCAGTAGAGTTTGTGCGCGAGTTCGCTCCGCGGCGGCGCGT
AAATTGGAAGGGGCGCAGGGTGCAGCGCGTGTTGCGGCCCGGCACGGCGGTGG
TGTTCACGCCCGGCGAGCGGTCCTCGGTCAGGAGCAAGCGTAGCTATGACGAGG
TGTACGGCGACGACGACATCCTGGACCAGGCGGCGGAGCGGGCGGGCGAGTTC
GCCTACGGGAAGCGGTCGCGCGAAGAGGAACTGATCTCGCTGCCGCTGGACGAG
AGCAACCCCACGCCGAGCCTGAAGCCCGTGACCCTGCAGCAGGTGCTGCCCCAG
GCGGTGCTGCTGCCGAGCCGAGGGGTCAAGCGCGAGGGCGAGAGCATGTACCC
GACCATGCAGATCATGGTGCCCAAGCGCAGGCGCGTGGAGGACGTGCTGGACAC
CGTGAAAATGGATGTGGAGCCCGAGGTCAAGGTGCGCCCCATCAAGCAGGTGGC
GCCGGGCCTGGGCGTGCAGACCGTGGACATTCAGATCCCCACCGACATGGATGT
CGACAAAAAACCCTCGACCAGCATCGAGGTGCAGACCGACCCCTGGCTCCCAGC
CTCCACCGCTACCGTCTACACTTCTACCGCCGCCACGGCTACCGAGCCTCCCAGG
AGGCGAAGATGGGGCGCCGCCAGCCGGCTGATGCCCAACTACGTGGTGCATCCT
TCCATCATCCCGACGCGGGCTACCGCGGCACCCGGTACTACGCCAGCCGCAGG
CGCCCAGCCGCCAAACGCCGCCGCCGCACCGCCACCCGCCGCCGTCTGGCCCCC
GCCCGCGTGCGCCGCGTAACCACGCGCCGGGGCCGCTCGCTCGTTCTGCCCACC
GTGCGCTACCACCCCAGCATCCTTTAATCCGTGTGCTGTGATACTGTTGCAGAGA
GATGGCTCTCACTTGCCGCCTGCGCATCCCCGTCCCGAATTACCGAGGAAGATCC
CGCCGCAGGAGAGGCATGGCAGGCAGCGGCCTGAACCGCCGCCGGCGGCGGGC
CATGCGCAGGCGCCTGAGTGGCGGCTTTCTGCCCGCGCTCATCCCCATAATCGCC
GCGGCCATCGGCACGATCCCGGGCATAGCTTCCGTTGCGCTGCAGGCGTCGCAG
CGCCGTTGATGTGCGAATAAAGCCTCTTTAGACTCTGACACACCTGGTCCTGTAT
ATTTTTAGAATGGAAGACATCAATTTTGCGTCCCTGGCTCCGCGGCACGGCAGCGC
GGCCGTTCATGGGCACCTGGAACGAGATCGGCACCAGCCAGCTGAACGGGGGC
GCCTTCAATTGGAGCAGTGTCTGGAGCGGGCTTAAAAATTTCGGCTCGACGCTCC
GGACCTATGGGAACAAGGCCTGGAATAGTAGCACGGGGCAGTTGTTAAGGGAA
AAGCTCAAAGACCAGAACTTCCAGCAGAAGGTGGTGGACGGGCTGGCCTCGGG
CATTAACGGGGTGGTGGACATCGCGAACCAGGCCGTGCAGCGCGAGATAAACA
GCCGCCTGGACCCGCGGCCGCCCACGGTGGTGGAGATGGAAGATGCAACTCCTC
CGCCACCAAGGGGCGAAAAGCGCCCGCGGCCTGACGCGGAGGAGACGATCCTG
CAGGTTGACGAGCCGCCATCGTACGAGGAGGCCGTCAAGGCCGGCATGCCCACC
ACGCGCATCATCGCGCCGCTGGCCACGGGTGTAATGAAACCCGCCACCCTTGAC
CTGCCTCCACCACCCACGCCCGCTCCACCGAAGGCAGCTCCGGTTGTGCAGGCC
CCCCGGTGGCGACCGCCGTGCGCCGCGTCCCCGCCCGCCGCCAGGCCCAGAAC
TGGCAGAGCACGCTGCACAGTATCGTGGGCCTGGGAGTGAAAAGTCTGAAGCGC
CGCCGATGCTATTGAGAGAGAGGAAAGAGGACACTAAAGGGAGAGCTTAACTT
```

TABLE 7-continued

Nucleic Acid Sequences of Vectors

SEQ ID NO Sequence

GTATGTGCCTTACCGCCAGAGAACGCGCGAAGATGGCCACCCCCTCGATGATGC
CGCAGTGGGCGTACATGCACATCGCCGGGCAGGACGCCTCGGAGTACCTGAGCC
CGGGTCTGGTGCAGTTTGCCCGCGCCACCGACACGTACTTCAGCCTGGGCAACA
AGTTTAGGAACCCCACGGTGGCTCCCACCCACGATGTGACCACGGACCGGTCCC
AGCGTCTGACGCTGCGCTTCGTGCCCGTGGATCGCGAGGACACCACGTACTCGT
ACAAGGCGCGCTTCACTCTGGCCGTGGGCGACAACCGGGTGCTAGACATGGCCA
GCACTTACTTTGACATCCGCGGCGTCCTGGACCGCGGTCCCAGCTTCAAACCCTA
TTCGGGCACGGCTTACAACAGCCTGGCCCCAAAAGGTGCCCCCAACTCCAGTCA
GTGGGAGCAGAAAAAAACTACTGGTGGAGGCAATGACATGGAAACGCATACTT
ATGGCGTTGCAGCCATGGGTGGAGAAGACATTACAGAAAAGGGCCTTCAAATTG
GCATTGATGAAACTAAAGAAGAAAATAACAAGATATTTGCAGACAAAACATTCC
AACCAGAACCTCAAGTGGGAGAAGAAAACTGGCAGGAAACATTTGTTTTTTATG
GCGGTAGAGCTCTTAAGAAGGACACCAAAATGAAACCATGCTATGGCTCATTTG
CCAGACCTACTAATGAAAAGGGAGGTCAGGCTAAATTTGTACTTGACCAGGAAG
GAAAGCCAACTAAAAATCATGATATCACAATGGCTTTCTTTGATACTCCTGGTGG
ACAATTGAATGGAAAAGATGAGCTTAAGGCAGACATTGTCATGTACACTGAAAA
TGTCAACCTGGAAACACCTGACACGCATGTTGTTTACAAACCTGGAACTTCAGAT
GACAGTTCAGAAATCAATTTGGTTCAACAGTCCATGCCAAATAGACCCAACTAC
ATTGGCTTCAGGGACAACTTTGTAGGGCTCATGTATTACAACAGCACTGGCAAC
ATGGGTGTGCTGGCAGGTCAGGCCTCTCAGTTGAATGCTGTGGTGGATTTGCAA
GACAGAAACACAGAGCTATCTTACCAGCTCTTGCTAGATTCTCTGGGTGACAGA
ACCAGATACTTTAGCATGTGGAACTCTGCGGTGGACAGCTATGATCCAGATGTT
AGGATCATTGAGAATCACGGTGTGGAAGATGAACTTCCAAACTATTGCTTCCCA
TTGGATGGCGCTGGAACTAATGCAGTTTACCAAGGTGTAAAAATTACAGATGGA
AATGATGGTGATGTCAATGATGACTGGGAAAAAGACACCGCAGTATCTGAACGT
AATCAGATATGCAAGGGCAACATCTATGCCATGGAGATCAACCTCCAGGCCAAC
CTGTGGAAGAGTTTTCTGTACTCGAATGTGGCCCTGTACCTGCCCGACTCCTACA
AGTACACGCCGGCCAACGTCAAGCTGCCCGCCAACACCAACACCTACGAGTACA
TGAATGGCCGCGTGGTAGCCCCCTCGCTGGTGGACGCTTACATCAACATCGGCG
CCCGGTGGTCGCTGGACCCCATGGACAATGTCAATCCCTTCAACCACCACCGCA
ACGCGGGCCTGCGCTACCGCTCCATGCTGTTGGGCAACGGCCGCTACGTGCCCTT
CCACATCCAAGTGCCCCAAAAGTTCTTTGCCATCAAGAACCTGCTCCTGCTCCCA
GGCTCCTACACCTACGAGTGGAACTTCCGCAAGGACGTCAACATGATCTTGCAG
AGTTCTCTCGGCAACGATCTGCGCGTCGACGGCGCCTCCGTCCGCTTCGACAGCG
TCAACCTCTACGCCACCTTCTTCCCCATGGCGCACAACACTGCCTCCACCCTGGA
AGCCATGCTGCGCAACGACACCAACGATCAGTCCTTCAACGACTACCTCTCGGC
CGCCAACATGCTCTACCCCATCCCGGCCAAGGCCACCAACGTGCCCATTTCCATC
CCCTCGCGCAACTGGGCCGCCTTCCGCGGCTGGAGTTTCACCCGGCTCAAGACC
AAAGAAACTCCCTCCCTCGGTTCTGGTTTCGACCCATACTTTGTCTACTCTGGCTC
CATCCCCTATCTCGACGGGACCTTCTACCTCAACCACACCTTCAAGAAGGTCTCC
ATCATGTTCGACTCCTCGGTCAGCTGGCCCGGCAACGACCGGCTGCTCACGCCG
AACGAGTTCGAGATCAAGCGCAGCGTCGACGGGGAGGGCTACAACGTGGCCCA
ATGCAACATGACCAAGGACTGGTTCCTCGTCCAGATGCTCTCCCACTACAACATC
GGCTACCAGGGCTTCCACGTGCCCGAGGGCTACAAGGACCGCATGTACTCCTTC
TTCCGCAACTTCCAGCCCATGAGCAGGCAGGTGGTCGATGAGATCAACTACAAG
GACTACAAGGCCGTTACCCTGCCCTTCCAGCACAACAACTCGGGCTTCACCGGCT
ACCTCGCACCCACCATGCGTCAGGGGCAGCCCTACCCCGCCAACTTCCCCTACCC
GCTCATCGGCCAGACAGCCGTGCCCTCCGTCACCCAGAAAAAGTTCCTCTGCGA
CAGGGTCATGTGGCGCATCCCCTTCTCCAGCAACTTCATGTCCATGGGCGCCCTT
ACCGACCTGGGTCAGAACATGCTCTACGCCAACTCGGCCCACGCGCTCGACATG
ACCTTCGAGGTGGACCCCATGGATGAGCCCACCCTCCTCTATCTTCTCTTCGAAG
TTTTCGACGTGGTCAGAGTGCACCAACCGCACCGCGCGCGTCATCGAGGCCGTCT
ACCTGCGCACGCCCTTCTCCGCCGGCAACGCCACCACATAAGCATGAGCGGCTC
CAGCGAAAGAGAGCTCGCGGCCATCGTGCGCGACCTGGGCTGCGGGCCCTACTT
TTTGGGCACCCACGACAAGCGCTTCCCGGGCTTCCTCGCCGGCGACAAGCTGGC
CTGCGCCATCGTCAACACGGCCGGCCGCGAGACCGGGGCGTGCACTGGCTCGC
CTTCGGCTGGAACCCGCGCTCGCGCACCTGCTACATGTTCGACCCCTTTGGGTTC
TCGGACCGCCGGCTCAAGCAGATTTACAGCTTCGAGTACGAGGCCATGCTGCGC
CGCAGCGCCCTGGCCTCCTCGCCCGACCGCTGTCTCAGCCTCGAGCAGTCCACCC
AGACCGTGCAGGGGCCCGACTCCGCCGCCTGCGGACTTTTCTGTTGCATGTTCTT
GCATGCCTTCGTGCACTGGCCCGACCGACCCATGGACGGAAACCCCACCATGAA
CTTGCTGACGGGGGTGCCCAACGGCATGCTACAATCGCCACAGGTGCTGCCCAC
CCTCAGGCGCAACCAGGAGGAGCTCTACCGCTTCCTCGCGCGCACTCCCATTAC
TTTCGATCCCACCGCGCCGCCATCGAACACGCCACCGCTTTTGACAAAATGAAA
CAACTGCGTGTATCTCAATAAACAGCACTTTTATTTTACATGCACTGGAGTATAT
GCAAGTTATTTAAAAGTCGAAGGGGTTCTCGCGCTCGTCGTTGTGCGCCGCGCTG
GGGAGGGCCACGTTGCGGTACTGGAACTTGGGATACCACTTGAACTCGGGGATC
ACCAGTTTGGGCACTGGGGTCTCGGGGAAGGTCTCGCTCCACATGCGCCGGCTC
ATCTGCAGGGCGCCCAGCATGTCCGGGCGGAGATCTTGAAATCGCAGTTGGGA
CCGGTGCTCTGTGCGCGCGAGTTGCGGTACACGGGGTTGCAGCACTGGAACACC
ATCAGACTGGGGTACTTCACACTGGCCAGCACGCTCTTGTCGCTGATCTGATCCT
TGTCCAGGTCCTCGGCGTTGCTCAGGCCGAACGGGGTCATCTTGCACAGCTGGC
GGCCCAAGAAGGGCACGCTCTGAGGCTTGTGGTTACACTCGCAGTGCACGGGCA
TTAGCATCATCCCCGCGCCGCGCTGCATATTCGGGTAGAGGGCCTTGACAAAGG
CCGAGATCTGCTTGAAAGCTTGCTGGGCCTTGCTCCCTCGCTAAAAACAGCCC
GCAGCTCTTCCCGCTGAACTGGTTATTCCCGCACCCGGCATCCTGCACGCAGCAG

TABLE 7-continued

Nucleic Acid Sequences of Vectors

SEQ ID NO Sequence

```
CGCGCGTCATGGCTGGTCAGTTGCACCACGCTCCGTCCCCAGCGGTTCTGGGTCA
CCTTGGCCTTGCTGGGTTGCTCCTTCAGCGCGCGCTGCCCGTTCTCGCTGGTCAC
ATCCATCTCCACCACGTGGTCCTTGTGGATCATCACCGTTCCATGCAGACACTTG
AGCTGGCCTTCCACCTCGGTGCAGCCGTGATCCCACAGGGCGCAGCCGGTGCAC
TCCCAGTTCTTGTGCGCGATCCCGCTGTGGCTGAAGATGTAACCTTGCAACATGC
GGCCCATGATGGTGCTAAATGCTTTCTGGGTGGTGAAGGTCAGTTGCAGACCGC
GGACCTCCTCGTTCATCCAGGTCTGGCACATCTTTTGGAAGATCTCGGTCTGCTC
GGGCATGAGCTTGTAAGCATCGCGCAGGCCGCTGTCGACGCGGTAGCGTTCCAT
CAACACGTTCATGGCATCCATGCCCTTCTCCCAAGACGAGACCAGAGGCAGACT
CAGGGGGTTGCGTACGTTCAGGACACCGGGGGTCGCGGGCTCGACGATGCGTTT
TCCGTCCTTGCCTTCCTTCAACAGAACCGGCGGCTGGCTGAATCCCACTCCCACG
ATCACGGCTTCTTCCTGGGGCATCTCTTCGTCGGGGTCTACCTTGGTCACATGCTT
GGTCTTTCTGGCTTGCTTCTTTTTTGGAGGGCTGTCCACGGGGACCACGTCCTCCT
CGGAAGACCCGGAGCCCACCCGCTGATACTTTCGGCGCTTGGTGGGCAGAGGAG
GTGGCGGCGAGGGGCTCCTCTCCTGCTCCGGCGGATAGCGCGCTGAACCGTGGC
CCCGGGGCGGAGTGGCCTCTCGGTCCATGAACCGGCGCACGTCCTGACTGCCGC
CGGCCATTGTTTCCTAGGGGAAGATGGAGGAGCAGCCGCGTAAGCAGGAGCAG
GAGGAGGACTTAACCACCCACGAGCAACCCAAAATCGAGCAGGACCTGGGCTTC
GAAGAGCCGGCTCGTCTAGAACCCCCACAGGATGAACAGGAGCACGAGCAAGA
CGCAGGCCAGGAGGAGACCGACGCTGGGCTCGAGCATGGCTACCTGGGAGGAG
AGGAGGATGTGCTGCTGAAACACCTGCAGCGCCAGTCCCTCATCCTACGGGACG
CTCTGGCCGACCGGAGCGAAACCCCCCTCAGCGTCGAGGAGCTGTGTCGGGCCT
ACGAGCTCAACCTCTTCTCGCCGCGCGTGCCCCCAAACGCCAACCCAACGGCA
CCTGCGAGCCCAACCCGCGTCTCAACTTCTACCCCGTCTTTGCGGTCCCCGAGGC
CCTTGCCACCTATCACATCTTTTTCAAGAACCAAAAGATCCCCGTCTCCTGCCGC
GCCAACCGCACCCGCGCCGACGCGCTCCTAGCTCTGGGACCCGGCGCGCGCATA
CCTGATATCGCTTCCCTGGAAGAGGTGCCCAAGATCTTCGAAGGGCTCGGTCGG
GACGAGACGCGCGCGGCGAACGCTCTGAAAGAAACAGCAGAGGAAGAGGGTCA
CACTAGCGCCCTGGTAGAGTTGGAAGGCGACAACGCCAGGCTGGCAGTGCTCAA
GCGCAGCGTCGAGCTCACCCACTTCGCCTACCCCGCCGTCAACCTCCCGCCCAAG
GTCATGCGTCGCATCATGGATCAGCTTATCATGCCCCACATCGAGGCCCTCGATG
AAAGTCAGAAGCAGCGCCCCGAGGACACCCGGCCCGTGGTCAGCGACGAGCAG
CTTGCGCGCTGGCTCGGGACCCGCGACCCCCAGGCCCTGGAGCAGCGGCGCAAG
CTCATGCTGGCCGTGGTCCTGGTCACCCTCGAGCTCGAATGCATGCGCCGCTTCT
TCAGCGACCCCGAGACCCTGCGCAAGGTCGAGGAGACCCTGCACTACACTTTCA
GGCACGGTTTCGTCAGGCAGGCATGCAAGATTTCCAACGTGGAGCTGACCAACC
TGGTCTCCTGCCTGGGGATCCTGCACGAGAACCGCCTGGGGCAGACCGTGCTCC
ACTCTACCCTCAAGGGCGAGGCGCGGCGGGACTATGTCCGCGACTGCGTCTTTCT
CTTTCTCTGCCACACATGGCAGTCGGCCATGGGCGTGTGGCAGCAGTGTCTCGAG
GACGAGAACCTGAAGGAGCTGGACAATCTTCTTGCTAGAAATCTTAAAAAGCTG
TGGACGGGCTTCGACGAGCGCACCGTCGCCTCGGACCTGGCCGAGATCGTGTTC
CCCGAGCGCCTGAGGCAGACACTGAAAGGCGGGCTGCCCGACTTCATGAGCCAG
AGCATGTTGCAAAACTACCGCACTTTCATTCTCGAGCGATCGGGGATGCTGCCCG
CCACCTGCAACGCTTTCCCCTCCGACTTTGTCCCGCTGATCTACCGCGAGTGTCC
CCCGCCGCTGTGGAGCCACTGCTATCTCTTGCAGCTGGCCAACTACATCGCCTAC
CACTCGGACGTGATCGAGGACGTGAGCGGCGAGGGGCTTCTCGAGTGCCACTGC
CGCTGCAACCTGTGCTCCCCGCACCGCTCTCTGGTCTGCAACCCCCCAGCTCCTAA
GCGAGACCCAGGTCATCGGTACCTTCGAGCTGCAAGGTCCGCAGGAGTCCACCG
CTCCGCTGAAACTCACGCCGGGGTTGTGGACTTCCGCGTACCTGCGCAAATTTGT
ACCCGAGGACTACCACGCCCATGAGATAAAGTTCTTCGAGGACCAATCGCGCCC
TCAGCACGCGGATCTCACGGCCTGCGTCATCACCCAGGGCGCGATCCTCGCCCA
ATTGCATGCCATCCAAAAATCCCGCCAAGAGTTTCTTCTGAAAAAGGGTAGAGG
GGTCTACCTGGACCCCCAGACGGGCGAGGTGCTCAACCCGGGTCTCCCCCAGCA
TGCCGAGGAAGAAGCAGGAGCCGCTAGTGGAGGAGATGGAAGAAGAATGGGAC
AGCCAGGCAGAGGAGGACGAATGGGAGGAGGAGACAGAGGAGGAAGAATTGG
AAGAGGTGGAAGAGGAGCAGGCAACAGAGCAGCCCGTCGCCGCACCATCCGCG
CCGGCAGCCCCGCCGGTCACGGATACAACCTCCGCAGCTCCGGCCAAGCCTCCT
CGTAGATGGGATCGAGTGAAGGGCGACGGTAAGCACGAGCGGCAGGGCTACCG
ATCATGGAGGGCCCACAAAGCCGCGATCATCGCCTGCTTGCAAGACTGCGGGGG
GAACATCGCTTTCGCCCGCCGCTACCTGCTCTTCCACCGCGGGGTGAACATCCCC
CGCAACGTGTTGCATTACTACCGTCACCTTCACAGCTAAGAAAAAGCAAGTCAG
AGGAGTCGCGGAGGAGGAGGAGGAGGCCTGAGGATCGCGGCGAACGAGCCCT
TGACCACCAGGGAGCTGAGGAACCGGATCTTCCCCACTCTTTATGCCATTTTTCA
GCAGAGTCGAGGTCAGCAGCAAGAGCTCAAAGTAAAAAATCGGTCTCTGCGCTC
GCTCACCCGCAGTTGCTTGTACCACAAAAACGAAGATCAGCTGCAGCGCACTCT
CGAAGACGCCGAGGCTCTGTTCCACAAGTACTGCGCGCTCACTCTTAAAGACTA
AGGCGCGCCCACCCGGAAAAAAGGCGGGAATTACCTCATCGCCACCATGAGCA
AGGAGATTCCCACCCCTTACATGTGGAGCTATCAGCCCCAGATGGGCCTGGCCG
CGGGCGCCTCCCAGGACTACTCCACCCGCATGAACTGGCTCAGTGCCGGCCCCT
CGATGATCTCACGGGTCAACGGGGTCCGCAGTCATCGAAACCAGATATTGTTGG
AGCAGGCGGCGGTCACCTCCACGCCCAGGGCAAAGCTCAACCCGCGTAATTGCC
CCTCCACCCTGGTGTATCAGGAAATCCCCGGGCCGACTACCGTACTACTTCCGCG
TGACGCACTGGCCAAGTCCGCATGACTAACTCAGGTGTCCAGCTGGCCGGCGG
CGCTTCCCGGTGCCCGCTCCGCCCACAATGGGTATAAAAACCCTGGTGATCCG
AGGCAGAGGCACACAGCTCAACGACGAGTTGGTGAGCTCTTCGATCGGTCTGCG
ACCGGACGGAGTGTTCCAACTAGCCGGAGCCGGGAGATCGTCCTTCACTCCCAA
```

TABLE 7-continued

Nucleic Acid Sequences of Vectors

SEQ ID NO Sequence

CCAGGCCTACCTGACCTTGCAGAGCAGCTCTTCGGAGCCTCGCTCCGGAGGCAT
CGGAACCCTCCAGTTCGTGGAGGAGTTTGTGCCCTCGGTCTACTTCAACCCCTTC
TCGGGATCGCCAGGCCTCTACCCGGACGAGTTCATACCGAACTTCGACGCAGTG
AGAGAAGCGGTGGACGGCTACGACTGAATGTCCCATGGTGACTCGGCTGAGCTC
GCTCGGTTGAGGCATCTGGACCACTGCCGCCGCCTGCGCTGCTTTGCCCGGGAG
AGCTGCGGACTCATCTACTTTGAGTTTCCCGAGGAGCACCCCAACGGCCCTGCAC
ACGGAGTGCGGATCACCGTAGAGGGCACCACCGAGTCTCACCTGGTCAGGTTCT
TCACCCAGCAACCCTTCCTGGTCGAGCGGGACCGGGGCGCCACCACCTACACCG
TCTACTGCATCTGTCCTACCCCGAAGTTGCATGAGAATTTTTGCTGTACTCTTTGT
GGTGAGTTTAATAAAAGCTAAACTCTTGCAATACTCTGGACCTTGTCGTCGTCAA
CTCAACGAGACCGTCTACCTCACCAACCAGACTGAGGTAAAACTCACCTGCAGA
CCACACAAGACCTATATCATCTGGTTCTTCGAGAACACCTCATTTGCAGTCTCCA
ACACTCACTGCAACGACGGTGTTGAACTTCCCAACAACCTTTCCAGTGGACTGA
GTTACGATACACGTAGAGCTAAGCTCGTCCTCTACTATCCTTTCATAGAGGGAAC
CTACCAGTGCCTGAGTGGACCTTGCTTCCACAGTTTTACTTTGGTGAACGTTACC
GACAGCAGCACAGCCGCTCCAGAAACTAACCTTCCTTCTGATACTAACAAACCT
CGTTTCGGAGGTGAGCTAAGGCTTCCCCCTTCTGAGGAGGGGGTTAGCCCTTACG
AAGTGGTCGGGTATTTGATTTTAGGGGTGGTCCTGGGTGGGTGCATAGCGGTGCT
AGCTCAGCTGCCTTGCTGGGTAGAAATCAAAATCTTTATATGCTGGGTCAGACAT
TGTGGGGAGGAACTATGAAGGGGTTCTTGCTGATTATCCTTTCCCTGGTGGGGGG
TGTGCTGTCATGCCACGAACAGCCACGATGTAACATCACCACAGGCAATGAGAG
GAGTGTCATATGCACAGTAGTCATCAAATGCGAGCATGAATGCCCTCTCAACAT
CACATTCAAAAACCGTACCATGGGGAATGCATGGGTGGGCGACTGGGAACCAG
GAGATGAGCAGAACTACACGGTCACTGTCCATGGTAGCGATGGAAATCACACTT
TCGGTTTCAAATTCATTTTTGAAGTCATGTGTGATATCACACTGCATGTGGCTAG
ACTTCATGGCTTGTGGCCCCCTACCAAGGAAAACATGGTTGGGTTTTCTTTGGCT
TTTGTGATCATGGCCTGCTTTATGTCAGGTCTGCTTGTAGGGGCTCTAGTTTGGTT
CCTGAAGCGCAAGCCCAGGTACGGAAATGAGGAGAAGGAAAAATTGCTATAAA
TCTTTTTCTTTCGCAGAACCATGAATACTTTGACCAGTGTCGTGCTGCTCTCTCT
TCTTGTAGCTGTTAGTCAGGGACTATCGGAATCTAAAGTTGTACAAATACCATAC
GGCAGTGATTATGTTTAGTGGGACCAAGAGATCCACCAGTTCAATGGTTTGGG
GGTGGAGATTTTACTATGTTCTGTAATGGAAGTAAAACTCACTTGCGTAACATAA
GACACACTTGTAATGAACAAAACCTGACTTTACTGTCAGTTGGCTATGGCCATAG
AGGTGATTACTATGGTTATAGGCATGATAACACAGACAGAGAACATTATAAGGT
TATAATCCAAGCACCTGCGCCAAAAACCAGAAAACCCCTTTCAAAAATAAAATA
TGTTAATGTTACCATGGGCCAAATCTAACACTAAGCGGACCACCAGGAACGCC
AGTTACATGGCTTGGTGAGGGACACAAACTTTGCGAAGGCAAAAATGTTTTCTA
TCGCGAACTTAACCACACTTGTACAGAAAAGGACCTTATCCTATTGTTTGTAAAT
AGGACGCATAATGGTCCTTATATTGGTTACAACAAAGAAGGTACAGACAGAGAA
CAATATGAAGTGTCAGTATTAGATTTAATGCCAATTGCAGGACAAGGTTTGGATT
CAAAAATAAAAAAGAACAGAAAAGCCTTCCTAAAAGAAAGCCAAAAGATAAA
GTAAAAGAGGTTAACTTTCCAACAGGATCTAATCAGACACTGATTGGACCTCCT
GGACAAAAAATTGATTGGCATGTGAGCAGTAATGATGGACAGTTTAAAAAACTG
TGTGAAACTAAAGATGGAAAACATTCTTGCCATGGGCAGAACATAACAATTTTA
AACATTAGCAGATCAGATGAAGGGTCTTACTATGGTTCCAGTAATGACGCTTCA
ACGCACTATAAGCTTACTGTGTATGACAAATCAAGCTTTGGTAAACCGAAAATC
AAGATTGATCCATACACCACAAAGGGAACAACCACTGAAAATCATCATGAGTTT
GAATTACAACAGGGAAATGATCAAACAGAAGAATCAAAAATTCCATCTACTACT
GTGGCAATCGTGGTGGGAGTGATTGCGGGATTCATAACTATAATCATTGTGATTC
TGTGCTACATCTGCTGCCGCAAGCGTCCCAGGACTTACAATCATATGGTAGACCC
ACTACTCAGCTTCTCTTACTGAGACTCAGTCACTTTCATTTCAGAACCATGAAGG
CTTTCACAGCTTGCGTTCTGATTAGCATAATCACACTTAGTTTAGCAGCACCTAA
ACCAGAAGTATATACACAAGTTAATGTCACTAGGGGTGGGAATGCTACACTAGA
TGGACCATTTAACAATAACACATGGACAAGATATCATGACGATGGGAAAAAAA
GCGGATGGATGAATATTTGTAAATGGTCAGACCCATCATACACATGTCATAGTA
ATGGAAGCCTTAGTATTTTTGCTTTCAACATTAGTTCAGGTAAATATAAAGTTCA
AAGTTACACTAACAGTTATAATGGATTAGATGGTTATGAAAAACTTGAAGTTAA
AATGTTTAATCTAACAGTAATTGAGCCTCCAACCACTAGAGCACCCACCACAGTT
AGGACAACTAAGGACACAACACAGCCTACCACTGCACCCACTACACATCCAACC
ACCACAGCCAGTACAACTATTGAAACCACTACTCAAACTACAGTGCAGAATACT
ACTTTATTGATTGGGTTTTTACTGAGAGGAAATGAAAGTACTACTGATCAGACAG
AGGCTACCTCAAGTGCCTTCAGCAGCACTGCAAATTTAACTTCGCTTGCTTGGAC
TAATGAAACCGGAGTATCATTGATGCATGGCCAGCCTTACTCAGGTTTGGATATT
CAAATTACTTTTCTGGTTGTTTGTGGGATCTTTATTCTTGTGGTTCTTCTGTACTTT
GTCTGCTGCAAAGCCAGAGAAAATCTAGGAGGCCCATCTACAGGCCAGTAATC
GGGGATCCTCAGCCTCTCCAAGTGGAAGGGGGTCTAAGGAATCTTCTCTTCTCTT
TTTCAGTATGGTGATTCAGCCATGATTCCTAGGTTCTTCCTATTTAACATCCTCTT
CTGTCTATTCAACGTGTGCGCTGCCTTCGCGGCCGTCTCGCACGCCTCGCCCGAC
TGTCTCGGGCCCTTCCCCACCTACCTCCTCTTTGCCCTGCTAACCTGCACCTGCGT
CTGCAGCATTGTCTGCCTGGTCGTCACCTTCCTGCAGCTCATCGACTGGTGCTGC
GCGCGCTACAATTATCTCCACCACAGTCCCGAATACAGGGACGAGAACGTAGCC
AGAATCTTAAGGCTCATTTGACCATGCAGACTCTGCTCATACTGCTATCCCTCCT
CTCCCCTGCCCTCGCTGATGATGATTACTCTAAGTGCAAATTTGTGGAGCTATGG
AATTTCTTAGACTGCTATGATGCTAAAATGGATATGCCATCCTATTACTTGGTGA
TTGTGGGGATAGTCATGGTCTGCTCCTGCACTTTCTTTGCCATCATGATCTACCCC
TGTTTTGATCTCGGCTGGAACTCTGTTGAGGCATTCACATACACACTAGAAAGCA

TABLE 7-continued

Nucleic Acid Sequences of Vectors

| SEQ ID NO | Sequence |
|---|---|
| | GTTCACTAGCCTCCACGCCACCACCCACACCTCCTCCCCGCAGAAATCAGTTTCC<br>CCTGATTCAGTACTTAGAAGAGCCCCCTCCCCGACCCCCTTCCACTGTTAGCTAC<br>TTTCACATAACCGGCGGCGATGACTGACCACCACCTGGACCTCGAGATGGACGG<br>CCAGGCCTCCGAGCAGCGCATCCTGCAACTGCGCGTCCGTCAGCAGCAGGAGCG<br>GGCCGCCAAGGAGCTCCTCGATGCCATCAACATCCACCAGTGCAAGAAGGGCAT<br>CTTCTGCCTGGTCAAACAGGCAAAGATCACCTACGAGCTCGTGTCCAACGGCAA<br>ACAGCATCGCCTCACCTATGAGATGCCCCAGCAGAAGCAGAAGTTCACCTGCAT<br>GGTGGGCGTCAACCCCATAGTCATCACCCAGCAGTCGGGCGAGACCAGCGGCTG<br>CATCCACTGCTCCTGCGAAAGCCCTGAGTGCATCTACTCCCTCCTCAAGACCCTT<br>TGCGGACTCCGCGACCTCCTCCCCATGAACTGATGTTGATTAAAAGCCCAGAAA<br>CCAATCAGTCCCTTCCCCCATTTACCCATTTCCCCAATTCTCATAAATCATTGGAA<br>TTAATCATTCAATAAAGATCACTTACTTGAAATCTGAAAGTATGTCTCTGGTGTA<br>GTTGTTTAGCAGCACCTCGGTACCCTCCTCCCAGCTCTGGTACTCCAGTCCCCGG<br>CGGGCGGCAAACTTCCTCCACACCTTGAAAGGGATGTCAAATTCCTGGTCCACA<br>ATTTTCATTGTCTTCCCTCTCAGATGTCAAAGAGGCTCCGGGTGGAAGATGACTT<br>CAACCCCGTCTACCCCTATGACTACGCGCGGAATCAGAATATCCCCTTCCTCACT<br>CCCCCCTTTGTCTCCTCCGATGGATTCAAAAACTTCCCCCCTGGTGTCCTGTCACT<br>CAAACTGGCTGACCCAATCACCATCACTAATGGGGATGTCTCGCTCAAGGTGGG<br>AGGGGGACTCGCCTTGCAAGAAGGAAGTGGACAGCTAACAGTCAATACTAAAG<br>CTCCATTGCAAGTTGCAAATGATAAATTAGAATTAGCACTTGATGCTCCATTTCA<br>AGAAAAAAATGGAAAACTGGTATTGAAAACAGGACATGGTTTAGCTGTTTTAAC<br>TAAAGATAACACCCACATACCAGACTTAATTGGAACCCTTGTAGTAGTAACTGG<br>AAATGGAATTGGTACAGGTAGTGTAGCTGGCGGAGGAACCATAGATGTAAGACT<br>TGGAGATGATGGTGGACTCTCATTTGATAAAAAGGGTGATTTAGTAGCCTGGAA<br>TAAAAAAGATGACAGGCGCACTTTATGGACAACGCCAGATCCATCGCCAAATTG<br>TAGAATTGAAGTTGCAAAGGATGCAAAACTTACTCTTGTCTTAACAAAGTGCGG<br>AAGTCAGATTTTAGCTTCTGTTTCAATTATTGTACTAAAAGGAACGTATGAATAT<br>GCAAAGAAGGAGACAAGCGTTAAAGAGTTCAGTATTAAGTTACTGTTTGATAAA<br>AATGGAGTGCTTTTGCCTGAATCTAATTTGGATAAAGATTATTGGAACTACAGAA<br>GTGATGATTTAACTATAGCCAAGCCATATGAAAATGCAGTACCTTTCATGCCAA<br>ATTTAAAGGCATACCCAAAACCTGATACAACTACTCAAACAACTCCAGGAGATA<br>AAAAAAGCAGTGGTAAAAATAAAATTGTGAGTAATGTGTATTTTGGAGGTGAGG<br>TTTATCAGCCAGGAGTTATAGTTGTTGCTTTTAATCAAGAAAAGGAAGCAAACT<br>GTGCTTACTCCATAACTTTGAAATTTGGATGGGGAAAGACATATGAAACACCCA<br>TACCATTTGATACCTCTTCTTTTCACCTTCTCTTACATTGCTCAAGAAAATGAAGAC<br>AAAGAACAATAAAGTGTTTTGAACTGAATTTATGTATCTTTATTGATTTTTACAC<br>CAGCACGGGTAGTCAGCCTCCCACCACCAGCCCATTTCACAGTGTAAACAATTCT<br>CTCAGCACGGGTGGCCTTAAATAGGGGAATGTTCTGATTAGCACGGGAACTGGA<br>TTTAGTGTCTATAATCCACACAGTTTCCTGGCGAGCCAAACGGGGGTCGGTGATT<br>GAGATGAAGCCGTCCTCTGAAAAGTCATCCAAGCGGGCCTCGCAGTCCAAGGTC<br>ACAGTCTGGTGGAACGAGAAGAACGCACAGATTCATACTCGGAAAACAGGATG<br>GGTCTGTGCCTTTCCATCAGCGCCCTCAACAGTCTCTGCCGTCGGGGCTCGGTGC<br>GGCTGCTGCAGATGGGATCGGGATCGCAAGTCTCTCTGACTATGATCCCCACAG<br>CCTTCAGCATCAGTCTCCTGGTGCGTCGGGCACAGCACCGCATCCTGATCTCTGC<br>CATGTTCTCACAGTAAGTGCAGCACATAATCACCATGTTATTCAGCAGCCCATAA<br>TTCAGGGTGCTCCAGCCAAAGCTCATGTTGGGGATGATGGAACCAACGTGACCA<br>TCGTACCAGATGCGGCAGTATATCAGGTGCCTGCCCCTCATGAACACACTGCCC<br>ATATACATGATCTCTTTGGGCATATCTCTGTTCACAATCTGACGGTACCAGGGGA<br>AGCGCTGGTTGAACATGCACCCGTAAATGACTCTCCTGAACCACACGGCCAGCA<br>GGGCGCCTCCAGCCCGACACTGCAGGGAGC |
| SEQ ID NO: 1445 | CATCATCAATAATATACCCCACAAAGTAAACAAAAGTTAATATGCAAATGAGCT<br>TTTGAATTTAGGGCGTGGCCAACGCTGATTGGCCGTTGCAACGACCGTTAGTGAC<br>GTCACGACGCACGGCGTCAACGGTCGGCGCGGAGGCGTGGCCTAGGCCGGAAG<br>CAAGTCGCGGGTCTGATGACGTCTAAAAAAGCGGACTTTAGACCCGGAAATGGC<br>CGATTTTCCCGCGGCCACGCCCGGATATGAGGTAATTCTGGGCGGATGCAAGTG<br>AAATTAGGTCATTTTGGCGCGAAAACTGAATGAGGAAGTGAAAAGCGAAAAAT<br>ACCGGTCCCGCCCAGGGCGGAATATTTACCGAGGGCCGAGAGACTTTGACCGAT<br>TACGTGGGGGTTTCGATTGCGGTGTTTTTTTCGCGAATTTCCGCGTCCGTGTCAA<br>AGTCCGGTGTTTATGTCACCTGGTCAGCTGATCCACAGGGTATTTAAACCAGTCG<br>AGACCGTCAAGAGGCCACTCTTGAGTGCCAGCGAGTAGAGATTTCTCTGAGCTC<br>CGCTCCCAGAGTCTGAGAAAATGAGACACCTGCGCCTCCTGCCAGCAACTGTG<br>CCTATGGACATGGCTGTGCTTCTGCTGGACGACTTTGTGAATACAGTATTGGAGG<br>ACGAACTGCATCCAAGTCCGTTCGAGCTGGGACCCACACTTCAGGACCTCTATG<br>ATCTGGAGGTAGATGCCCATGAGGACGACCCGAACGAAGAGGCTGTGAATTTAA<br>TATTTCCAGAATCTATGATTCTTCAGGCTGACATAGCCAACGAATCTATTCCTAC<br>TCCACTTCATACTCCAACTCTGTCACCCATACCTGAATTGGAAGAGGAGGACGA<br>GTTAGACCTCCGGTGCTACGAGGAAGGTTTTCCTCCCAGCGATTCAGAGGACGA<br>ACAGGGTGAGCAGAGCATGGCTCTAATCTCAGACTATGCTTGTGTGGTTGTGGA<br>AGAGCATTTTGTGTTGGACAATCCTGAGGTGCCCGGGAAGGCTGTAGATCCTG<br>CCAATATCACCGGGATCAGACCGGAGACCCTAATGCCTCCTGCGCTCTGTGTTAC<br>ATGAAAACCACTTTCAGCTTTATTTACAGTAAGTGGAGTGAATGTGAGAGAGGC<br>TGAGTGCTTAACACATCTCTGTGTGATGCTTGAACAGCTGTGCTAAGTGTGGTTT<br>ATTTTTGTTACTAGGTCCGGTGTCAGAGGATGAGTCATCACCCTCAGAAGAAGA<br>CCACCCGTCACCCCCTGATCTCACAGATGACACGCTCCTGCAAGTGTACAGACCC<br>ACCCCAGTCAGACCCAGTGGCGAGAGGCGAGCAGCTGTTGACAAAATTGAGGA |

TABLE 7-continued

Nucleic Acid Sequences of Vectors

| SEQ ID NO | Sequence |
|---|---|
| | CTTGTTGCAGGACATGGGTGGGGATGAACCTTTGGACCTGAGCTTGAAACGCCC |
| | CAGGAACTAGGCGCAGCTGCGCTGAGTCATGTGTAAATAAAGCTGTATAATAAA |
| | AGTATATGTGACGCATGCAAGGTGTGGTTTATGACTCATGGGCGGGGCTTAGAC |
| | CTATATAAGTGGCAACACCTGGACACTCAGACACAGACCTTCAGGGAGCTCCTG |
| | ATGGGAGGTGTGGACTATCCTTGCAGACTTTAACAAGACACGCCGGCTTGTAGAG |
| | GATAGTTCAGACGGGTGCTCCGGGTTCTGGAGACACTGGTTTGGAACTCCTCTAT |
| | CTCGCCTGGTGTACACAGTTAAGAAGGATTATAGCGAGGAATTTGAAAATCTTTT |
| | TTCCGACTGCTCTGGCCTGCTTGATTCACTGAATTTTGGCCACCAGTCCCTTTTCC |
| | AGGAAAGGGTCCTCCACAGCCTTGATTTTTCCAGCCCAGGGCGCACTACAGCCG |
| | GGGGTTGCTTTTGTGGTTTTTCTGGTTGACAAATGGAGCCAGAACACCCAACTGAG |
| | CAGGGGCTACATCCTGGACTTCGCGGCCATGCACCTGTGGAGGGCCTGGATCAG |
| | GCAGCGGGGACAGAGAATCTTGAACTACTGGCTTCTACAGCCAGCAGCTCCGGG |
| | TCTTCTTCATCTACACAGACAAACATCCATGTTGGAGGAAGAAATGAGGGAGGC |
| | CATGGACGACAACCCGAGGAGCGGCCTGGACCCTCCGTCGGAAGAGGAGCTGG |
| | ATTGAATCAGGTATCCAGCCTGTACCCAGAGCTTAGCAGGGTGCTGACATCCAT |
| | GGCCAGGGGAGTGAAGCGGGAGAGGAGCGATGGGGGCAATACCGGGATGATGA |
| | CCGAGCTGACGGCCAGCCTGATGAATCGCAAGCGCCCAGAGCGCATTACCTGGC |
| | ATGAGCTACAGCTGGAGTGCAGGGATGAGGTCGGCCTGATGCAGGATAAATATG |
| | GCCTGGAGCAGATAAAAACCCACTGGTTGAACCCAGATGAGGATTGGGAGGAG |
| | GCCATTAAGAAGTATGCCAAGATTGCCCTGCGCCCAGATTGCAAGTACAGGGTG |
| | ACCAAGACGGTGAATATCAGACATGCCTGCTACATCTCAGGGAACGGGGCAGAG |
| | GTGGTCATCGATACCCTGGACAAGGCCGCCTTCAGGTGTTGCATGATGGGAATG |
| | AGAGCCGGAGTGATGAATATGAATTCCATGATCTTCATGAACATGAAGTTCAAT |
| | GGGAGAGAAGTTTAATGGGGTGCTGTTCATGGCCAACAGCCACATGACCCTGCAT |
| | GGCTGTGATTTCTTCGGCTTCAACAATATGTGTGCAGAGGTCTGGGGCGCCGCTA |
| | AGATCAGGGGATGTAAGTTTTATGGCTGTTGGATGGGCGTGGTCGGAAGACCCA |
| | AGAGCGAGATGTCTGTGAAGCAGTGTGTGTTTGAGAAATGCTACCTGGGAGTCT |
| | CTACCGAGGGCAATGCTCGAGTGAGACACTGCTCTTCCATGGAGACGGGCTGCT |
| | TCTGCCTGGTGAAGGGCACAGCCTCGATCAAGCATAATATGGTGAAGGGCTGCA |
| | CGGATGAGCGCATGTACAACATGCTGACCTGCGACTCGGGGTCTGCCATATCC |
| | TGAAGAACATCCATGTGACCTCCCACCCCAGGAAGAAGTGGCCAGTGTTTGAGA |
| | ATAACCTGCTGATCAAGTGCCATATGCACCTGGGTGTCAGAAGGGGTACCTTCC |
| | AGCCGTACCAGTGCAACTTTAGCCAGACCAAGCTGCTGTTGGAGAACGATGCCT |
| | TCTCCAGGGTGAACCTGAACGGCATCTTTGACATGGATGTCTCCGGTGTACAAGAT |
| | CCTGAGATACGATGAGACCAAGTCCAGGGTGCGCGCTTGCGAGTGCGGGGGCAG |
| | ACACACCAGGATGCAACCGGTGGCCCTGGATGTGACCGAGGATCTGCGACCCGA |
| | CCACCTGGTGATGGCCTGTACCGGGACCGAGTTCAGCTCCAGTGGGGAGGACAC |
| | AGATTAGAGGTAGGTTTGAGTAGTGGGCGTGGCTAAGGCGACTATAAAGGTGGG |
| | TGTCTTACGAGGGTCTTTTTGCTTTTCTGCAGACATCATGAACGGGACCGGCGGG |
| | CACTTCGAAGGGGGCTTTTTAGCCCTTATTTGACAACCCGCCTGCCGGGATGGG |
| | CCGGAGTTCGTCAGAATGTGATGGGATCGACGGTGGACGGGCGCCCAGTGCTTC |
| | CAGCAAATTCCTCGACCATGACCTACGCGACCGTGGGGACGAGCTCGTCGCTCG |
| | ACAGCACCGCCGCAGCCGCGGCAGCCGCAGCCGCCATGACAGCGACGAGACTG |
| | GCCTCGAGCTACATGCCAAGCAGCAACAGCAGCCCCTCCGTCCCCAGTTCCATC |
| | ATCGCCGATGAGAAACTGCTGGCCCTGCTGGCAGAGCTGGAAGCCCTGAGCCGC |
| | CAGTTGGCCGCCCTGACCCAGCAGGTGTCCGATCTCCGCGAGCAACAGCAGCAG |
| | CAAAAATAAATGATTCAATAAACACAGATTCTGATTCAAACAGCAAAGCATCTT |
| | TATTATTTATTTTTTCGCGCGGTAGGCCCTGGTCCACCTCTCCCGATCATTGAG |
| | AGTGCGGTGGATTTTTTCCAGGACCCGGTAGAGGTGGGATTGGATGTTGAGGTA |
| | CATGGGCATGAGCCCGTCCCGGGGTGGAGGTAGCACCACTGCATGCCTCGTG |
| | CTCTGGGGTCGTGTTAGATGATCCAGTCATAGCAGGGGCGCTGGGCGTGGTG |
| | CTGGATGATGTCCTTGAGGAGGAGACTGATGCCACGGGGAGCCCCTTGGTGTA |
| | GGTGTTGGCGAAGCGGTTGAGCTGGGAGGGATGCATGCGGGGGGAGATGATGT |
| | GGAGTTTGGCCTGGATCTTGAGGTTGGCGATGTTGCCGCCCAGATCCGCCGGG |
| | GGTTCATGTTGTGCAGGACCACCAGGACGGTGTAGCCCGTGCACTTGGGGAACT |
| | TGTCATGCAACTTGGAAGGGAATGCGTGGAAGAATTTGGAGACGCCCTTGTGCC |
| | CGCCCAGGTTTTCCATGCACTCATCCATGATGATGGCAATGGGCCCGTGGGCTGC |
| | GGCTTTGGCAAAGACGTTTCTGGGGTCAGAGACATCGTAATTATGCTCCTGGGTG |
| | AGATCATCATAAGACATTTTAATGAATTTGGGGCGGAGGGTGCCAGATTGGGGG |
| | ACGATGGTTCCCTCGGGACCCGGGGCGAAGTTCCCCTCGCAGATCTGCATCTCCC |
| | AGGCTTTCATCTCGGAGGGGGGATCATGTCCACCTGCGGGCGATGAAAAAAA |
| | CGGTTTCCGGGGCGGGGGTGATGAGCTGCGAGGATAGCAGGTTTCTCAACAGCT |
| | GGGACTTGCCGCACCCGGTCGGGCCGTAGATGACCCCGATGACGGGTTGCAGGT |
| | GGTAGTTCAAGGAGATGCAGCTGCCGTCGTCCCGGAGGAGGGGGCCACCTCGT |
| | TGAGCATGTCCCTGACTTGGAGGTTTTCCCGACGAGCTCGCCAAGGAGGCGGT |
| | CCCCGCCCAGCGAGAGCAGCTCTTGCAGGGAAGCAAAGTTTTTCAGGGGCTTGA |
| | GCCCGTCGGCCATGGGCATCTTGGCGAGGGTCTGCGAGAGGAGCTCGAGGCGGT |
| | CCCAGAGCTCGGTGACGTGCTCTACGGCATCTCGATCCAGCAGACTTCCTCGTTT |
| | CGGGGGTTGGGACGACTGCGACTGTAGGGCACGAGACGATGGGCGTCCAGCGCT |
| | GCCAGCGTCATGTCCTTCCAGGGTCTCAGGGTCCGCGTGAGCGTGGTCTCCGTCA |
| | CGGTGAATGGGTGGCCCGGGTGGGCTTGCAAGGGTGCGCTTGAGACTGA |
| | TCCTGCTGGTGCTGAAACGGGCACGGTCTTCGCCCTGCGCGTCGGCGAGATAGC |
| | AGTTGACCATGAGCTCGTAGTTGAGTGCCTCGGCGGCGTGGCCCTTGGCGCGGA |
| | GCTTGCCCTTGGAAGAGCGCCCGCAGGCGGGACAGAGGAGGGATTGCAGGGCG |
| | TAGAGCTTGGGTGCAAGAAAGACGGACTCGGGGGCAAAGGCGTCCGCTCCGCA |
| | GTGGGCGCAGACGGTCTCGCACTCCACGAGCCAGGTGAGCTCGGGCCGCTCGGG |

TABLE 7-continued

Nucleic Acid Sequences of Vectors

SEQ ID NO Sequence

GTCAAAAACCAGTTTTCCCCCGTTCTTTTTGATGCGCTTCTTACCTCGCGTCTCCA
TGAGTCTGTGTCCGCGTTCGGTGACAAACAAGCTGTCTGTGTCCCCGTAGACGGA
CTTGATGGGCCTGTCCTGCAAGGGCGTCCCGCGGTCCTCCTCGTAGAGAAACTCG
GACCACTCTGAGACAAAGGCGCGTCCACGCCAAGACAAAGGAGGCCACGTG
CGAGGGGTAGCGGTCGTTGTCCACCAGGGGGTCCACCTTTTCCACGGTATGCAG
ACACATGTCCCCCTCCTCCGCATCCAGGAAGGTGATTGGCTTGTAGGTGTAGGCC
ACGTGACCCGGGGTCCCCGACGGGGGGTATAAAAGGGGGCGGGTCTGTGCTCG
TCCTCACTCTCTTCCGCGTCGCTGTCCACGAGCGCCAGCTGTTGGGGTAGGTATT
CCCTCTCGAGAGCGGGCATGACCTCGGCACTCAGGTTGTCAGTTTCTAGAAACG
AGGAGGATTTGATGTTGGCCTGCCCTGCCGCGATGCTTTTGAGTAGACTTTCATC
CATCTGGTCAGAAAAGACTATTTTTTTATTGTCAAGCTTGGTGGCGAAGGAGCCA
TAGAGGGCGTTTGAGAGAAGCTTGGCGATGGATCTCATGGTCTGATTTTTGTCAC
GGTCGGCGCGCTCCTTGGCCGCGATGTTGAGCTGGACATACTCGCGCGCGACAC
ACTTCCATTCGGGGAAGACGGTGGTGCGCTCGTCGGGCACGATCCTGACGCGCC
AGCCGCGGTTATGCAGGGTGACCAGGTCCACACTGGTGGCCACCTCGCCGCGCA
GGGGCTCGTTGGTCCAGCAGAGTCGCCCGCCCTTGCGCGAGCAGAAAGGGGGCA
GCACATCCAAGAGGTGCTCGTCAGGGGGGTCCGCATCGATGGTGAAGATGCCCG
GACAGAGTTCCTTGTCAAAATAGTCTATTTTTGAGGATGCATCATCCAAGGCCAT
CTGCCACTCGCGGGCGGCCATTGCTCGCTCGTAGGGGTTGAGGGGCGGACCCCA
TGGCATGGGATGCGTGAGCGCGGAGGCGTACATGCCGCAGATGTCGTAGACATA
GATGGGCTCCGCGAGGATGCCGATGTAGGTGGGATAACAGCGCCCCCCGCGAT
GCTGGCGCGCACATAGTCATACAACTCATGCGACGGGGCCAAAAAGGCGGGGC
CGAGATTGGTGCGCTGGGGCTGCTCGGCGCGGAAGACGATCTGGCGAAAGATGG
CATGCGAGTTTGAGGAGATGGTGGGCCGTTGGAAGATGTTAAAGTGGGCGTGGG
GCAAGCGGACCGAGTCGCGGATGAAGTGCGCGTAGGAGTCTTGCAGCTTGGCGA
CGAGCTCGGCGGTGACGAGGACGTCCATGGCGCAGTAGTCCAGCGTTTCGCGGA
TGATGTCATAACCCGTCTCTCCTTTCTTCTCCCACAGCTCGCGGTTGAGGGCGTA
CTCCTCGTCATCCTTCCAGTACTCCCGGAGCGGGAATCCTCGATCGTCCGCACGG
TAAGAGCCCAGCATGTAGAAATGGTTCACGGCCTTGTAGGGACAGCAGCCCTTC
TCCACGGGGAGGGCGTAAGCTTGTGCGGCCTTGCGGAGCGAGGTGTGCGTCAGG
GCGAAGGTGTCCCTGACCATGACTTTCAAGAACTGGTACTTGAAATCCGAGTCG
TCGCAGCCGCCGTGCTCCCAGAGCTCGAAATCGGTGCGCTTCTTCGAGAGGGGG
TTAGGCAGAGCGAAAGTGACGTCATTGAAGAGAATCTTGCCTGCCCGCGGCATG
AAATTGCGGGTGATGCGGAAAGGGCCCGGCACGGAGGCTCGGTTGTTGATGACC
TGGGCGGCGAGGACGATCTCGTCGAAGCCGTTGATGTTGTGCCCGACGATGTAG
AGTTCCATGAATCGCGGGCGGCCTTTGATGTGCGGCAGCTTTTTGAGCTCCTCGT
AGGTGAGGTCCTCGGGGCATTGCAGGCCGTGCTGCTCTAGCGCCCACTCCTGGA
GATGTGGGTTGGCTTGCATGAAGGAAGCCCAGAGCTCGCGGGCCATGAGGGTCT
GGAGCTCGTCGCGAAAGAGGCGGAACTGCTGGCCCACGGCCATCTTTTCTGGGG
TGACGCAGTAGAAGGTGAGGGGGTCCCGCTCCCAGCGATCCCAGCGTAAGCGCA
CGGCTAGATCGCGAGCGAGGGCGACCAGCTCGGGGTCCCCCGAGAATTTCATGA
CCAGCATGAAGGGGACGAGCTGCTTGCCGAAGGACCCCATCCAGGTGTAGGTTT
CTACATCGTAGGTGACAAAGAGCCGTTCCGTGCGAGGATGAGAGCCGATTGGGA
AGAACTGGATTTCCTGCCACCAGTTGGACGAGTGGCTGTTGATGTGATGAAAGT
AGAAATCCCGCCGGCGAACCGAGCACTCGTGCTGATGCTTGTAAAAGCGTCCGC
AGTACTCGCAGCGCTGCACGGGCTGTACCTCATCCACGAGATACACAGCGCGTC
CCTTGAGGAGGAACTTCAGGAGTGGCGGCCCTGGCTGGTGGTTTTCATGTTCGCC
TGCGTGGGACTCACCCTGGGGCTCCTCGAGGACGGAGAGGCTGACGAGCCCGCG
CGGGAGCCAGGTCCAGATCGCGGCGCGGCGGGGGCGGAGAGCGAAGACGAGGG
CGCGCAGTTGGGAGCTGTCCATGGTGTCGCGGAGATCCAGGTCCGGGGGCAGGG
TTCTGAGGTTGACCTCGTAGAGGCGGGTGAGGGCGTGCTTGAGATGCAGATGGT
ACTTGATCTCCACGGGTGAGTTGGTGCCGTGTCCACGCATTGCATGAGCCCGTA
GCTGCGCGGGGCCACGACCGTGCCGCGGTGCGCTTTTAGAAGCGGTGTCGCGGA
CGCGCTCCCGGCGGCAGCGGCGGTTCCGGCCCCGCGGGCAGGGGCGGCAGAGG
CACGTCGGCGTGGCGCTCGGGCAGGTCCCGGTGCTGCGCCCTGAGAGCGCTGGC
GTGCGCGACGACGCGGCGGTTGACATCCTGGATCTGTCGCCTCTGCGTGAAGAC
CACTGGCCCCGTGACTTTGAACCTGAAAGACAGTTCAACAGAATCAATCTCGGC
GTCATTGACGGCGGCCTGACGCAGGATCTCTTGCACGTCGCCCGAGTTGTCCTGG
TAGGCGATCTCGGACATGAACTGCTCGATCTCCTCCTCCTGGAGATCGCCGCGGC
CCGCGCGCTCGACGGTGGCGGCGAGGTCGTTGGAGATGCGGCCCATGAGCTGCG
AGAAGGCGCCCAGGCCGCTCTCGTTCCAGACGCGGCTGTAGACCACGTCCCCGT
CGGCGTCGCGCGCGCGCATGACCACCTGCGCGAGGTTGAGCTCCACGTGCCGCG
CGAAGACGGCGTAGTTGCGCAGGCGCTGGAAGAGGTAGTTGGGGTGGTGGCG
ATGTGCTCGGTGACGAAGAAGTACATGATCCAGCGGCGCAGGGGCATCTCGCTG
ATGTCGCCCATGGCCTCTAGCCTTTCCATGGCCTCGTAGAAATCCACGGCGAAGT
TGAAAAACTGGGCGTTGCGGGCCGAGACCGTGAGCTCGTCTTCCAGGAGCCGGA
TGAGCTCGGCGATGGTGGCGCGCACCTCGCGCTCGAATCCCCGGGGCCTCCT
CCTCTTCCTCTTCTTCCATGACGACCTCTTCTTCTATTTCTTCCTCTGGGGCGGT
GGTGGTGGCGGGCCCGACGACGACGGCGACGCACCGGGAGACGGTCGACGAA
GCGCTCGATCATCTCCCCGCGCGGCGACGCATGGTTTCGGTGACGGCGCGACC
CCGTTCGCGAGGACGCAGCGTGAAGACGCCGCCGGTCATCTCCCGGTAATGGGG
CGGGTCCCCGTTGGGCAGCGAGAGGGCGCTGACGATGCATCTTATCAATTGCGG
TGTAGGGGACGTGAGCGCGTCGAGATCGACCGGATCGGAGAATCTTTCGAGGAA
AGCGTCTAGCCAATCGCAGTCGCAAGGTAAGCTCAAACACGTAGCAGCCCTGTG
GACGCTGTTAGAATTGCGGTTGCTGATGATGTAATTGAAGTAGGCGTTTTTGAGG
CGGCGGATGGTGGCGAGGAGGACCAGGTCCTTGGGTCCCGCTTGCTGGATGCGG

TABLE 7-continued

Nucleic Acid Sequences of Vectors

SEQ ID NO Sequence

```
AGCCGCTCGGCCATGCCCCAGGCCTGGCCCTGACACCGGCTCAGGTTCTTGTAGT
AATCATGCATGAGCCTCTCGATGTCATCACTGGCGGAGGCGGAGTCTTCCATGC
GGGTGACCCCGACGCCCCTGAGCGGCTGCACGAGCGCCAGGTCGGCGACGACGC
GCTCGGCGAGGATGGCCTGTTGCACGCGGGTGAGGGTGTCCTGGAAGTCGTCCA
TGTCGACGAAGCGGTGGTAGGCCCCGGTGTTGATGGTGTAGGTGCAGTTGGCCA
TGAGCGACCAGTTAACGGTCTGCAGGCCGGGCTGCACGACCTCGGAGTACCTGA
GCCGCGAGAAGGCGCGCGAGTCGAAGACGTAGTCGTTGCAGGTGCGCACGAGG
TACTGGTATCCGACTAGGAAGTGCGGCGGCGGCTGGCGGTAGAGCGGCCAGCGC
TGGGTGGCCGGCGCGCCCGGGGCCAGGTCCTCGAGCATGAGGCGGTGGTATCCG
TAGAGGTAGCGGGACATCCAGGTGATGCCGGCGGCGGTGGTGGAGGCGCGCGG
GAACTCGCGGACGCGGTTCCAGATGTTGCGCAGCGGCAGGAAATAGTCCATGGT
CGGCACGGTCTGGCCGGTGAGACGCGCGCAGTCATTGACGCTCTAGAGGCAAAA
ACGAAAGCGGTTGAGCGGGCTCTTCCTCCGTAGCCTGGCGGAACGCAAACGGGT
TAGGCCGCGCGTGTACCCCGGTTCGAGTCCCCTCGAATCAGGCTGGAGCCGCGA
CTAACGTGGTATTGGCACTCCCGTCTCGACCCGAGCCCGATAGCCGCCAGGATA
CGGCGGAGAGCCCTTTTTGCTGGCCGCGGGGAGTCGCTATGCTTGAAAGCGGCC
GAAAACCCCGCGGGTAGTGGCTCGCGCCCGTAGTCTGGAGAAGCATCGCCAGG
GTTGAGTCGCGGCAGAACCCGGTTCGCGGACGGCCGCGGCGAGCGGGACTTGGT
CACCCCGCCGATTAAAGACCCACAGCCAGCCGACTTCTCCAGTTACGGGAGCGA
GCCCCCTTTTTCTTTTTGCCAGATGCATCCCGTCCTGCGCCAAATGCGTCCCACC
CCCCCGGCGACCACCGCGACCGCGGCCGTAGCAGGCGCCGGCGCTAGCCAGCCA
CAGCCACAGACAGAGATGGACTTGGAAGAGGGCGAAGGGCTGGCGAGACTGGG
GGCGCCGTCCCGGAGCGACACCCCCGCGTGCAGCTGCAGAAGGACGTGCGCCC
GGCGTACGTGCCTGCGCAGAACCTGTTCAGGGACCGCAGCGGGGAGGAGCCCG
AGGAGATGCGCGACTGCCGGTTTCGGGCGGGCAGGGAGCTGCGCGAGGGCCTG
GACCGCCAGCGCGTGCTGCGCGACGAGGATTTCGAGCCGAACGAGCAGACGGG
GATCAGCCCCGCGCGCGCATGTGGCGGCGGCCAACCTGGTGACGGCCTACGA
GCAGACGGTGAAGCAGGAGCGCAACTTCCAAAAGAGTTTCAACAACCATGTGCG
CACGCTGATCGCGCGCGAGGAGGTGGCCCTGGGCCTGATGCACCTGTGGGACCT
GGCGGAGGCCATCGTGCAGAACCCGGACAGCAAGCCTCTGACGGCGCAGCTGTT
CCTGGTGGTGCAGCACAGCAGGGACAACGAGGCGTTCAGGGAGGCGCTGCTGA
ACATCGCCGAGCCCGAGGGCCGCTGGCTGCTGGAGCTGATCAACATCTTGCAGA
GCATCGTAGTGCAGGAGCGCAGCCTGAGCCTGGCCGAGAAGGTGGCGGCGATC
AACTACTCGGTGCTGAGCCTGGGCAAGTTTTACGCGCGCAAGATTTACAAGACG
CCGTACGTGCCCATAGACAAGGAGGTGAAGATAGACAGCTTTTACATGCGCATG
GCGCTCAAGGTGCTGACGCTGAGCGACGACCTGGGCGTGTACCGCAACGACCGC
ATCCACAAGGCCGTGAGCGCGAGCCGGCGGCGCGAGCTAAGCGACCGCGAGCT
GATGCTGAGCCTGCGCGGGCGCTGGTAGGCGGCGCCGCCGGCGGCGAGGAGTC
CTACTTCGACATGGGGGCGGACCTGCATTGGCAGCCGAGCCGGCGCGCCTTGGA
GGCCGCCTACGGTCCAGAGGACTTGGATGAGGAAGAGGAAGAGGAGGAGGATG
CACCCGTTGCGGGGTACTGACGCCTCCGTGATGTGTTTTTAGATGCAGCAAGCCC
CGGACCCCGCCATAAGGGCGGCGCTGCAAAGCCAGCCGTCCGGTCTAGCATCGG
ACGACTGGGAGGCCGCGATGCAACGCATCATGGCCCTGACGACCCGCAACCCCG
AGTCCTTTAGACAACAGCCGCAGGCCAACAGACTTTCGGCCATTCTGGAGGCGG
TGGTCCCCTCTCGGACCAACCCCACGCACGAGAAGGTGCTGGCGATCGTGAACG
CGCTGGCGGAGAACAAGGCCATTCGTCCCGACGAGGCTGGGCTGGTATACAACG
CCCTGCTGGAGCGCGTGGGCCGCTACAACAGCACGAACGTGCAGTCCAACCTGG
ACCGGCTGGTGACGGACGTGCGCGAGGCCGTGGCGCAGCGCGAGCGGTTCAAG
AACGAGGGCCTGGGCTCGCTGGTGGCGCTGAACGCCTTCCTGGCGACGCAGCCG
GCGAACGTGCCGCGCGGGCAGGACGATTATACCAACTTTATCAGCGCGCTGCGG
CTGATGGTGACCGAGGTTCCCCAGAGCGAGGTGTACCAGTCGGGTCCGGACTAC
TTTTTCCAGACTAGCCGGCAGGGCCTGCAGACGGTGAACCTGAGCCAGGCTTTC
AAGAACCTGCGCGGGCTGTGGGCGTGCAGGCGCCCGTGGGCGACCGGTCGAC
GGTGAGCAGCTTGCTGACGCCCAACTCGCGGCTGCTGCTGCTGCTGATCGCCC
TTCACCGACAGCGGCAGTGTGAACCGCAACTCGTACCTGGGTCACCTGCTGACG
CTGTACCGCGAGGCCATAGGCCAGGCACAGGTGGACGAGCAGACCTTCCAGGA
GATCACTAGTGTAAGCCGCGCGCTGGGGCGGAACGACACCGACAGTCTGAGGGC
CACCTTGAACTTCTTGCTGACCAATAGACAGCAGAAGATCCCGGCGCAGTATGC
GCTGTCGGCCGAGGAGGAGCGCATCCTGAGATATGTGCAGCAGAGCGTAGGGCT
GTTCCTGATGCAGGAGGGGGCCACACCCAGCGCCGCGCTGGACATGACCGCGCG
CAACATGGAACCTAGCATGTACGCCGCCAACCGGCCGTTCATCAATAAGCTGAT
GGACTACCTGCACCGCGCGGCGTCCATGAACTCGGACTACTTTACCAATGCCATT
TTGAACCCGCACTGGCTCCCGCCGCCGGGGTTCTACACGGGCAGTACGACATG
CCCGACCCCAACGACGGGTTCCTGTGGGACGACGTGGACAGCGCGGTGTTCTCA
CCGACCTTGCAAAAGCGCCAGGAGGCGGTGCGCACGCCCGCGAGCGAGGGTGC
GGTGGGTCGGAGCCCCTTTCCTAGCTTAGGGAGTTTGCATAGCTTGCCGGGCTCG
GTGAACAGCGGCAGGGTGAGCCGCCCGCGCTTGCTGGGCGAGGACGAGTACCTG
AACGACTCGCTGCTGCAGCCGCCGCGGGTCAAGAACGCCATGGCCAATAACGGG
ATAGAAAGTCTGGTGGACAAACTGAACCGCTGGAAGACCTACGCTCAGGACCAT
AGGGAGCCTGCGCCCGCCGCGGCGACAGCGCCACGACCGGCAGCGGGGCCT
GGTGTGGGACGACGAGGACTCGGCCGACGATAGCAGCGTGTTGGACTTGGGCGG
GAGCGGTGGGGCCAACCCGTTCGCGCATCTGCAGCCCAGACTGGGGCGACGGAT
GTTTTGAATGCAAAATAAAACTCACCAAGGCCATAGCGTGCGTTCTCTTCCTTGT
TAGAGATGAGGCGTGCGGTGGTGTCTTCCTCTCCTCCTCCCTCGTACGAGAGCGT
GATGGCGCAGGCGACCCTGGAGGTTCCGTTTGTGCCTCCGCGGTATATGGCTCCT
ACGGAGGGCAGAAACAGCATTCGTTACTCGGAGCTGGCTCCGCTGTACGACACC
```

TABLE 7-continued

Nucleic Acid Sequences of Vectors

SEQ ID NO Sequence

ACTCGCGTGTATTTGGTGGACAACAAGTCGGCGGACATCGCTTCCCTGAACTACC
AAAACGACCACAGCAACTTCCTGACCACGGTGGTGCAGAACAACGATTTCACCC
CCGCCGAGGCCAGCACGCAGACGATAAATTTTGACGAGCGGTCGCGGTGGGGCG
GTGATCTGAAGACCATTCTGCACACCAACATGCCCAATGTGAACGAGTACATGT
TCACCAGCAAGTTTAAGGCGCGGGTGATGGTGGCTAGAAAGCATCCCAAAGATG
TGCCAGTTAATGATTTAAGCAAGGATATCTTAGAGTATGAGTGGTTTGAGTTTAC
CCTGCCCGAGGGCAACTTTTCCGAGACCATGACCATAGACCTGATGAACAACGC
CATCTTGGAAAACTACTTGCAAGTGGGGCGGCAAAATGGCGTGCTGGAGAGCGA
TATCGGAGTCAAGTTTGACAGCAGAAATTTCAAGCTGGGCTGGGACCCGGTGAC
CAAGCTGGTGATGCCAGGGGTCTACACCTACGAGGCCTTCCACCCGGACGTGGT
GCTGCTGCCTGGCTGCGGGGTGGACTTCACCGAGAGCCGCCTGAGCAACCTCCT
GGGCATTCGCAAGAAGCAACCTTTCCAAGAGGGCTTCAGAATCATGTATGAGGA
TCTCGAAGGGGGCAACATCCCCGCACTTCTGAATGTGACCAAGTACCTGGAAAG
CAAGAAGAAGCTAGAGGAGGCAGTGGAGAATGCCGCTAAGGCTAATGGTCCTG
CAAGAGGAGACAGTAGTGTCTCAAGAGAGGTGGAAAAGGCAGCTGAAAAAGAG
CTTGTCATTGAGCCCATCAAGCAAGATGATAGCAAGAGAAGTTACAACCTCATC
GAGGGTACCCATGACACCCTGTACCGAAGCTGGTACCTGTCCTATACCTACGGG
GACCCCGAGAAGGGGGTGCAGTCGTGGACGCTGCTCACCACCCCGGACGTCACC
TGCGGCGCGGAGCAAGTCTACTGGTCGCTGCCGGACCTCATGCAAGACCCCGTC
ACCTTCCGCTCTACCCAGCAAGTCAGCAACTACCCCGTGGTTGGCGCCGAGCTCA
TGCCCTTCCGCGCCAAGAGCTTTTACAACGACCTCGCCGTCTACTCCCAGCTCAT
CCGCAGCTACACCTCCCTCACCCACGTCTTCAACCGCTTCCCCGACAACCAGATC
CTCTGCCGCCCGCCCGCGCCCACCATCACCACCGTCAGTGAAAACGTGCCTGCTC
TCACAGATCACGGGACGCTACCGCTGCGCAGCAGTATCCGCGGAGTCCAGCGAG
TGACCGTCACTGACGCCCGTCGCCGCACCTGTCCCTACGTCTACAAGGCCCTGGG
CATAGTCGCGCCGCGTGTGCTTTCCAGTCGCACCTTCTAAAAAATGTCTATTCTC
ATCTCGCCCAGCAATAACACCGGCTGGGGTATTACTAGGCCCAGCGCCATGTAC
GGAGGAGCCAAGAAGCGCTCCCTGCAGCACCCCGTCCGCGTCCGCGGCCACTTC
CGCGCTCCCTGGGGCGCTTACAAGCGCGGGCGGACTGCCACCGCCGCCGCCGTG
CGCACCACCGTTGACGACGTCATCGACTCGGTGGTCGCCGACGCGCAACTAT
ACCCCGCCCCCTCCACCGTGGACGCGGTCATCGACAGCGTGGTGGCCGACGCA
CGCGACTATGCCAGACGCAAGAGCCGGCGGCGACGGATCGCCAGGCGCCACCG
GAGCACGCCCGCCATGCGCGCCGCCCGGGCTCTGCTGCGCCGCGCCAGACGCAC
GGGCCGCCGGGCCATGATGCGAGCCGCGCCGCGCTGCTACTGCACCCCCCGC
AGGCAGGACTCGCAGACGAGCGGCCGCCGCCGCCGCCGCGGCCATCTCTAGCAT
GACCAGACCCAGGCGCGGAAACGTGTACTGGGTGCGCGACTCCGTCACGGGCGT
GCGCGTGCCCGTGCGCACCCGTCCTCCTCGTCCCTGATCTAATGCTTGTGTCCTC
CCTCGCAAGCGACGATGTCAAAGCGCAAAATCAAGGAGGAGATGCTCCAGGTC
GTCGCCCCGGAGATTTACGGACCCACCCCAGGCGGACCAGAAACCCCGCAAAATC
AAGCGGGTTAAAAAAAAGGATGAGGTGGACGAGGGGGCAGTAGAGTTTGTGCG
CGAGTTCGCTCCGCGGCGGCGCGTAAATTGGAAGGGGCGCAGGGTGCAGCGCGT
GTTGCGGCCCGGCACGGCGGTGGTGTTCACGCCCGGCGAGCGGTCCTCGGTCAG
GAGCAAGCGTAGCTATGACGAGGTGTACGGCGACGACGACATCCTGGACCAGG
CGGCGGAGCGGGGGCGAGTTCGCCTACGGGAAGCGGTCGCGCGAAGAGGAG
CTGATCTCGCTGCCGCTGGACGAAAGCAACCCCACGCCGAGCCTGAAGCCCGTG
ACCCTGCAGCAGGTGCTGCCCCAGGCGGTGCTGCTGCCGAGCCGCGGGGTCAAG
CGCGAGGGCGAGAACATGTACCCGACCATGCAGATCATGGTGCCCAAGCGCCGG
CGCGTGGAGGAAGTGCTGGACAGCGTGAAAATGGATGTGGAGCCCGAGGTCAA
GGTGCGCCCCATCAAGCAGGTGGCGCCGGGCCTGGGCGTACAGACCGTGGACAT
TCAGATCCCCACCGACATGGATGTCGACAAAAAACCCTCGACCAGCATCGAGGT
GCAGACCGACCCCTGGCTTCCAGCCTCCACCTCTACCGCCTCTACTTCTACCGCC
GCCACGGCTACCGAGCCTCCCAGGAGGCGAAGATGGGGCGCCGCCAGCCGGCT
GATGCCCAACTACGTGTTGCATCCTTCCATCATCCCGACGCCGGGCTACCGCGGC
ACCCGGTACTACGCCAGCCGCAGGCGCCCAGCCAGCAAACGCCGCCGCCGCACC
GCCACCCGCCGCCGTCTGGCCCCCGCCCGCGTGCGCGCGTAACCACGCGCCGG
GGCCGCTCGCTCGTTCTGCCCACCGTGCGCTACCACCCCAGCATCCTTTAATCCG
TGTGCTGTGATACTGTTGCAGAGAGATGGCTCTCACTTGCCGCCTGCGCATCCCC
GTCCCGAATTACCGAGGAAGATCCCGCCGCAGGAGAGGCATGGCAGGCAGCGG
CCTGAACCGCCGCCGGCGCGGGCCATGCGCAGGCGCCTGAGTGGCGGCTTTCT
GCCCGCGCTCATCCCCATAATCGCCGCGGCCATCGGCACGATCCCGGGCATAGC
TTCCGTGGCGCTGCAGGCGTCGCAGCGCCGTTGATGTGCGAATAAAGCCTCTTTA
GACTCTGACACACCTGGTCCTGTATATTTTTAGAATGGAAGACATCAATTTTGCG
TCCCTGGCTCCGCGGCACGGCACGCGGCCGTTCATGGGCACCTGGAACGAGATC
GGCACCAGCCAGCTGAACGGGGCGCCTTCAATTGGAGCAGTGTCTGGAGCGGG
CTTAAAAATTTCGGCTCGACGCTCCGGAACTATGGGAACAAGGCCTGGAATAGT
AGCACGGGGCAGTTGTTAAGGGAAAAGCTCAAAGACCAGAACTTCCAGCAGAA
GGTGGTGGACGGGCTGGCCTCGGGCATTAACGGGGTGGTGGACATCGCAACCA
GGCCGTGCAGCGCGAGATAAACAGCCGCCTGGACCCGCGGCCGTCCACGGTGGT
GGAGATGGAAGATGCAACTCCGCCCAAGGGCGAGAAGCGGCCGCGGCCCGACG
CGGAGGAGACGATCCTGCAGGTGGATGAGCCTCCCTCGTACGAGGAGGCCGTCA
AGGCCGGCATGCCCACCACGCGCATCATCGCGCCGCTGGCCAGGGTGTAATGA
AACCCGCCACCCTTGATCTGCCTCCACCACCCACGCCCGCTCCACCGAAGGCAG
CTCCGGTTGTGCAGGCCCCCCGGTGGCGACCGCCGTGCGCCGCGTCCCCGCCC
GCCGCCAGGCCCAGAACTGGCAGAGCACACTGCACAGTATCGTGGGCCTGGGAG
TGAAAAGTCTGAAGCGCCGCCGATGCTATTGAGAGAGGAAAGAGGACACTA
AAGGGAGAGCTTAACTTGTATGTGCCTTACCGCCAGAGAACGCGCGAAGATGGC

TABLE 7-continued

Nucleic Acid Sequences of Vectors

SEQ ID NO Sequence

```
CACCCCCTCGATGATGCCGCAGTGGGCGTACATGCACATCGCCGGGCAGGACGC
CTCGGAGTACCTGAGTCCGGGTCTGGTGCAGTTTGCCCGCGCCACCGACACGTA
CTTCAGCCTGGGCAACAAGTTTAGGAACCCCACGGTGGCTCCCACCCACGATGT
GACCACGGACCGGTCCCAGCGTCTGACGCTGCGCTTCGTGCCCGTGGATCGCGA
GGACACCACGTACTCGTACAAGGCGCGCTTCACTCTGGCCGTGGGCGACAACCG
GGTGCTAGACATGGCCAGCACTTACTTTGACATCCGCGGCGTCCTGGACCGCGG
TCCCAGCTTCAAACCCTACTCGGGCACGGCCTACAACAGCCTGGCCCCCAAGGG
TGCCCCTAATTCCAGTCAGTGGGAAGAAAAAAAGAATGGAGCTGGAAATCAAA
CCGAAACTCATACGTATGGCGTCGCTCCCATGGGCGGAACTAACATTACAATTA
ATGGTTTGCAAATTGGAACTGAGGAAGAAGATGGAAATCCTACAAAGGAAATTT
TTGCAGATAAAACATTCCAGCCTGAACCTCAAATAGGAGAAGAAACTGGCAGG
ACACTGAGAATTTTTATGGCGGCAGAGCTCTTAAGAAAGACACCAAAATGAAAC
CTTGCTATGGCTCTTTTGCCAGACCTACTAACGAAAAGGGAGGTCAAGCTAAGTT
AAAACTTGACGCCCAAGGTCAGCCAACTAAAGATTATGACATTGACCTGGCTTT
CTTTGACTCACCTGGAGGAAACACAGCAACTGGTGGTCAAGAAGAGCTTAAAGC
AGACATTGTCATGTACACTGAGAATGCTTATCTGGAAACACCAGATACCCATGT
AGTTTACAAGCCAGGAACTTCTGATGACAGTTCTGCCGCCAACTTGGTTCAGCAG
TCCATGCCCAACAGGCCAAACTACATCGGCTTCAGAGACAACTTTGTGGGTCTC
ATGTATTATAACAGCACTGGCAACATGGGTGTGCTGGCTGGTCAGGCCTCTCAGT
TGAATGCCGTGGTTGACTTGCAAGACAGAAACACAGAGCTGTCTTACCAGCTCT
TGCTAGATTCTCTGGGTGACAGAACCAGATACTTTAGCATGTGGAACTCTGCGGT
GGACAGTTACGATCCCGATGTCAGGATCATTGAGAATCATGGCGTGGAAGATGA
ACTTCCAAACTATTGCTTCCCATTGGACGGCTCTGGCACCAATGCAGCTTATCAA
GGTGTTAAAGTTAAAAATGGGGAAGATGGTGATATTGAGAGCGAATGGGAAAA
AGACACCAATGTCGCAGCTCGTAACCAACTGTGCAAGGGCAACATCTTCGCCAT
GGGAGATCAACCTCCAGGCCAACCTGTGGAAGAGTTTTCTGTACTCGAACGTGGC
CCTGTACCTGCCCGACTCCTACAAGTACACGCCGGCCAACGTCAAGCTGCCCAC
CAACACCAACACCTACGAGTACATGAACGGCGCGTGGTAGCCCCCTCGCTGGT
GGACGCCTACATCAACATCGGCGCCCGCTGGTCGTTGGACCCCATGGACAACGT
CAACCCCTTCAACCACCACCGCAATGCGGGCCTGCGCTACCGCTCCATGCTTCTG
GGCAACGGCCGCTACGTGCCCTTCCACATCCAAGTGCCCCAAAAGTTCTTTGCCA
TCAAGAACCTGCTCCTGCTCCCGGGCTCCTACACCTACGAGTGGAACTTCCGCAA
GGACGTCAACATGATCCTGCAGAGTTCCCTCGGAAACGATCTGCGCGTCGACGG
CGCCTCCGTCCGCTTCGACAGCGTCAACCTCTACGCCACCTTCTTCCCCATGGCG
CACAACACCGCCTCCACCCTGGAAGCCATGCTGCGCAACGACACCAACGACCAG
TCCTTCAACGACTACCTCTCGGCCGCCAACATGCTCTACCCCATCCCGGCCAAGG
CCACCAACGTGCCCATCTCCATCCCCTCGCGCAACTGGGCCGCCTTCCGCGGCTG
GAGTTTCACCCGGCTCAAGACCAAGGAAACTCCATCCCTCGGCTCGGGTTTCGA
CCCCTACTTTGTCTACTCGGGCTCCATCCCCTATCTCGACGGGACCTTCTACCTCA
ACCACACCTTCAAGAAGGTCTCCATCATGTTCGACTCCTCGGTCAGCTGGCCCGG
CAACGACCGGCTGCTCACGCCGAACGAGTTCGAGATCAAGCGCAGCGTCGACGG
GGAGGGCTACAACGTGGCCCAATGCAACATGACCAAGGACTGGTTCCTCGTCCA
GATGCTCTCCCACTACAACATCGGCTACCAGGGTTTCCACGTGCCCGAGGGCTAC
AAGGACCGCATGTACTCCTTCTTCCGCAACTTCCAGCCCATGAGCAGGCAGGTG
GTCGATGAGATCAACTACAAGGACTACAAGGCCGTCACCCTGCCCTTCCAGCAC
AACAACTCGGGTTTCACCGGCTACCTCGCACCCACCATGCGTCAGGGGCAGCCC
TACCCCGCCAACTTCCCCTACCCGCTCATCGGCCAGACAGCCGTGCCCTCCGTCA
CCCAGAAAAGTTCCTCTGCGACAGGGTCATGTGGCGCATCCCCTTCTCCAGCA
ACTTCATGTCCATGGGCGCCCTTACCGACCTGGGTCAGAACATGCTCTACGCCAA
CTCGGCCCACGCGCTCGACATGACCTTCGAGGTGGACCCCATGGATGAGCCCAC
CCTCCTCTATCTTCTCTTTGAAGTTTTCGACGTGGTCAGAGTGCACCAGCCGCAC
CGCGGCGTCATCGAGGCCGTCTACCTGCGCACGCCCTTCTCCGCCGGCAACGCC
ACCACCTAAGCATGAGCGGCTCCAGCGAAAGAGAGCTCGCGGCCATCGTGCGCG
ACCTGGGCTGTGGGCCCTACTTTTTGGGCACCCACGACAAGCGTTTCCCTGGCTT
CCTCGCCGGCGACAAGCTGGCCTGCGCCATCGTCAACACGGCCGGCCGCGAGAC
CGGAGGCGTGCACTGGCTCGCCTTTGGCTGGAACCCGCGCTCGCGCACCTGCTA
CATGTTCGACCCCTTTGGGTTCTCGGACCGCCGGCTCAAGCAGATTTACAGCTTC
GAGTACGAGGCCATGCTGCGCCGCAGCGCCTGGCCTCCTCGCCCGACCGCTGT
CTCAGTCTCGAGCAGTCCACCCAGACCGTGCAGGGGCCCGACTCCGCCGCCTGC
GGACTTTTCTGTTGCATGTTCTTGCATGCCTTCGTGCACTGGCCCGACCGACCCA
TGGACGGAAACCCCACCATGAACTTGCTGACGGGGGTGCCCAACGGCATGCTAC
AATCGCCACAGGTGCTACCCACCCTCCGGCGCAACCAGGAGGAGCTCTACCGCT
TCCTCGCGCGCCACTCCCCTTACTTTCGCTCCCACCGCGCCGCCATCGAACACGC
CACCGCTTTTGATAAAATGAAACAACTGCGTGTATGACTCAAATAAACAGCACT
TTTATTTTACATGCACTGGAGTATATGCAAGTTATTTAAAAGTCGAAGGGGTTCT
CGCGCTCGTCGTTGTGCGCCGCGCTGGGGAGGGCCACGTTGCGGTACTGGTACTT
GGGATACCACTTGAACTCGGGAATCACCAGTTTGGGCACTGGGGTCTCGGGGAA
GGTCTCGCTCCACATGCGCCGGCTCATCTGCAGGGCGCCCAGCATGTCAGGCGC
GGAGATCTTGAAATCGCAGTTGGGACCGGTGCTCTGTGCGCGCGAGTTGCGGTA
CACAGGGTTGCAGCACTGGAACACCATCAGACTGGGGTACTTCACACTGGCCAG
CACGCTCTTTGTCGCTGATCTGATCCTTGTCCAGATCCTCGGCGTTGCTCAGGCCG
AACGGGGTCATCTTGCACAGCTGGCGGCCCAGGAAGGGCACGCTCTGAGGCTTG
TGGTTACACTCGCAGTGCACGGGCATCAGCATCATCCCCGCGCCGCGCTGCATAT
TAGGGTAGAGGGCCTTGACAAAGGCCGCGATCTGCTTGAAAGCTTGCTGGGCCT
TGGCCCCCTCGCTGAAAAACAGCCCACAGCTCTTCCCGCTGAACTGGTTATTCCC
GCACCCGGCATCATGCACGCAGCAGCGCGCGTCATGGCTGGTCAGTTGCACCAC
```

TABLE 7-continued

Nucleic Acid Sequences of Vectors

SEQ ID NO Sequence

```
GCTTCGGCCCCAGCGGTTCTGGGTCACCTTAGCCTTGCTGGGCTGCTCCTTCAAC
GCGCGCTGACCGTTCTCGCTGGTCACATCCATCTCCACCACGTGGTCCTTGTGGA
TCATCACCGTCCCATGCAGACACTTGAGCTGGCCTTCCACCTCGGTGCAGCCGTG
GTCCCACAGGGCGCAGCCGGTGCACTCCCAGTTCTTGTGCGCGATCCCGCTGTGG
CTGAAGATGTAACCTTGCAACATGCGGCCCATGATGGTGCTAAATGCTTTCTGGG
TGGTGAAGGTCAGTTGCATCCCGCGGGCCTCCTCGTTCATCCAGGTCTGGCACAT
CTTTTGGAAGATCTCGGTCTGCTCGGGCATGAGCTTGTAAGCATCGCGCAGGCCG
CTGTCGACGCGGTAGCGTTCCATCAGCACGTTCATGGCATCCATGCCCTTCTCCC
AGGACGAGACCAGCGGCAGACTCAGAGGGTTGCGCACGTTCAGGACACCAGGG
GTCGCGGGCTCGACGATGCGTTTTCCGTCCTTGCCTTCCTTCAACAGAACCGGCG
GCTGGCTGAATCCCACTCCCACGATCACGGCATCTTCCTGGGGCATCTCTTCGTC
GGGGTCTACCTTGGTCACATGCTTGGTCTTCCTGGCTTGCTTCTTTTTTGGAGGGC
TGTCCACGGGGACCACGTCCTCCTCGGAAGACCCGGAGCCCACCCGCTGATACT
TTCGGCGCTTGGTGGGCAGAGGAGGTGGTGGCGGCGAGGGGCTCCTCTCCTGCT
CCGGCGGATAGCGCGCCGACCCGTGACCCCGGGGCGGAGTGGCCTCTCGGTCCA
TGAACCGGCGCACGTCCTGACTGCCGCCGGCCATTGTTTCCTAGGGGAAGATGG
AGGAGCAGCCGCGTAAGCAGGAGCAGGAGGAGGACTTAACCACCCACGAGCAA
CCCAAAATCGAGCAGGACCTGGGCTTCGAAGAGCCGGCTCGTCTAGAACCCCCA
CAGGATGAACAGGAGCACGAGCAAGACGCAGGCCAGGAGGAGACCGACGCTGG
GCTCGAGCATGGCTACCTGGGAGGAGAGGAGGATGTGCTGCTGAAACACCTGCA
GCGCCAGTCCATCATCCTCCGGGACGCCCTGGCCGACGGAGCGAAACCCCCCT
CAGCGTCGAGGAGCTGTGTCGGGCCTACGAGCTCAACCTCTTCTCGCCGCGCGT
GCCCCCCAAACGCCAGCCCAACGGCACCTGCGAGCCCAACCCGCGTCTCAACTT
CTATCCCGTCTTTGCGGTCCCCGAGGCCCTTGCCACCTATCACATCTTTTTCAAGA
ACCAAAAGATCCCCGTCTCCTGTCGCGCCAACCGCACCCGCGCCGACGCGCTCC
TCGCTCTGGGGCCCGGCGCGCGCATACCTGATATCGCTTCCCTGGAAGAGGTGC
CCAAGATCTTCGAAGGGCTCGGTCGGGACGAGACGCGCGCGGCGAACGCTCTGA
AAGAAACAGCAGAGGAAGAGGGTCACACTAGCGCCCTGGTAGAGTTGGAAGGC
GACAACGCCAGGCTGGCCGTGCTCAAGCGCAGCGTTGAGCTCACCCACTTCGCC
TACCCCGCCGTCAACCTCCCGCCCAAGGTCATGCGTCGCATCATGGATCAGCTCA
TCATGCCCCACATCGAGGCCCTCGATGAGACCCAAGAGCAGCGCCCAGAGGACG
CCCGGCCCGTGGTCAGCGACGAGCAGCTCGCGCGCTGGCTCGGGACCCGCGACC
CCCAGACCCTGGAGCAGCGGCGCAAGCTGATGCTGGCCGTGGTCCTGGTCACCC
TCGAGCTCGAATGCATGCGCCGCTTCTTCAGCGACCCCGAGACCCTGCGCAAGG
TCGAGGAGACCCTGCACTACACTTTCAGGCACGGCTTCGTCAGGCAGGCCTGCA
AGATCTCCAACGTGGAGCTGACCAACCTGGTCTCCTGCCTGGGGATCCTGCATG
AGAACCGCCTTGGGCAGACCGTGCTCCACTCTACCCTGAAGGGCGAGGCGCGGC
GGGACTATGTCCGCGACTGCGTCTTTTCTCTTTCTCTGCCACACATGGCAAGCAGC
CATGGGCGTGTGGCAGCAGTGTCTCGAGGACGAGAACCTAAAGGAGCTGGACA
AGCTTCTTGCTAGAAACCTTAAAAAGCTGTGGACGGGCTTCGACGAGCGCACCG
TCGCCTCGGACCTGGCCGAGATCGTCTTCCCTGAGCGCCTTAGGCAGACGCTGA
AAGGCGGGCTGCCCGACTTCATGAGCCAAAGCATGTTGCAAAACTACCGCACTT
TCATTCTCGAACGATCGGGGATCCTGCCCGCCACCTGCAACGCCTTCCCCTCCGA
CTTTGTCCCGCTTAGCTACCGCGAGTGTCCCCCGCCGCTGTGGAGCCACTGCTAC
CTCTTGCAGTTGGCTAACTACATCGCCCACCACTCGGATGTGATCGAGGACGTGA
GCGGCGAGGGGCTGCTAGAGTGCCACTGCCGCTGCAACCTGTGCTCCCCGCACC
GCTCCCTGATCTGCAACCCCCAGCTACTCAGCGAGACCCAGGTCATCGGTACCTT
CGAGCTGCAAGGTCCGGAGAAGTCCACCGCTCCGCTGAAACTCACGCCGGGGTT
GTGGACTTCCGCGTACCTGCGCAAATTTGTACCCGCTGACTACCACGCCCATGAG
ATAAAGTTCTTCGAGGACCAATCGCGTCCGCAGCATGCGGATCTCACGGCCTGC
GTCATCACCCAGGGCGCGATCCTCGCCCAATTGCACGCCATCCAAAAATCCCGC
CAAGAGTTTCTTCTGAAAAAGGGTAGAGGGGTCTACCTGGACCCCCAGACGGGC
GAGGTGCTCAACCCGGGTCTCCCCCAGCATGCCGAGGAAGAAGCAGGAGCCGCT
AGTGGAGGAGATGGAAGAAGAATGGGACAGCCAGGCAGAGGAGGACGAATGG
GAGGAGGAGACAGAGGAGGAAGAATTGGAAGAGGTGGAAGAGGAGCAGGCAA
CAGAGCAGCCCGTCGCCGCACCATCCGCGCCGGCAGCCCCGCCGGTCACGGATA
CAACCTCCGCTCCGGTCAAGCCTCCTCGTAGATGGGATCGAGTGAAGGGTGACG
GTAAGCACGAGCGGCAGGGCTACCGATCATGAGGGCCCACAAAGCCGCGATC
ATCGCCTGCTTGCAAGACTGCGGGGGAACATCGCTTTCGCCCGCCGCTACCTGC
TCTTCCACCGCGGGGTGAACATCCCCGCAACGTGTTGCATTACTACCGTCACCT
TCACAGCTAAGAAAAAATCAGAAGTAAGAGGGAGTCGCCGAGGAGGCCTGAGG
ATCGCGGCGAACGAGCCCTTGACCACCAGGGAGCTGAGGAACCGGATCTTCCCC
ACTCTTTATGCCATTTTTCAGCAAAGTCGAGGTCAGCAGCAAGAGCTCAAAGTA
AAAAACCGGTCTCTGCGCTCGCTCACCCGCAGTTGCTTGTACCACAAAAACGAA
GATCAGCTGCAGCGCACTCTCGAAGACGCCGAGGCTCTGTTCCACAAGTACTGC
GCGCTCACTCTTAAAGACTAAGGCGCGCCCACCCGGAAAAAGGCGGGAATTAC
CTCATCGCCACCATGAGCAAGGAGATTCCCACCCCTTACATGTGGAGCTATCAG
CCCCAGATGGGCCTGGCCGCAGGCGCCTCCCAGGACTACTCCACCCGCATGAAC
TGGCTCAGTGCCGGCCCCTCGATGATCTCACAGGTCAACGGGGTCCGTAACCAT
CGAAACCAGATATTGTTGGAGCAGGCGGCGGTCACCTCCACGCCCAGGGCAAAG
CTCAACCCGCGTAATTGGCCCTCCACCCTGGTGTATCAGGAAATCCCCGGACA
ACTACCGTACTACTTCCGCGTGACGCACTGGCCGAAGTCCGCATGACTAACTCA
GGTGTCCAGCTGGCCGGCGGCGCTTCCCGGTGCCCGCTCCGCCCACAATCGGGT
ATAAAAACCCTGGTGATCCGAGGCAGAGGCACACAGCTCAACGACGAGTTGGTG
AGCTCTTCAATCGGTCTGCGACCGGACGGAGTGTTCCAACTAGCCGGAGCCGGG
AGATCCTCCTTCACTCCCCACCAGGCCTACCTGACCTTGCAGAGCAGCTCTTCGG
```

TABLE 7-continued

Nucleic Acid Sequences of Vectors

SEQ ID NO Sequence

AGCCTCGCTCCGGAGGCATCGGAACCCTCCAGTTCGTGGAGGAGTTTGTGCCCTC
GGTCTACTTCAACCCCTTCTCGGGATCGCCAGGCCTCTACCCGGACGAGTTCATA
CCGAACTTCGATGCAGTGAGAGAAGCGGTGGACGGCTACGACTGAATGTCCAAT
GGTGACTCGGCTGAGCTCGCTCGGTTGAGGCATCTGGACCACTGCCGCCGCCTG
CGCTGCTTCGCCCGGGAGAGCTGCGGACTCATCTACTTTGAGTTTCCCGAGGAGC
ACCCCAACGGCCCTGCACACGGAGTGCGGATCACCGTAGAGGGCACCACCGAGT
CTCACCTGGTCAGGTTCTTCACCCAGCAACCCTTCCTGGTCGAGCGGGACCGGGG
CGCCACCACCTACACCGTCTACTGCATCTGTCCTACCCCGAAGTTGCATGAGAAT
TTTTGTTGTACTCTGTGTGCTGAGTTTAATAAAAGCTAAACTCCTACAATACTCT
GGGATCCCGTGTCGTCGCACTCGCAACGAGATCTTCAACCTCACCAACCAGACT
GAGGTAAAACTCAACTGCAGACCAGGGGGCAAATACATCCTCTGGCTCTTTGAA
AACACTTCCTTCGCAGTCTCCAACGCCTGCGCCAACGACGGTATTGAAATACCCA
ACAACCTTACCAGTGGACTAACTTACACTACCAGAAAGACTAAGCTAGTACTCT
ACAATCCTTTTGTAGAGGGAACCTACCACTGCCAGAGCGGACCTTGCTTCCACAC
TTTCACTTTGGTGAACGTTACCGACAGCAGCGCAGCCGCTCCAGAAACATCTAA
CCTTTTTGATACTAACACTCCTAAAACCGGAGGTGAGCTCTGGGTTCCCTCTTTA
ACAGAGGGGGGTAAACATATTGAAGCGGTTGGGTATTTGATTTTAGGGGTGGTC
CTGGGTGGGTGCATAGCGGTGCTGTATTACCTTCCTTGCTGGATCGAAATCAAAA
TCTTTATCTGCTGGGTCATACATTGTTGGGAGGAACCATGAAGGGGCTCTTGCTG
ATTATCCTTTTCCTGGTTGGGGGTGTACTGTCATGCCACGAACAGCCACGATGTA
ACATCACCACAGGCAATGAGAGGAGTGTGATATGCACAGTAGTCATCAAATGCG
AGCATACATGTCCTCTCAACATCACATTCAAGAATAAGACCATGGGAAATTCAT
GGGTGGGCGATTGGGAACCAGGAGATGAGCAGAACTACACGGTCACTGTCCATG
GTAGCGATGGGAATCACACTTTCGGTTTCAAATTCATTTTTGAAGTCATGTGTGA
TATCACACTGCATGTGGCTAGACTTCATGGCTTGTGGCCCCCTACCAAGGAGAAC
ATGGTTGGGTTTTCTTTGGCTTTTGTGATCATGGCCTGCTTTATGTCAGGTCTGCT
GGTAGGGGCTTTAGTATGGTTCCTGAAGCGCAAGCCTAGGTATGGAAATGAGGA
GAAGGAAAAATTGCTATAAATCTTTTTCTTTTCACAGCACCATGAATACTTTGAC
CAGTGTCGTGCTGCTCTCTCTTCTTGTAGCTTTTAGTCAGGCAGGAATTATTAACT
TAAATGTATCATGGGGAATGAATCTAACTTTAGTGGGACCATCAGACCTGCCAG
TTACATGGTATGATGGAAAGGGAATGCAGTTTTGTGATGGAAATACAATTAAGA
ACCCACAAATCAAGCATAGCTGTAATCAACAGAATCTAACTTTACTTAATGCTG
ACAAGTCTCATGAAAGAACTTACCTAGGTTACAGACATGACAGTAAGGGAAAAG
TAGACTATAAGGTTACAGTCATACCACCTCCTCCAGCCACTCGCAAGCCTTTGTC
AGAGCCTCATTATGTTACTGTGACTATGGGCGATAACATAACTTTAGTGGGACCC
TCAGACCTGCCAGTTACATGGTATGATGGAGAAGGAAATAAATTCTGCGATGGA
GAAAAAGTTGAACATGCAGAATTTAATCATACATGTAACATCCAGAACCTGACA
CTGCTCTTTGTCAACTTAACGCATAATGGAGCATACATTGGTTATAACAAAGACG
GTTCTGATAGAGAATTATATGAGGTGTCAGTCAAAACCTTGTTTCAGAACGGGG
CTGGACAAGGTAATAAAGGGAAACCTAATACTGCTCAAAGTGGTGGTAAAAAA
ACCAAAACAGAACATAGAAACCAGAGTCCAAAAAGAAAATCAACAAATAACCT
TCAGCCAACACAATTGTATGTTAGGCCTTTTACTAATGTTAGTTTAACTGGACCT
CCAAATGGCAAGGTTACTTGGTATGATGGCGAACTTAATGATCCATGTGAACAA
AAGTACAAACTCAGAACTTTTTGCAATCAGCAAATCTAACTTTAATTAATGTAA
GCAGCACTTATGATGGCATCTATTATGGCACTGATGAAAAGATAAGGCAAATC
GTTACAGAATAAAAGTAAATACTACAAATCACAAAACTGTTAAAATTAAGCCAC
ATACCAGAGAACCTCCTGCTGTACAAGAAAAACAGTTTGAATTACAAGATGCAG
AAACTGATGAAAACGAATCAAAAATTCCCTCAGCTACTGTGGCAATCGTGGTGG
GAGTGATTGCGGGCTTTGTAACTCTGATCATTGTCTTCATATGCTACATCTGCTG
CCGCAAGCGTCCCAGGTCATACAATCATATGGTAGACCCACTACTCAGCTTCTCT
TACTGAAGCTCAGTCACTCTCATTTCAGAACCATGAAGGCTTTCACAGCTTGCGT
TCTGATTAGCATAGTCACACTTAGTTCAGCTGCAATGATTAATGTTAATGTCACT
AGAGGTGGTAAAATTACATTGAATGGGACTTATCCACAAACTACATGGACAAGA
TATCATAAAGATGGATGGAAAAATATCTGTGAATGGAATGTTACTGCATATAAA
TGCTTCAATAATGGAAGCATTACTATTACTGCCACTGCCAACATTACTTCTGGCA
CATACAAAGCTGAAAGCTATAAAAATGAAATCAAAAAACTAACCTATAAAAAC
AACAAAACCACATTTGAAGATTCTGGAAATTATGAACATCAAAAATTATCTTTTT
ATATGTTGACAATAATTGAACTGCCTACAACTAAGGCTCCCACCACAGTTAGGA
CAACTATTAAGACCACTACTCACACTACAGTGCAAAATACTACTTTATTGATTGG
GTTTTTACTGAGAGAGAATGAAAGTACTACTGAACAGACAGAGGCTACCTCAAG
TGCCTTCAGCAGCACTGCAAATTTAACTTCGCTTGCTTGGACTAATGAAACCGGA
GTATCATTGATGCATGCCAGCCTTACTCAGGTTTGGATATTCAAATTACTTTTCT
GGTTGTCTGTGGGATCTTTATTCTTGTGGTTCTTCTGTACTTTGTCTGCTGCAAAG
CCAGAGAGAAATCTAGGAGGCCCATCTACAGGCCAGTGATTGGGAACCTCAGC
CACTCCAAGTGGATGGAGGCTTAAGGAATCTTCTCTTCTCTTTTACAGTATGGTG
ATCAGCCATGATTCCTAGGTTCTTCCTATTTAACATCCTCTTTTGTCTCTTCAACA
TCTGTGCTGCCTTCGCGGCCGTCTCGCACGCCTCGCCGACTGTCTAGGGCCTTT
CCCCACCTACCTCCTCTTTGCCCTGCTCACCTGCACCTGCGTCTGCAGCATTGTCT
GCGTGGTCATCACCTTCCTGCAGCTCATCGACTGGTGCTGCGCGCTATAATTA
TCTCCACCACAGTCCCGAATACAGGGACGAGAACGTAGCCAGAATCTTAAGGCT
CATCTGACCATGCAGACTCTGCTCATGCTGCTATCCCTCCTATCCCCTGCCCTCGC
CACTTCTGCTGACTCTAAATGCAAATTCGCGGAGATATGGAATTTCTTAGATTGC
TATCAGGAGAAATTGATATGCCCTCCTATTACTTGGTGTTTGTGGGAATAGTCA
TGGTCTGCTCCTGCACTTTCTTTGCCATCATAATCTACCCCTGTTTTGATCTCGGC
TGGAACTCTGTTGAGGCATTCACATACACACTAGAAAGCAGTTCACTAGCCTCC
ACGCCACCGCCCACACCGCCTCCCCGCAGAAATCAGTTCCCACTGATTCAGTACT

TABLE 7-continued

Nucleic Acid Sequences of Vectors

| SEQ ID NO | Sequence |
|---|---|
| | TAGAAGAGCCCCCTCCCCGGCCCCCTTCCACTGTTAGCTACTTTCACATAACCGG<br>CGGCGATGACTGACCACCACCTGGACCTCGAGATGGACGGCCAGGCCTCCGAGC<br>AGCGCATCCTGCAACTGCGCGTCCGTCAGCAGCAGGAGCGGGCCGCCAAGGAGC<br>TCCTCGATGCCATCAACATCCACCAGTGCAAGAAGGGCATCTTCTGCCTTGTCAA<br>ACAGGCAAAGATCACCTACGAGCTCGTGTCCGGCGGCAAGCAGCATCGCCTCAC<br>CTATGAGCTGCCCCAGCAGAAGCAGAAGTTCACCTGCATGGTGGGCGTCAACCC<br>CATAGTCATCACCCAGCAGTCGGGCGAGACCAGCGGCTGCATCCACTGCTCCTG<br>CGAAAGCCCCGAGTGCATATACTCCCTCCTCAAGACCCTTTGCGGACTCCGCGAC<br>CTCCTCCCCATGAACTGATGTTGATTAAAAGCCCGAAAACCAATCAGACCCTTCC<br>CCCATTTCCCCATTCCCAATTACTCATAAAATAAATCATTGGAATTAATCATTCA<br>ATAAAAATCACTTACTTGAAATCTGAAAGTATGTCTCTGGTGTAGTTGTTCAACA<br>GCACCTCGGTACCCTCCTCCCAGCTCTGGTACTCCAGTCCCCGGCGGGCGGCGAA<br>CTTCCTCCACACCTTGAAAGGGATGTCAAATTCCTGGTCACAATTTTCATTGTC<br>TTCCCTCTCAGATGGCAAAGAGGCTCCGGGTGGAAGATGACTTCAACCCCGTCT<br>ACCCCTATGGCTACGCGCGGAATCAGAATATCCCCTTCCTCACTCCCCCCTTTGT<br>CTCCTCCGATGGATTCCAAAACTTCCCCCCTGGGGTCCTGTCACTCAAACTAGCT<br>GACCCAATAGCCATCGTCAATGGGAATGTCTCACTCAAAGTGGGAGGGGGTCTC<br>ACTTTGCAAGATGGAACTGGAAAACTAACAGTCAATGCTGATCCACCTTTGCAA<br>CTTACAAACAACAAATTAGGGATTGCTTTGGACGCTCCATTTGATGTTATAGATA<br>ATAAACTCACATTGTTAGCGGGCCATGGCTTGTCTATTATAACAAAAGAAACAT<br>CAACACTGCCTGGCTTGATTAATACTCTTGTAGTATTAACTGGAAAGGGTATTG<br>AACAGAATCAACAGATAATGGCGGAAGCGTATGTGTTAGAGTTGGAGAAGGTG<br>GCGGCTTATCATTTAATAATGATGGAGACTTGGTAGCATTTAATAAAAAGAAG<br>ATAAGCGCACCCTATGGACAACTCCAGACACATCTCCAAATTGCAAGATTGATC<br>AGGATAAGGACTCTAAGTTAACTCTGGTCCTTACAAAGTGTGGAAGTCAAATAT<br>TGGCTAATGTGTCATTAATTGTCGTAGCTGGTAAGTACAAAATTATCAATAACAA<br>TACTCAACCAGCTCTCAAAGGATTTACCATTAAATTATTGTTTGATGAAAATGGA<br>GTACTTATGGAATCTTCAAATCTTGGTAAATCATATTGGAACTTTAGAAATGAAA<br>ATTCAATTATGTCAACAGCTTATGAAAAAGCTATTGGATTCATGCCTAATTTGGT<br>AGCCTATCCAAAACCTACCGCTGGCTCTAAAAAATATGCAAGAGATATAGTTTA<br>TGGAAACATCTACCTTGGTGGAAAGCCAGATCAACCAGTAACCATTAAAACTAC<br>CTTTAATCAGGAAACTGGATGTGAATATTCTATCACATTTGATTTTAGTTGGGCC<br>AAGACTTATGTAGATGTTGAATTTGAAACAACCTCTTTTACCTTTTCCTATATCGC<br>CCAAGAATGAAAGACCAATAAACGTGTTTTTCATTTCAAAATTTTCATGTATCTT<br>TATTGATTTTTACACCAGCACGGGTAGTCAGTCTCCCACCACCAGCCCATTTCAC<br>AATGTACACGGTCCTTTCAGCACGGGTGGCCTTAAATAGGGGAATGTCCTGATT<br>AGTGCGGGAACTGGTTTTAGTGTCTATAATCCACACAGTTTCCTGGCGAGCCAAA<br>CGGGGGTCGGTGATTGAGATGAAGCCGTCCTCTGGAAAGTCATCCAAGCGGGCC<br>TCACAGTCCAAGGTCACAGTCGGTGGAATGAGAAGAACGCACAGATTCATACT<br>CGGAAAACAGGATAGGTCTGTGCCTCTCCATCAGCGCCCTCAACAGTCTCTGCC<br>GCCGGGGCTCGGTGCGACTGCTGCAGATGGGATCGGGATCGCAAGTCTCTTTGA<br>CTATGATCCCCACAGCCTTCAGCAACAGTCTCCTGGTGCGACGGGCACAGCACC<br>GCATCCTGATCTCACTCAAGTTCTCACAGTAAGTGCAGCACATAATCACCATGTT<br>ATTCAGCAGCCCATAATTCAGGGCGCTCCAGCCAAAGCTCATGTTGGGGATAAT<br>GGAACCCACGTGACCATCGTACCAGATGCGGCAGTATATCAGGTGCCTGCCCCT<br>CATGAACACACTGCCCATATACATGATCTCTTTGGGCATGTCTCTGTTCACAATC<br>TGACGGTACCAGGGGAAGCGCTGGTTGAACATGCACCCGTAAATGACTCTCCTG<br>AACCACACGGCCAGCAG |
| SEQ ID<br>NO: 1446 | CATCATCAATAATATACCCCACAAAGTTTACAAAAGTTAATATGCAAATGAGCT<br>TTTGAATTTTAACGGTTTTGGGGCGGAGCCAACGCTGATTGGACGAGAAGCGGT<br>GATGCAAATGACGTCACGACGCACGGCCGACGGTCGCCGCGGAGGCGTGGCCTA<br>GCCCGGAAGCAAGTCGCGGAGCTGATGACGTATAAAAAAGCGGACTTTAGACCC<br>GGAAACGGCCGATTTTCCCGCGGCCACGCCCGGATATGAGGTAATTCTGGGCGG<br>ATGCAAGTGAAATTAGGTCATTTTGGCGCGAAAACTGAATGAGGAAGTGAAAAG<br>TGAAAAATACCGGTCCCGCCCAGGGTGGAATATTTACCGAGGGCCGAGAGACTT<br>TGACCGATTACGTGGGGGTTTCGATTGCGGTGTTTTTTCGCGAATTTCCGCGTC<br>CGTGTCAAAGTCCGGTGTTTATGTCACAGATCAGCTGATCCACAGGGTATTTAAA<br>CCAGTCGAGCCCGTCAAGAGGCCACTCTTGAGTGCCAGCGAGTAGAGATTTCTC<br>TGAGCTCCGCTCCCAGAGTCTGAGAAAAATGAGACACCTGCGCCTCCTGCCTGG<br>AACTGTGCCTATGGACATGGCTGTGCTTTTACTGGATGACTTTGTGAATACAGTA<br>TTGGAGGACGAACTGCATCCAAGTCCGTTCGAGCTGGGACCCACACTTCAGGAC<br>CTTTATGATCTGGAGGTAGATGCCCATGATGACGACCCGAACGAGAGGCTGTG<br>AATTTAATATTTCCAGAATCTATGATTCTTCAGGCTGACATAGCCAACGAATCTA<br>TACCTACTCCACTTCATACACCGACTTTACCACCCATACCTGAATTGGAAGAGGA<br>GGACGAACTAGACCTCCGGTGTTATGAGGAAGGTTTTCCTCCCAGCGATTCAGA<br>GGACGAACGGGGTGAGCAGAGTATGGCTATAATATCAGACTATGCTTGTGTGGT<br>TGTGGAAGAGCATTTTGTGTTGGACAATCCTGAGGTGCCAGGGCAAGGCTGTAG<br>ATCCTGCCAATATCACCGGGATCAGACCGGAGACCCAAATGTTTCCTGCGCTCTG<br>TGTTACATGAAAATGAGCTTCAGCTTTATTTACAGTAAGTGGAGTGAATGTGAG<br>AGAGGCTGAGTGCTTAACACATAACTGTAATGCTTGAACAGCTGCGCTAAGTGT<br>GGTTTATTTTTGTTACTAGGTCCGGTGTCAGAGGATGAGTCATCACCCTCAGAAG<br>AAGACCACCCGTGTCCCCCTGAGCTGTCAGGCGAAACGCCCCTGCAAGTGCACA<br>GACCCACCCCAGTCAGACCCAGTGGCGAGAGGCGAGCAGCTGTTGAAAAAATTG<br>AGGACTTGTTACATGACATGGGTGGGGATGAACCTTTGGACCTGAGCTTGAAAC<br>GCCCCAGGAACTAGGCGCAGCTGCGCTTAGTCATGTGTAAATAAAGTTGTACAA |

TABLE 7-continued

Nucleic Acid Sequences of Vectors

SEQ ID NO Sequence

TAAAAGTATATGTGACGCATGCAAGGTGTGGTTTGACTCATGGGCTGGGCTTAG
TCCTATATAAGTGGCAACACCTGGGCACTCGGGCACAGACCTTCAGGGAGTTCC
TGATGGATGTGTGGACTATCCTTGCAGACTTTAGCAAGACACGCCGGCTTGTAG
AGGATAGTTCAGACGGGTGCTCCGGGTTCTGGAGACACTGGTTTGGAACTCCTCT
ATCTCGCCTGGTGTACACAGTTAAGAAGGATTATAAAGAGGAATTTGAAAATCT
TTTTGCTGACTGCTCTGGTCTGCTAGATTCTCTGAATCTTGGCCACCAGTCCCTTT
TCCAGGAAAGGGTACTCCACAGCCTTGATTTTTCCAGCCCAGGGCGCACTACAG
CCGGGGTTGCTTTTGTGGTTTTTCTGGTTGACAAATGGAGCCAGGACACCCAACT
GAGCAGGGGCTACATCCTGGACTTCGCAGCCATGCACCTGTGGAGGGCCTGGAT
CAGGCAGCGGGGACAGAGAATCTTGAACTACTGGCTTCTACAGCCAGCAGCTCC
GGGTCTTCTTCGTCTACACAGACAAACATCCATGTTGGAGGAAGAAATGAGGCA
GGCCATGGACGAGAACCCGAGGAGCGGCCTGGACCCTCCGTTGGAAGAGGAGC
TGGATTGAATCAGGTATCCAGCCTGTACCCAGAGCTTAGCAAGGTGCTGACAAC
CATGGCCAGGGGAGTGAAGAGGGAGAGGAGTGATGGGGGCAATACCGGGATGA
TGACCGAGCTGACTGCCAGCCTGATGAATCGGAAGCGCCCAGAGCGCCTTACCT
GGTACGAGCTACAGCAGGAGTGCAGGGATGAGATAGGCCTGATGCAGGATAAA
TATGGCCTGGAGCAGATAAAAACTCACTGGTTGAACCCAGATGAGGATTGGGAG
GAGGCCATAAAGAAATATGCCAAGATAGCCCTGCGCCCAGATTGCAAGTACATA
GTGACCAAGACGGTGAATATCAGACATGCCTGCTACATCTCAGGGAACGGGCA
GAGGTGGTCATCGATACCCTGGACAAGTCAGCATTCAGGTGTTGCATGATGGGA
ATGAGAGCCGGAGTGATGAATATGAATTCCATGATCTTCATGAACATGAAGTTC
AATGGAGAGAAGTTTAATGGGGTGCTGTTCATGGCCAACAGCCACATGACCCTG
CATGGTTGCAGCTTCTTCGGTTTCAACAACATGTGCGCCGAGGTCTGGGGAGCTG
CTAAGATCAGGGGCTGTAAGTTTTATGGCTGCTGGATGGGCGTGGTCGGAAGAC
CCAAGAGCGAGATGTCTGTGAAGCAGTGTGTGTTTGAGAAGTGCTACCTGGGGG
TGTCTACAGAGGGCAATGCTAGAGTGAGACATTGCTCTTCCCTGGAGACGGGCT
GCTTCTGCCTGGTGAAGGGCACAGCTTCGATCAAGCATAATGTGGTGAAAGGCT
GCACGGATGAGCGCATGTACAACATGCTGACCTGCGACTCAGGGGTCTGTTATA
TCCTGAAGAACATCCATGTGACCGCCCACCCCAGAAAGAAGTGGCCAGTGTTTG
AGAATAACCTGCTAATCAAGTGCCATATGCACCTGGGAGCCAGAAGGGGCACCT
TCCAGCCGTACCAGTGCAACTTTAGCCAGACCAAGCTGCTGTTGGAGAACGATG
CCTTCTCCAGGGTGAACCTGAACGGCATCTTTGACATGGATGTCTCGGTGTACAA
GATCCTGAGATACGATGAAACCAGGTCCAGGGTGCGCGCTTGCGAGTGCGGGGG
CAGACACACCAGGATGGCCTGTGGCCCTGGATGTGACAGAGGAGCTGAGACC
AGACCACCTGGTGATGGCCTGTACCGGGACCGAGTTCAGCTCCAGTGGGGAGGA
CACAGATTAGAGGTAGGTTTGAGTAGTGGGCGTGGCTAATGTGACTATAAAGGT
GGGTGTCTTACGAGGGTCTTTTTGCTTTTCTGCAGACATCATGAACGGGACCGGC
GGGGCCTTCGAAGGGGGGCTTTTTAGCCCTTATTTGACAACCCGCCTGCCGGAT
GGGCCGGAGTTCGTCAGAATGTGATGGGATCTACGGTGGATGGGCGCCCAGTGC
TTCCAGCAAATTCCTCGACCATGACCTACGCGACCGTGGGGACGAGCTCGTCGC
TCGACAGCACCGCCGCAGCCGCGGCAGCCGCAGCCGCCATGACAGCGACGAGA
CTGGCCTCGAGCTACATGCCCAGCAGCGGTAGCAGCCCCTCTGTGCCCAGTTCCA
TCATCGCCGAGGAGAAACTGCTGGCCCTGCTGGCCGAGCTAGAAGCCCTGAGCC
GCCAGCTGGCCGCCCTGACCCAGCAGGTGTCCGATCTCCGCGAGCAACAGCAGC
AGCAAAATAAATGATTCAATAAACACAGATTCTGATTCAAACAGCAAAGCATCT
TTATTATTTATTTTTTCGCGCGCGGTAGGCCCTGGTCCACCTCTCCCGATCATTGA
GAGTGCGGTGGATTTTTTCCAGGACCCGGTAGAGGTGGGATTGGATGTTGAGGT
ACATGGGCATGAGCCCGTCCCGGGGGTGGAGGTAGCACCACTGCATGGCCTCGT
GCTCTGGGGTCGTGTTGTAGATGATCCAGTCATAGCAGGGGCGCTGGGCGTGGT
GCTGGATGATGTCCTTGAGGAGGAGACTGATGGCCACGGGGAGCCCCTTGGTGT
AGGTGTTGGCAAAGCGGTTGAGCTGGGAGGGATGCATGCGGGGGGAGATGATG
TGCAGTTTGGCCTGGATCTTGAGGTTGCGATGTTGCCGCCCAGATCCCGCCTGG
GGTTCATGTTGTGCAGGACCACCAGGACGGTGTAGCCCGTGCACTTGGGGAACT
TATCATGCAACTTGGAAGGGAATGCGTGGAAGAATTTGGAGACGCCCTTGTGCC
CGCCCAGGTTTTCCATGCACTCATCCATGATGATGGCAATGGGCCCGTGGGCTGC
GGCTTTGGCAAAGACGTTTCTGGGGTCAGATACATCATAATTATGCTCCTGGGTG
AGATCATCATAAGACATTTTAATGAATTTGGGCGGAGGGTGCCAGATTGGGGG
ACGATGGTTCCCTCGGGCCCCGGGCAAAGTTCCCCTCACAGATCTGCATCTCCC
AGGCTTTCATCTCGAGGGGGGGATCATGTCCACCTGCGGGGCGATGAAAAAAA
CGGTTTCCGGGGCGGGGTGATGAGCTGCGAGGAGAGCAGGTTTCTCAACAGCT
GGGACTTGCCGCACCCGGTCGGGCCGTAGATGACCCCGATGACGGGTTGCAGGT
GGTAGTTCAAGGACATGCAGCTGCCGTCGTCCCGAGGAGGGGGCCACCTCGT
TGAGCATGTCTCTGACTTGGAGGTTTTCCCGGACGAGCTCGCCGAGAAGGCGGT
CCCCGCCCAGCGAGAGGAGCTCTTGCAGGGAAGCAAAGTTTTTCAGGGGCTTGA
GTCCGTCGGCCATGGGCATCTTGGCGAGGGTCTGCGAGAGGAGTTCGAGACGGT
CCCAGAGCTCGGTGACGTGCTCTACGGCATCTCGATCCAGCAGACTTCCTCGTTT
CGGGGGTTGGGACGACTGCGACTGTAGGGCACGAGACGATGGGCGTCCAGCGC
GGCCAGCGTCATGTCCTTCCAGGGTCTCAGGGTCCGCGTGAGTGGGTCTCCGTC
ACGGTGAAGGGGTGGGCCCCGGGCTGGGCGCTTGCAAGGGTGCGCTTGAGACTC
ATCCTGCTGGTGCTGAAACGGGCACGGTCTTCGCCCTGCGCGTCGGCGAGATAG
CAGTTGACCATGAGCTCGTAGTTGAGGGCCTCGGCGGCTGGCCCCTTGGCCGCAG
AGCTTGCCCTTGGAAGAGCGCCCACAGGCGGGACAGAGGAGGGATTGCAGGGC
GTAGAGCTTGGGCGCGAGAAAGACCGACTCGGGGGCGAAGGCGTCCGCTCCGC
AGTGGGCGCAGACGGTCTCGCACTCAACTAGCCAGGTGAGCTCGGGCTGCTCGG
GGTCAAAAACCAGTTTTCCACCGTTCTTTTTGATGCGCTTCTTACCTCGCGTCTCC
ATGAGTCTGTGTCCGCGCTCGGTGACAAACAGGCTGTCGGTGTCCCCGTAGACG

TABLE 7-continued

Nucleic Acid Sequences of Vectors

SEQ ID NO Sequence

GACTTGATGGGCCTGTCCTGCAGGGGCGTCCCGCGGTCCTCCTCGTAGAGAAAC
TCGGACCACTCTGAGACAAAGGCGCGCGTCCACGCCAAGACAAAGGAGGCCAC
GTGCGAGGGGTAGCGGTCGTTGTCCACCAGGGGGTCCACCTTTTCCACCGTGTGC
AGACACATGTCCCCCTCCTCCGCATCCAAGAAGGTGATTGGCTTGTAGGTGTAG
GCCACGTGACCGGGGTCCCCGACGGGGGGGTATAAAAGGGGGCGGGTCTGTG
CTCGTCCTCACTCTCTTCCGCGTCGCTGTCCACGAGCGCCAGCTGTTGGGGTAGG
TATTCCCTCTCGAGAGCGGGCATGACCTCGGCACTCAGGTTGTCAGTTTCTAGAA
ATGAGGAGGATTTGATGTTGGCTTGCCCTGCCGCGATGCTTTTTAGGAGACTTTC
ATCCATCTGGTCAGAAAAGACAATTTTTTTATTGTCAAGCTTGGTGGCGAATGAG
CCATAGAGGGCGTTGGAGAGAAGCTTGGCGATGGATCTCATGGTCTGATTTTTGT
CACGGTCGGCGCGCTCCTTGGCCGCGATGTTGAGCTGGACATACTCGCGCGCGA
CGCACTTCCATTCGGGGAAGACGGTGGTGCGCTCGTCGGGCACGATCCTGACGC
GCCAGCCGCGGTTATGCAGGGTGACCAGGTCCACGCTGGTGGCCACCTCGCCGC
GCAGTGGCTCGTTGGTCCAGCAGAGTCTGCCGCCCTTGCGCGAGCAGAACGGGG
GCAGCACATCAAGCAGATGCTCGTCAGGGGGGTCCGCATCGATGGTGAAGATGC
CCGGACAGAGTTCCTTGTCAAAATAATCAATTTTTGAGGATGCATCATCCAAGGC
CATCTGCCACTCGCGGGCGGCCAGCGCTCGCTCGTAGGGGTTGAGGGGCGGACC
CCAGGGCATGGGATGCGTGAGGGCGGAGGCGTACATGCCGCAGATGTCATAGA
CATAGATGGGCTCCGAGAGGATGCCGATGTAGGTGGGATAACAGCGCCCCCGC
GGATGCTGGCGCGCACGTAGTCATACAACTCGTGCGAGGGGGCCAAGAATGCGG
GGCCGAGATTGGTGCGCTGGGGCTGCTCGGCGCGGAAGACGATCTGGCGAAAG
ATGGCGTGCGAGTTGGAGGAGATGGTGGGCCGTTGGAAGATGTTAAAGTGGGCG
TGAGGCAGGCGGACCGAGTCGCGGATGAAGTGCGCGTAGGAGTCTTGCAGCTTG
GCGACGAGCTCGGCGGTGACGAGGACGTCCATGGCGCAGTAGTCCAGCGTTTCG
CGGATGATGTCATAACCCGCCTCTCCTTTCTTCTCCCACAGCTCGCGGTTGAGGG
CGTACTCCTCGTCATCCTTCCAGTACTCCCGGAGCGGGAATCCTCGATCGTCCGC
ACGGTAAGAGCCCAGCATGTAGAAATGGTTCACGGCCTTGTAGGGACAGCAGCC
CTTCTCCACGGGGAGGGCGTAAGCTTGTGCGGCCTTGCGGAGCGAGGTGTGCGT
CAGGGCGAAGGTATCCCTGACCATGACTTTCAAGAACTGGTACTTGAAGTCCGA
GTCGTCGCAGCCGCCGTGCTCCCAGAGCTCGAAATCGGTGCGCTTCTTCGAGAG
GGGGTTAGGTAGAGCGAAAGTGACGTCATTGAAGAGAATCTTGCCCGCTCGCGG
CATGAAATTGCGGGTGATGCGGAAAGGACCCGGGACGGAGGCTCGGTTGTTGAT
GACCTGGGCGGCGAGGACGATCTCGTCGAAGCCGTTGATGTTGTGCCCGACGAT
GTAGAGTTCCATGAATCGCGGGCGGCCTTTGATGTGCGGCAGCTTTTTGAGCTCC
TCGTAGGTGAGGTCCTCGGGGCATTGCAGGCCGTGCTGCTCGAGCGCCCACTCCT
GGAGATGTGGGTTGGCTTGCATGAAGGAAGCCCAGAGCTCGCGGGCCATGAGG
GTCTGGAGCTCGTCGCGAAAGAGGCGGAACTGCTGGCCCACGGCCATCTTTTCT
GGGGTGACGCAGTAGAAGGTGAGGGGGTCCCGCTCCCAGCGATCCCAGCGTAA
GCGCACGGCGAGATCGCGAGCGAGGGCGACCAGCTCGGGGTCTCCCGAGAATTT
CATGACCAGCATGAAGGGGACGAGCTGCTTGCCGAAGGACCCCATCCAGGTGTA
GGTTTCTACATCGTAGGTGACAAAGAGCCGCTCCGTGCGAGGATGAGAGCCGAT
TGGGAAGAACTGGATTTCCTGCCACCAGTTGGACGAGTGGCTGTTGATGTGATG
AAAGTAGAAATCTCGCCGGCGAACCGAGCACTCGTGCTGATGCTTGTAAAAGCG
TCCGCAGTACTCGCAGCGCTGCACGGGCTGTACCTCATCCACGAGATACACAGC
GCGTCCCTTGAGGAGGAACTTCAGGAGTGGCGGCCCTGGCTGGTGGTTTTCATGT
TCGCCTGCGTGGGACTCACCCTGGGGCTCCTCGAGGACGGAGAGGCTGACGAGC
CCGCGCGGGAGCCAGGTCCAGATCTCGGCGCGGCGGGGGCGGAGAGCGAAGAC
GAGGGCGCGCAGTTGGGAGCTGTCCATGGTGTCGCGGAGATCCAGGTCCGGGGG
CAGGGTTCTGAGGTTGACCTCGTAGAGGCGGGTGAGGGCGTGCTTGAGATGCAG
ATGGTACTTGATCTCCACGGGTGAGTTGGTGGCCGTGTCCACGCATTGCATGAGC
CCGTAGCTGCGCGGGGCCACGACCGTGCCGCGGTGCGCTTTTAGAAGCGGTGTC
GCGGACGCGCTCCCGGCGGCAGCGGCGGTTCCGGCCCCGCGGGCAGGGGCGGC
AGAGGCACGTCGGCGTGGCGCTCGGGCAGGTCCGGTGCTGCGCCCTGAGAGCG
CTGGCGTGCGCGACGACGCGGCGGTTGACATCCTGGATCTGCCGCCTCTGCGTG
AAGACCACCGGCCCCGTGACTTTGAACCTGAAAGACAGTTCAACAGAATCAATC
TCGGCGTCATTGACGGCGGCCTGACGCAGGATCTCTTGCACGTCGCCCGAGTTGT
CCTGGTAGGCGATCTCGGACATGAACTGCTCGATCTCCTCCTCCTGGAGATCGCC
GCGGCCCGCGCGCTCCACGGTGGCGGCGAGGTCATTCGAGATGCGGCCCATGAG
CTGCGAGAAGGCGCCCAGGCCGCTCTCGTTCAGACGCGGCTGTAGACCACGTC
CCCGTCGGCGTCGCGCGCGCGCATGACCACCTGCGCGAGGTTGAGCTCCACGTG
CCGCGCGAAGACGGCGTAGTTGCGCAGGCGCTGGAAGAGGTAGTTGAGGGTGG
TGGCGATGTGCTCGGTGACGAAGAAGTACATGATCCAGCGGCGCAGGGGCATCT
CGCTGATGTCGCCGATGGCCTCCAGCCTTTCCATGGCCTCGTAGAAATCCACGGC
GAAGTTGAAAAACTGGGCGTTGCGGGCCGAGACCGTGAGCTCGTCTTCCAGGAG
CCGAATGAGCTCGGCGATGGTGGCGCGCACCTCGCGCTCGAAATCCCCGGGGGC
CTCCTCCTCTTCCTCTTCTTCTTCCATGACGACCTCTTCTTCTATTTCTTCCTCTGG
GGGCGGTGGTGGTGGCGGGGCCCGACGACGACGGCGACGCACCGGGAGACGGT
CGACGAAGCGCTCGATCATCTCCCCGCGGCGGCGACGCATGGTTTCGGTGACGG
CGCGACCCCGTTCGCGAGGACGCAGCGTGAAGACGCCGCCGGTCATCTCCCGGT
AATGGGCGGGTCCCCGTTGGGCAGCGATAGGGCGCTGACGATGCATCTTATCA
ATTGCGGTGTAGGGGACGTGAGCGCGTCGAGATCGACCGGATCGGAGAATCTTT
CGAGGAAAGCGTCTAGCCAATCGCAGTCGCAAGGTAAGCTCAAACACGTAGCA
GCCCTGTGGACGCTGTTAGAATTGCGGTTGCTGATGATGTAATTGAAGTAGGCGT
TTTTGAGGCGGCGGATGGTGGCGAGGAGGACCAGGTCCTTGGGTCCCGCTTGCT
GGATGCGGAGCCGCTCGGCCATGCCCCAGGCCTGGCCCTGACACCGGCTCAGGT
TCTTGTAGTAGTCATGCATGAGCCTCTCGATGTCATCACTGGCGGAGGCGGAGTC

TABLE 7-continued

Nucleic Acid Sequences of Vectors

SEQ ID NO Sequence

TTCCATGCGGGTGACCCCGACGCCCCTGAGCGGCTGCACGAGCGCCAGGTCGGC
GACGACGCGCTCGGCGAGGATGGCCTGTTGCACGCTGGTGAGGGTGTCCTGGAA
GTCGTCCATGTCGACGAAGCGGTGGTAGGCCCCGGTGTTGATGGTGTAGGTGCA
GTTGGCCATGAGCGACCAGTTGACGGTCTGCAGGCCGGGTTGCACGACCTCGGA
GTACCTGAGCCGCGAGAACGCGCGCGAGTCGAAGACGTAGTCGTTGCAGGTGCG
CACGAGGTACTGGTAGCCAACTAGGAAGTGCGGCGGCGGCTGGCGGTAGAGCG
GCCAGCGCTGGGTGGCCGGCGCGCCCGGGGCCAGGTCCTCGAGCATGAGGCGGT
GGTAGCCGTAGAGGTAGCGGGACATCCAGGTGATGCCGGCGGCGGTGGTGGAG
GCGCGCGGGAACTCGCGGACGCGGTTCCAGATGTTGCGCAGCGGCAGGAAATA
GTCCATGGTCGGCACGGTCTGGCCGGTGAGACGCGCGCAGTCATTGACGCTCTA
GAGGCAAAAACGAAAGCGGATGAGCGGGCTCTTCCTCCGTAGCCTGGCGGAAC
GCAAACGGGTTAGGCCGCGTGTGTACCCCGGTTCGAGTCCCCTCGAATCAGGCT
GGAGCCGCGACTAACGTGGTATTGGCACTCCCGTCTCTGACCCGAGCCCGATAGC
CGCCAGGATACGGCGGAGAGCCCTTTTTGCCGGCCGAGTGGGGTCGCTAGACTT
GAAAGCGGCCGAAAACCCTGCCGGGTAGTGGCTCGCGCCCGTAGTCTGGAGAAG
CATCGCCAGGGTTGAGTCGCGGCAGAACCCGGTTCGCGGACGGCCGCGGCGAGC
GGGACTTGGTCACCCCGCCGATTTAAAGACCCACAGCCAGCCGACTTCTCCAGTT
ACGGGAGCGAGCCCCCTTTTTTCTTTTTGCCAGATGCATCCCGTCCTGCGCCAAA
TGCGTCCCACCCCCCGGCGACCACCGCGACCGCGGCCGTAGCAGGCGCCGGCG
CTAGCCAGCCACCGCAGACAGAGATGGACTTGGAAGAGGGCGAAGGGCTGGCG
AGACTGGGGGCGCCGTCCCCGGAGCGACACCCCCGCGTGCAGCTGCAGAAGGA
CGTGCGCCCGGCGTACGTGCCTGCGCAGAACCTGTTCAGGGACCGCAGCGGGGA
GGAGCCCGAGGAGATGCGCGACTGCCGGTTTCGGGCGGGCAGGGAGCTGCGCG
AGGGCCTGGACCGCCAGCGCGTGCTGCGCGACGAGGATTTCGAGCCGAACGAGC
AGACGGGGATCAGCCCCGCGCGCGCACGTGGCGGCGGCCAACCTGGTGACG
GCCTACGAGCAGACAGGTGAAGCAGGAGCGCAACTTCCAAAAGAGTTTCAACAA
CCACGTGCGCACGCTGATCGCGCGCGAGGAGGTGGCCCTGGGCCTGATGCACCT
GTGGGACCTGGCGGAGGCCATCGTGCAGAACCCGGACAGCAAGCCTCTGACGGC
GCAGCTGTTCCTGGTGGTGCAGCACAGCAGGGACAACGAGGCGTTCAGGGAGGC
GCTGCTGAACATCGCCGAGCCCGAGGGTCGCTGGCTGCTGGAGCTGATCAACAT
CTTGCAGAGCATCGTAGTGCAGGAGCGCAGCCTGAGCCTGGCCGAGAAGGTGGC
GGCGATCAACTACTCGGTGTTGAGCCTGGGCAAGTTTTACGCGCGCAAGATTTA
CAAGACGCCGTACGTGCCCATAGACAAGGAGGTGAAGATAGACAGCTTTTACAT
GCGCATGGCGCTCAAGGTGCTGACGCTGAGCGACGACCTGGGCGTGTACCGCAA
CGACCGCATCCACAAGGCCGTGAGCACGAGCCGGCGGCGCGAGCTGAGCGACC
GCGAGCTGATGCTTAGCCTGCGCCGGGCGCTGGTAGGGGCGCCGCCGGCGGCG
AGGAGTCCTACTTCGACATGGGGGCGGACCTGCATTGGCAGCCGAGCCGGCGCG
CCTTGGAGGCCGCCTACGGTCCAGAGGACTTGGATGAGGATGAGGAAGAGGAG
GAGGATGCACCCGCTGCGGGGTACTGACGCCTCCGTGATGTGTTTTAGATGTCC
CAGCAAGCCCCGGACCCCGCCATAAGGGCGGCGCTGCAAAGCCAGCCGTCCGGT
CTAGCATCGGACGACTGGGAGGCCGCGATGCAACGCATCATGGCCCTGACGACC
CGCAACCCCGAGTCCTTTAGACAACAGCCGCAGGCCAACAGATCTCGGCCATT
CTGGAGGCGGTGGTCCCCTCTCGGACCAACCCCACGCACGAGAAGGTGCTGGCG
ATCGTGAACGCGCTGGCGGAGAACAAGGCCATCCGTCCCGACGAGGCCGGGCTG
GTGTACAACGCCCTGCTGGAGCGCGTGGGCCGCTACAACAGCACGAACGTGCAG
TCCAACCTGGACCGGCTGGTGACGGACGTGCGCGAGGCCGTGGCGCAGCGCGAG
CGGTTCAAGAACGAGGGCCTGGGCTCGCTGGTGGCGCTGAACGCCTTCCTGGCG
ACGCAGCCGGCGAACGTGCCGCGCGGGCAGGACGATTACACCAACTTTATCAGC
GCGCTGCGGCTGATGGTGACCGAGGTGCCCCAGAGCGAGGTGTACCAGTCGGGC
CCGGACTACTTTTTCCAGACTAGCAGACAGGGCTTGCAGACGGTGAACCTGGAC
CAGGCTTTCAAGAACCTGCGCGGACTGTGGGGCGTGCAGGCGCCCGTGGGCGAC
CGGTCGACGGTGAGCAGCTTGCTGACGCCCAACTCGCGGCTGCTGCTGCTGCTG
ATCGCGCCCTTCACCGACAGCGGCAGCGTGAACCGCAACTCGTACCTGGGCCAC
CTGCTGACGCTGTACCGCGAGGCCATAGGCCAGGCGCAGGTGGACGAGCAGACC
TTCCAGGAGATCACGAGCGTGAGCCGCGCGCTGGGGCAGAACGACACCGACAG
TCTGAGGGCCACCCTGAACTTCTTGCTGACCAATAGACAGCAGAAGATTCCGGC
GCAATACGCGCTGTCGGCCGAGGAGGAGCGCATCCTGAGATATGTGCAGCAGAG
TGTAGGGCTTTTCCTGATGCAGGAGGGCGCCACCCCCAGCGCCGCGCTGGACAT
GACCGCGCGCAACATGGAACCTAGCATGTACGCCGCCAACCGGCCGTTCATCAA
TAAGCTGATGGACTACCTGCACCGCGCGGCGGCCATGAACACGGACTATTTCAC
CAACGCCATCCTGAACCCGCACTGCTCCCGCCGCGGGGTTCTACACGGGCGA
GTACGACATGCCCGACCCCAACGACGGGTTCCTGTGGGACGACGTGGACAGCGC
GGTGTTCTCCCCGACCTTGCAAAAGCGCCAGGAGGCGGTGCGCACGCCCGTGAG
CGAGGGCGCGGTGGGTCGGAGCCCCTTTCCTAGCTTAGGGAGTTTGCATAGCTT
GCCGGGCTCGGTGAACAGCGGCAGGGTGAGCGCCCGCGCTTGCTGGGCGAGG
ACGAGTACCTGAACGACTCGCTGCTGCAACCGCCACGGGTCAAGAACGCCATGG
CCAATAACGGGATAGAGTCTGGTGGACAAATTGAACCGCTGGAAGACCTACG
CTCAGGACCATAGGGACGCGCCCGCGCCGCGGCGACAGCGCCACGACCGGCAG
CGGGGCCTGGTGTGGGACGACGAGGACTCGGCCGACGATAGCAGCGTGTTGGAC
TTGGGGGGAGCGGTGGGGCCAACCCGTTCGCGCATCTGCAGCCCAGACTGGGG
CGACGGATGTTTTGAATGCAAAATAAAACTCACCAAGGCCATAGCGTGCGTTCT
CTTCCTTGTTAGAGATGAGGCGCGCGGTGGTGTCTCCTCCTCCCTCGTACGAGAG
CGTGATGGCGCAGGCGACCCTGGAGGTTCCGTTTGTGCCTCCGCGGTATATGGCT
CCTACGAGGGCAGAAACAGCATTCGTTACTCGGAGCTGGCTCCGCAGTACGAC
ACCACTCGCGTGTACTTGGTGGACAACAAGTCGGCGGACATCGCTTCCCTGAAC
TACCAAAAACGACCACAGCAACTTCCTGACCACGGTGGTGCAGAACAACGATTTC

TABLE 7-continued

Nucleic Acid Sequences of Vectors

SEQ ID NO Sequence

ACCCCCGCCGAGGCCAGCACGCAGACGATAAATTTTGACGAGCGGTCGCGGTGG
GGCGGTGATCTGAAGACCATTCTGCACACCAACATGCCCAATGTGAACGAGTAC
ATGTTCACCAGCAAGTTTAAGGCGCGGGTGATGGTGGCTAGGAAGCATCCAGAG
GGGGTAGTTGAAACAGATTTGAGTCAGGATAAGCTTGAGTATCAGTGGTTTGAG
TTTACCCTGCCCGAGGGCAACTTTTCCGAGACCATGACCATAGACCTTGATGAAC
AACGCCATCTTGGAAAACTACTTGCAAGTGGGGCGACAAAATGGCGTGCTGGAG
AGCGATATAGGAGTCAAGTTTGACAGCAGGAATTTCAAGCTGGGCTGGGACCCG
GTGACCAAGCTGGTGATGCCGGGGGTCTACACCTACGAGGCCTTCCACCCGGAC
GTGGTGCTGCTGCGGGCTGCGGGGTGGACTTCACCGAGAGCCGCCTGAGCAAC
CTCCTGGGCATTCGCAAGAAGCAACCTTTCCAAGAGGGCTTCAGAATCATGTAT
GAGGATCTAGAAGGGGGCAACATCCCCGCTCTGCTGGATGTGGAAGCATACCTC
AACAGCAAGAATGATATGGAGGAGGCTACCAAGAATGCAAACAGAGCTGCTGA
CAATGGAGGTGGTGAAACTAGGGGAGATACTTTTCTCACCACCGAACAGCTGAG
AGCCGCTGGCAAGGAGCTTGTTATTAAGCCAATCAAGGAAGATGCTAGCAAGAG
GAGCTACAATGTCATAGATGGCACCCATGACACCCTGTACCGAAGCTGGTACCT
GTCCTATACCTACGGGGACCCCGAGAAGGGGGTGCAGTCGTGGACGCTGCTCAC
CACCCCGGACGTCACCTGCGGCGCGGAGCAAGTCTACTGGTCGCTGCCGGACCT
CATGCAAGACCCCGTCACCTTCCGCTCCACCCAGCAAGTCAGCAACTACCCCGT
GGTCGGCGCCGAGCTCATGCCCTTCCGCGCCAAGAGCTTTTACAACGACCTCGCC
GTCTACTCCCAGCTCATCCGCAGCTACACCTCCTCACCCACGTCTTCAACCGCT
TCCCCGACAACCAGATCCTCTGCCGCCCGCCCGCCGCCCACCATCACCACCGTCAG
TGAAAACGTGCCTGCTCTCACAGATCACGGGACGCTACCGCTGCGCAGCAGTAT
CCGCGGAGTCCAGCGAGTGACCGTCACTGACGCCCGTCGCCGCACCTGTCCCTA
CGTCTACAAGGCCCTGGGCATAGTCGCGCCGCGCGTGCTTTCCAGTCGCACCTTC
TAAAAAATGTCTATTCTCATCTCGCCCAGCAATAACACCGGCTGGGTCTTACTA
GGCCCAGCACCATGTACGGAGGAGCCAAGAAGCGCTCCCAGCAGCACCCCGTCC
GCGTCCGCGGTCACTTCCGCGCTCCCTGGGGCGCTTACAAGCGCGGGCGGACTT
CTACCGCCGCCGCCGTGCGCACCACCGTCGACGACGTCATCGACTCGGTGGTCG
CCGACGCGCGCAACTACACCCCCGCCCCCTCCACCGTGGACGCGGTCATCGACA
GCGTGGTGGCCGACGCGCGCGACTATGCCAGACGCAAGAGCCGGCGGCGACGG
ATCGCCAGGCGCCACCGGAGTACGCCCGCCATGCGCGCCGCCCGGGCTCTGCTG
CGCCGCGCCAGACGCACGGGCCGCCGGGCCATGATGCGAGCCGCGCGCCGCGCT
GCCACTGCACCCACCCCCGCAGGCAGGACTCGCAGACGAGCGGCCGCCGCCGCC
GCCGCGGCCATCTCTAGCATGACCAGACCCAGGCGCGGAAACGTGTACTGGGTG
CGCGACTCCGTCACGGGCGTGCGCGTGCCCGTGCGCACCCGTCCTCCTCGTCCCT
GATCTAATGCTTGTGTCCTCCCCCGCAAGCGACGATGTCAAAGCGCAAAATCAA
GGAGGAGATGCTCCAGGTCGTCGCCCCGGAGATTTACGGACCACCCCAGGCGGA
CCAGAAACCCCGCAAAATCAAGCGGGTTAAAAAAAAGGATGAGGTGGACGAGG
GGGCAGTAGAGTTTGTGCGCGAGTTCGCTCCGCGGCGGCGCGTAAATTGGAAGG
GGCGCAGGGTGCAGCGCGTGTTGCGGCCCGGCACGGCGGTGGTGTTCACGCCCG
GCGAGCGGTCCTCGGTCAGGAGCAAGCGTAGCTATGACGAGGTGTACGGCGACG
ACGACATCCTGGACCAGGCGGCGGAGCGGGCGGGCGAGTTCGACTACGGGAAG
CGGTCGCGCGAAGAGGAGCTGATCTCGCTGCCGCTGGACGAAAGCAACCCCACG
CCGAGCCTGAAGCCCGTGACCCTGCAGCAGGTGCTGCCCCAGGCGGTGCTGCTG
CCGAGCCGCGGGGTCAAGCGCGAGGGCGAGAGCATGTACCCGACCATGCAGAT
CATGGTGCCCAAGCGCCGGCGCGTGGAGGACGTGCTGGACACCGTGAAAATGG
ATGTGGAGCCCGAGGTCAAGGTGCGCCCCATCAAGCAGGTGGCGCCGGGCCTGG
GCGTGCAGACCGTGGACATTCAGATCCCCACCGACATGGATGTCGACAAAAAAC
CCTCGACCAGCATCGAGGTGCAGACCGACCCCTGGCTCCCAGCCTCCACCGCTA
CCGTCTCCACTTCTACCGCCGCCACGGCTACCGAGCCTCCCAGGAGGCGAAGAT
GGGGCGCCGCCAGCCGGCTGATGCCCAACTACGTGTTGCATCCTTCCATCATCCC
GACGCCGGGCTACCGCGGCACCCGGTACTACGCCAGCCGCAGGCGCCCAGCCAG
CAAACGCCGCCGCCGCACCGCCACCCGCCGCCGTCTGGCCCCCGCCCGCGTGCG
CCGCGTGACCACGCGCCGGGGCCGCTCGCTCGTTCTGCCCACCGTGCGCTACCAC
CCCAGCATCCTTTAATCCGTGTGCTGTGATACTGTTGCAGAGAGATGGCTCTCAC
TTGCCGCCTGCGCATCCCCGTCCCGAATTACCGAGGAAGATCCCGCCGCAGGAG
AGGCATGGCAGGCAGCGGCCTGAACCGCCGCCGGCGGCGGGCCATGCGCAGGC
GCCTGAGTGGCGGCTTTCTACCCGCGCTCATCCCCATAATCGCCGCGGCCATCGG
CACGATCCCGGCATACTTCCGTTGCGCTGCAGGCGTCGCAGCGCCGTTGATGT
GCGAATAAAGCCTCTTTAGACTCTGACACACCTGGTCCTGTATATTTTTAGAATG
GAAGACATCAATTTTGCGTCCCTGGCTCCGCGGCACGGCACGCGGCCGTTCATG
GGCACCTGGAACGAGATCGGCACCAGCCAGCTGAACGGGGGCGCCTTCAATTGG
AGCAGTGTCTGGAGCGGGCTTAAAAATTTCGGCTCGACGCTCCGGACCTATGGG
AACAAGGCCTGGAATAGTAGCACTGGGCAGTTGTTAAGGGAAAAGCTCAAAGA
CCAGAACTTCCAGCAGAAGGTGGTGGACGGGCTGGCCTCGGGCATTAACGGGGT
GGTGGACATCGCGAACCAGGCCGTGCAGCGCGAGATAAACAGCCGCCTGGACC
CGCGGCCACCCACGGTGGTGGAGATGGAAGATGCAACTCCTCCGCCGCCTAAGG
GCGAGAAGCGGCCGCGCCCGACGCGGAGGAGACGATCCTGCAGGTGGACGAG
CCGCCCCTCGTACGAGGAGGCCGTGAAGGCCGGCATGCCCACCACGCGCATCATC
GCGCCACTGGCCACGGGTGTAATGAAACCCGCCACCCTTGACCTGCCTCCACCA
CCCACGCCCGCTCCACCGAAGGCAGCTCCGGTCGTGCAGGCCCCCGGTGGCG
ACCGCCGTGCGCCGCGTCCCCGCCCGCCGCCAGGCCCAGAACTGGCAGAGCACG
CTGCACAGTATCGTGGGCCTGGGAGTGAAAAGTCTGAAGCGCCGCCGATGCTAT
TGAGAGATAGGAAAGAGGACACTAAAGGGAGAGCTTAACTTGTATGTGCCTTAC
CGCCAGAGAACGCGCGAAGATGGCCACCCCCTCGATGATGCCGCAGTGGGCGTA
CATGCACATCGCCGGGCAGGACGCCTCGGAGTACCTGAGTCCGGGTCTGGTGCA

TABLE 7-continued

Nucleic Acid Sequences of Vectors

SEQ ID NO Sequence

```
GTTTGCCCGCGCCACCGACACGTACTTCAGCCTGGGCAACAAGTTTAGGAACCC
CACGGTGGCTCCCACCCACGATGTGACCACGGACCGGTCCCAGCGTCTGACGCT
GCGCTTCGTGCCCGTGGATCGCGAGGACACCACGTACTCATACAAGGCGCGCTT
CACTCTGGCCGTGGGCGACAACCGGGTGCTAGACATGGCCAGCACTTACTTTGA
CATCCGCGGCGTCCTGGACCGCGGCCCCAGCTTCAAACCCTACTCGGGCACGGC
TTACAACAGTCTGGCTCCCAAGGGCGCCCCCAACTCCAGTCAGTGGGAACAGAA
AAAGGCCAATGGGGGAGCTGATGAAATGGAAACACACACCTTTGGCGTGGCTGC
TATGGGAGGAAAAAATATTACAGACAAGGGTTTGCAAATTGGAACAGATGAAA
CCAAAGAGGATGATGAAGATGAGATATATGCTGACAAAACTTTTCAACCAGAAC
CTCAAGTTGGAGAAGAAAACTGGAAAGAAACATTTGTTTATTATGGAGGAAGAG
CCATTAAGAAAGACACAAAAATGAAGCCTTGTTATGGTTCCTATGCCAGACCTA
CTAATGAAAAGGGCGGACAGGCTAAATTTTTAAATGGAGAAAATGGTCAACCAT
CTAAAGAACAAGACATAACAATGGCTTTCTTTGATCTAAGGCAAGCTGATGCAG
GAGGTAATAAAAATCAAGCAGACGTGGTTATGTATGCCGAAAATATTAATCTTG
AAACTCCAGACACTCATGTGGTGTATAAGCCAGGCAAGGAAGATGCAAGCTCTG
AAATTAATTTAACTCAGCAGTCCATGGCCAACAGACCCAACTACATCGGCTTCA
GGGACAACTTTGTGGGGCTGATGTACTACAACAGCACTGGTAACATGGGTGTGC
TGGCTGGTCAAGCATCTCAGTTGAACGCTGTGGTCGACTTGCAAGACAGAAACA
CAGAGCTGTCTTACCAGCTCTTGCTAGATTCTCTGGGTGACAGAACCAGATACTT
TAGCATGTGGAACTCTGCAGTGGACAGCTATGATCCCGATGTCAGGATCATTGA
GAATCACGGTGTGGAAGATGAACTTCCAAACTATTGTTTTCCATTGGACGGATGT
GGCAGCAGTACTGCTTTTCAGGGAGTTAAAGTAACGAATCCGGCTACCAGTACG
AATAATAACACACAATGGGGTGTTAACGATGAAGTTGCAACACATAACCAAATT
GCCAGAGGCAACCTGTACGCCATGGAGATCAACCTCCAGGCCAACCTGTGGAAG
AGTTTTCTGTACTCGAATGTGGCCCTGTACCTGCCCGACTCCTACAAGTACACGC
CGGCCAACATCACGCTGCCCACCAACACCAACACCTACGAGTACATGAACGGCC
GCGTGGTAGCCCCTCGCTGGTGGACGCCTACATCAACATCGGCGCGCGCTGGT
CGCTGGACCCCATGGACAATGTCAACCCCTTCAACCACCACCGCAACGCGGGCC
TGCGCTACCGCTCCATGCTGCTGGGCAACGGCCGCTACGTGCCCTTCCACATCCA
AGTGCCCCAAAAGTTCTTTGCCATCAAGAACCTGCTACTGCTCCCGGGCTCCTAC
ACCTACGAATGGAACTTCCGCAAGGATGTCAACATGATCCTGCAGAGTTCCCTC
GGCAACGACCTGCGCGTCGACGGCGCCTCCGTGCGCTTCGACAGCGTCAACCTC
TACGCCACCTTCTTCCCAATGCGCCACAACACCGCCTCCACCCTGGAAGCCATGC
TGCGCAATGACACCAACGACCAGTCCTTCAACGACTACCTCTCGGCCGCCAACA
TGCTCTATCCCATCCCGGCCAAGGCCACCAACGTGCCCATCTCCATCCCCTCGCG
CAACTGGGCCGCCTTTCGCGGCTGGAGTTTCACACGGCTCAAGACCAAGGAAAC
TCCCTCCCTCGGCTCGGGTTTCGACCCCTACTTTGTCTACTCGGGCTCCATCCCCT
ACCTCGACGGAACCTTCTACCTCAACCACACCTTCAAGAAGGTCTCCATCATGTT
CGACTCCTCGGTCAGCTGGCCCGGCAACGACCGGCTGCTCACGCCGAACGAGTT
CGAGATCAAGCGCAGCGTCGACGGGGAGGGCTACAACGTGGCCAATGCAACA
TGACCAAGGACTGGTTCCTCGTCCAGATGCTCTCCCACTACAACATCGGCTACCA
GGGCTTCCACGTGCCCGAGGGCTACAAGGACCGCATGTACTCCTTCTTCCGCAAC
TTCCAGCCCATGAGCAGGCAGGTGGTCGATGAGATCAACTACAAGGACTACAAG
GCCGTCACCCTGCCCTTCCAGCACAACAACTCGGGCTTCACCGGCTACCTCGCAC
CCACCATGCGCCAGGGGCAGCCCTACCCCGCCAACTTCCCCTACCCGCTCATCGG
CTCCACCGCAGTGCCCTCCGTCACCCAGAAAAAGTTCCTCTGCGACAGGGTCAT
GTGGCGCATCCCCTTCTCCAGCAACTTCATGTCCATGGGCGCCCTTACCGACCTG
GGTCAGAACATGCTCTATGCCAACTCGGCCCACGCGCTCGACATGACCTTCGAG
GTGGACCCCATGGATGAGCCCACCCTCCTCTATCTTCTCTTCGAAGTTTTCGACG
TGGTCAGAGTGCACCAGCCGCACCGCGGCGTCATCGAGGCCGTCTACCTGCGCA
CGCCCTTCTCCGCCGGCAACGCCACCACCTAAGCATGAGCGGCTCCAGCGAACG
AGAGCTCGCGGCCATCGTGCGCGACCTGGGCTGCGGGCCCTACTTTTTGGGCAC
CCACGACAAGCGCTTCCCGGGTTTCCTCGCCGGCGACAAGCTGGCCTGCGCCAT
CGTCAACACGGCCGGCCGCGAGACCGGAGGCGTGCACTGGCTCGCCTTCGGCTG
GAACCCGCGCTCGCGCACCTGCTACATGTTCGACCCCTTTGGGTTCTCGGACCGC
CGGCTCAAGCAGATTTACAGCTTCGAGTACGAGGCCATGCTGCGCCGCAGCGCC
CTGGCCTCCTCGCCCGACCGCTGTCTCAGCCTCGAGCAGTCCACCCAGACCGTGC
AGGGGCCCGACTCCGCCGCCTGCGGACTTTTCTGTTGCATGTTCTTGCATGCTTT
CGTGCACTGGCCCGACCGACCCATGGACGGAAACCCCACCATGAACTTGCTGAC
GGGGGTGCCCAACGGCATGCTACAATCGCCACAGGTGCTGCCCACCCTCAGGCG
AAACCAGGAGGAGCTCTACCGCTTCCTCGCGCGCCACTCCCCTTACTTTCGCTCC
CACCGCGCCGCCATCGAACACGCCACCGCTTTTGACAAAATGAAACAACTGCGT
GTATCTCAATAAACAGCACTTTTATTTTACATGCACTGGAGTATATGCAAGTTAT
TTAAAAGTCGAAGGGGTTCTCGCGCTCGTCGTTGTGCGCTGCGCTGGGGAGGGC
CACGTTGCGGAACTGGTACTTGGGATACCACTTGAACTCGGGGATCACCAGTTT
GGGCACTGGGGTCTCGGGGAAGGTTTCGCTCCACATGCGCCGGCTCATCTGCAG
GGCGCCCAGCATGTCAGGCGCGGAAATCTTGAAATCGCAGTTGGGACCGGTGCT
CTGCGCGCGCGAGTTGCGGTACACTGGGTTGCAGCACTGGAACACCATCAGACT
GGGGTACTTCACACTGGCCAGCACGCTCTTGTCGCTGATCTGATCCTTGTCCAGG
TCCTCGGCGTTGCTCAGGCCGAACGGGGTCATCTTGCACAGCTGGCGGCCCAGG
AAGGGCACGCTCTGAGGCTTGTGGTTACACTCGCAGTGAACGGGCATCAGCATC
ATCCCCGCGCCGCGCTGCATATTCGGGTAGAGGGCCTTGACAAAGGCCGTGATC
TGCTTGAAAGCTTGCTGGGCTTTGGCCCCCTCGCTGAAAAACAGGCCGCAGCTCT
TCCCGCTGAACTGGTTATTCCCGCACCCGGCATCATGCACGCAGCAGCGCGCGTC
ATGGCTGGTCAGTTGCACCACGCTCCGTCCCCAGCGGTTCTGGGTCACCTTGGCC
TTGCTGGGTTGCTCCTTCAGCGCACGCTGCCCGTTCTCACTGGTCACATCCATCTC
```

TABLE 7-continued

Nucleic Acid Sequences of Vectors

SEQ ID NO Sequence

```
CACCACGTGGTCCTTGTGGATCATCACCGTCCCATGCAGACACTTGAGCTGACCT
TCCACCTCGGTGCAGCCGTGGTCCCACAGGGCACTGCCGGTACACTCCCAATTCT
TGTGCGCGATCCCGCTGTGGCTGAAGATGTAACCTTGCAACAGGCGACCCATCA
CGGTGCTAAATGTTTTCTGGGTGGTGAAGGTCAGTTGCAGGGCGCGGGCCTCCTC
GTTCATCCAGGTCTGGCACATCTTCTGGAAGATCTCGGTCTGCTCGGGCATGAGC
TTGTAAGCATCGCGCAGGCCGCTGTCGACGCGGTAGCGTTCCATCAGCACGTTC
ATGGTATCCATACCCTTCTCCCAGGACGAGACCAGAGGCAGACTCAGGGGGTTG
CGCACGTTCAGGACACCGGGGGTCGCGGGCTCGACGATGCGTTTTCCGTCCTTGC
CTTCCTTCAGCAGAACCGGAGGCTGGCTGAATCCCACTCCCACGATCACGGCAT
CTTCCTGGGGCATCTCTTCGTCGGGGTCTACCTTGGTCACATGCTTGGTCTTCCTG
GCTTGCTTCTTTTTTGGAGGGCTGTCCACGGGGACCACGTCCTCCTCGGAAGACC
CGGAGCCCACCCGCTGATACTTTCGGCGCTTGGTGGGCAGAGGAGGTGGCGGCG
AGGGGCTCCTCTCCTGCTCCGGCGGATAGCGCGCCGACCCGTGGCCCCGGGGCG
GAGTGGCCTCTCGCTCCATGAACCGGCGCACGTCCTGACTGCCGCCGGCCATTGT
TTCCTAGGGGAAGATGGAGGAGCAGCCGCGTAAGCAGGAGCAGGAGGAGGACT
TAACCACCCACGAGCAACCCAAAATCGAGCAGGACCTGGGCTTCGAAGAGCCG
GCTCGTCTAGAACCCCCACAGGATGAACAGGAGCACGAGCAAGACGCAGGCCA
GGAGGAGACCGACGCTGGGCTCGAGCATGGCTACCTGGGAGGAGAGGAGGATG
TGCTGCTGAAACACCTGCAGCGCCAGTCCCTCATCCTCCGGGACGCCCTGGCCG
ACCGGAGCGAAACCCCCCTCAGCGTCGAGGAGCTGTGTCGGGCCTACGAGCTCA
ACCTCTTCTCGCCGCGCGTGCCCCCCAAACGCCAGCCCAACGGCACATGCGAGC
CCAACCCGCGTCTCAACTTCTATCCCGTCTTTGCGGTCCCCGAGGCCCTTGCCAC
CTATCACATCTTTTTCAAGAACCAAAAGATCCCCGTCTCCTGCCGCGCCAACCGC
ACCCGCGCCGACGCGCTCCTCGCTCTGGGGCCCGGCGCGCGCATACCTGATATC
GCTTCCCTGGAAGAGGTGCCCAAGATCTTCGAAGGGCTCGGTCGGGACGAGACG
CGCGCGGCGAACGCTCTGAAAGAAACAGCAGAGGAAGAGGGTCACACTAGCGC
CCTGGTAGAGTTGGAAGGCGACAACGCCAGGCTGGCCGTGCTCAAGCGCAGCGT
CGAGCTCACCCACTTCGCCTACCCCGCCGTCAACCTCCCGCCCAAGGTCATGCGT
CGCATCATGGATCAGCTCATCATGCCCCACATCGAGGCCCTCGATGAAAGTCAG
GAGCAACGCCCCGAGGACGCCCGGCCCGTGGTCAGCGACGAGATGCTCGCGCGC
TGGCTCGGGACCCGCGACCCCCAGGCTTTGGAACAGCGGCGCAAACTCATGCTG
GCCGTGGTCCTGGTCACCCTCGAGCTAGAATGCATGCGCCGCTTCTTCAGCGACC
CCGAGACCCTGCGCAAGGTCGAGGAGACCCTGCACTACACTTTCAGACACGGTT
TCGTCAGGCAGGCCTGCAAGATCTCCAACGTGGAGCTGACCAACCTGGTCTCCT
GCCTGGGGATCCTGCACGAGAACCGCCTGGGACAGACCGTACTCCACTCTACCC
TAAAGGGCGAGGCGCGGCGGGACTATGTCCGCGACTGCGTCTTTCTCTTTCTCTG
CCACACATGGCAGTCTGCCATGGGTGTGTGGCAGCAGTGTCTCGAGGACGAGAA
CCTGAAGGAGCTGGACAAGCTTCTTGCTAGAAACCTTAAAAATCTGTGGACGGG
CTTCGACGAGCGCACCGTCGCCTCGGACCTGGCCGAGATCGTCTTCCCAGAGCG
CCTGAGGCAGACGCTGAAAGGCGGGCTGCCCGACTTCATGAGCCAGAGCATGTT
GCAAAACTACCGCACTTTCATTCTCGAGCGATCGGGGATGCTGCCCGCCACCTGC
AACGCTTTCCCCTCCGACTTTGTCCCGCTGAGCTACCGCGAGTGTCCCCGCCGC
TGTGGAGCCACTGCTATCTCTTGCAGCTGGCCAACTACATCGCCTACCACTCGGA
CGTGATCGAGGACGTGAGCGGCGAGGGGCTGCTCGAGTGCCACTGCCGCTGCAA
CCTGTGCTCCCCGCACCGCTCCCTGGTCTGCAACCCCCAGCTACTTAGCGAGACC
CAGGTCATCGGTACCTTCGAGCTGCAAGGTCCGCAGGAGTCCACCGCTCCGCTG
AAACTCACGCCGGGGTTGTGGACTTCCGCGTACCTGCGCAAATTTGTACCCGAG
GACTACCACGCCCATGAAATAAAGTTCTTCGAGGACCAATCGCGGCCGCAGCAC
GCGGATCTCACGGCCTGCGTCATCACCCAGGGCGCGATCCTCGCCCAATTGCAC
GCCATCCAAAAATCCCGCCAAGAGTTTCTTCTGAAAAAGGGTAGAGGGGTCTAC
CTGGACCCCCAGACGGGCGAGGTGCTCAACCCGGGTCTCCCCCAGCATGCCGAG
GAAGAAGCAGGAGCCGCTAGTGGAGGAGATGGAAGAAGAATGGGACAGCCAG
GCAGAGGAGGACGAATGGGAGGAGGAGACAGAGGAGGAAGAATTGGAAGAGG
TGGAAGAGGAGCAGGCAACAGAGCAGCCCGTCGCCGCCACCATCCGCGCCGGCA
GCCCCGGCGGTCACGGATACAACCTCCGCAGCTCCGGTCAAGCCTCCTCGTAGA
TGGGATCGAGTGAAGGGTGACGGTAAGCACGAGCGGCAGGGCTACCGATCATG
GAGGGCCCACAAAGCCGCGATCATCGCCTGCTTGCAAGACTGCGGGGGGAACAT
CGCTTTCGCCCGCCGCTACCTGCTCTTCCACCGCGGGGTGAACATCCCCCGCAAC
GTGTTGCATTACTACCGTCACCTTCACAGCTAAGAAAAAGCAAGTCAGAGGAGT
CGCCGGAGGAGGAGGAGGCCTGAGGATCGCGGCGAACGAGCCCTCGACCACCA
GGGAGCTGAGGAACCGGATCTTCCCCACTCTTTATGCCATTTTTCAGCAGAGTCG
AGGTCAGCAGCAAGAGCTCAAAGTAAAAAATCGATCTCTGCGCTCGCTCACCCG
CAGTTGCTTGTACCACAAAAACGAAGATCAGCTGCAGCGCACTCTCAGAAGAGC
CGAGGCTCTGTTCCACAAGTACTGCGCGCTCACTCTTAAAGACTAAGGCGCGCC
CACCCGGAAAAAAGGCGGGAATTACCTCATCGCCACCATGAGCAAGGAGATTCC
CACCCCTTACATGTGGAGCTATCAGCCCCAGATGGGCCTGGCAGCGGGCGCCTC
CCAGGACTACTCCACCCGCATGAACTGGCTCAGTGCCGGCCCCTCGATGATCTCA
CGGGTCAACGGGGTCCGCAGTCATCGAAACCAGATATTGTTGGAGCAGGCGGCG
GTCACCTCCACGCCCAGGGCAAAGCTCAACCCGCGTAATTGGCCCTCCACCCTG
GTGTATCAGGAAATCCCCGGGCCGACTACCGTACTACTTCCGCGTGACGCACTG
GCCGAAGTCCGCATGACTAACTCAGGTGTCCAGCTGGCCGGCGGCGCTTCCGG
TGCCCGCTCCGCCCACAATCGGGTATAAAAACCCTGGTGATCCGAGGCAGAGGC
ACACAGCTCAACGACGAGTTGGTGAGCTCTTCGATCGGTCTGCGACCGGACGGA
GTGTTCCAACTAGCCGGAGCCGGGAGATCCTCCTTCACTCCCAACCAGGCCTACC
TGACCTTGCAGAGCAGCTCTTCGGAGCCTCGCTCCGGAGGCATCGGAACTCTCC
AGTTTGTGGAGGAGTTTGTGCCCTCGGTCTACTTCAACCCCTTCTCGGGATCGCC
```

TABLE 7-continued

Nucleic Acid Sequences of Vectors

SEQ ID NO Sequence

AGGCCTCTACCCGGACGAGTTCATACCGAACTTCGACGCAGTGAGAGAAGCGGT
GGACGGCTACGACTGAATGTCCCATGGTGACTCGGCTGAGCTCGCTCGGTTGAG
GCATCTGGACCACTGCCGCCGCCTGCGCTGCTTCGCCCGGGAGAGCTGCGGACT
CATCTACTTTGAGTTTCCCGAGGAGCACCCCAACGGCCCTGCACACGGAGTGCG
GATCACCGTAGAGGGCGCCACCGAGTCTCACCTGGTCAGGTTCTTCACCCAGCA
ACCCTTCCTGGTCGAGCGGGACCGGGGCGCCACCACCTACACCGTCTACTGCAT
CTGTCCTACCCCGAAGTTGCATGAGAATTTTTGCTGTACTCTTTGTGCTGAGTTTA
ATAAAAGCTGAAATAAGAATCTTCTCTGGACCTTGTCATCGACCTCGGAACAGC
ACCGTCTTACTCACCAATCAGACCAAGGTTCGTCTGAACTGCACAACCAACAGG
AAGTACCTTCTCTGGACTTTCCAAAACACCTCACTCGCTGTTGTCAACGCCCGTG
ACGACGACGGTGTTTAATCCCCAACAACCTCACCAGTGGACTTACTTTCAGCAC
AAGAAAAACTAAGCTCGTCCTCCACAAACCTTTTGTAGAGGGAACCTACCAGTG
CCGACACGGACCCTGTGTTCACAACTTCCATTTGGTGAACCTTACCAGCAGCAGT
ACAGTTGCTCCTGAAACAACTAACCTTTCTTCTGATACTAACAAACCTCGTGTCG
GAGGTGAGCTTTGGGTTCCCTCTCTAACAGAGGGTGGGAGTTCTATTGAAGTGGT
TGGGTATTTGATTTTAGGGGTGGTCCTGGGTGGGTGCATAGCGGTGCTATATCAC
CTTCCTTGCTGGGTCGAAATCAGAGTCTTTATCTGCTGGGTCAGACATTGTGGGG
AGGAACCATGAAGGGGCTCTTGCTGATTATCCTTTCCCTGGTGGGGGTGTACTG
TCATGCCACGAACAGCCACGATGTAACATCACCACAGGCAATGAGAGAAGCGA
ATGCTCTATAGTGATCAAATGTGAGCACAAATGTTCTCTCAACATCACATTCAAG
AATAAGACCATGGGAAATGTATGGGTGGGATTCTGGCAACCAGGAGATGAGCA
GAACTACACGGTCACTGTCCATGGTAGCGATGGAAATCACACTTTCGGTTTCAA
ATTCATTTTTGAAGTCATGTGTGATATCACACTGCATGTGGCTAGACTTCATGGC
TTGTGGCCCCCTACCAAGGAGAACATGGTTGGGTTTTCTTTGGCTTTTGTGATCA
TGGCCTGTGCAATGTCAGGTCTGCTGGTAGGGCTATAATATGGTTCCTGAGGCA
CAAGCCCAGGTATGGAAATCTGGAAAAGGAAAAATTGCTATAAATGTTTTTCTT
TCCACAGCATCATGAATACAGTGATCCGTATCGTGCTGCTCTCTCTTCTTGTAGC
TTTTAGTCAGGCAGGATTTCATACTATCAATGCTACATGGTGGGCTAATATAACT
TTAGTGGGACCCTCAGATACGCCAGTCACCTGGTATGATAAACAGGGAATGCAG
TTCTGTGATGGAAATACAGTTAAGAATCCTCAAATAAGACATGAGTGTAATGAG
CAAAACCTTACACTAATTCATGTGAACAAAACCCATGAAAGGACATACATGGGT
TATAATAGACAGAGTACTCATAAGGAAGACTATAAAGTCATAGTTATACCGCCT
CCTCCTGCTACTGTAAAGCCACAGTCAGGTCCAGAGTATGTATATGTTAATATGG
GAGAGAATAAAACATTAGTTGGACCTCCAGGAATACCAGTTACTTGGTATGACG
GAGAAGGAAATAAATTCTGCGATGGAGAAAAAGTTGAACATGCAGAATTTAATC
ATACATGTGACGTGCAAAATCTTACACTGTTGTTTATAAATCTTACACATGATGG
GGCTTATCTTGGCTATAATCACCAGGGAACTAAAAGAACTTGGTATGAGGTTGT
AGTGACAGATGGTTTTCCAAAATCAGGGGAGATGAAAATCGAAGATCAGAGTA
GACAAACAGAACAAAAACAAACTGGGCAAAAACAAAATGAGCATAAACAGGGT
GGGCAGAAACAGGAGGGGCAAAAAGAGACAAGTCAAAAGAAAGCTAATGACA
AACAGAAGGCGACACACAGGAGGCCATCAAAACTAAAGCCGCACACACCTGAA
GCAAAACTGATTACAGTTTCTAGTGGGTCTAACTTAACATTACTTGGGCCAGATG
GAAAGGTCACTTGGTATGATGATGATTTAAAAAGACCATGTGAACCTGGATATA
AGTTAAACTGTAAGTGTGACAATCAAAACCTAACCCTAATCAATGTAACTAAAC
TTTATGAGGGAGTTTACTATGGTACTAATGACGGAGGCAATGGCAAAAGATACA
GAGTAAAAGTAAACACTACGAATTCTCAAAATGTGAAAATTCAGCCGTACACCA
GGCCTACTACTCCTGATCAGAAACACAGATTTGAATTGCAAATTGATTATAATCA
AGACAATGACAAAATTCCATCAACTACTGTGGCAATCGTGGTGGGTGTGATTGC
GGGCTTCATAACTCTGATCATTGTCATTCTGTGCTACATCTGCTGCCGCAAGCGT
CCAAGGGCATACAATCATATGGTAGACCCACTACTCAGCTTCTCTTACTGAGACT
CAGTCACTTTCATTTCAGAACCATGAAGGCTTTCACAGCTTGCGTTCTGATTAGC
ATAGTCACACTTAGTTCAGCTGCAATGATTAATGTTAATGTCACTAGAGGTGGTA
AAATTACATTGAATGGGACTTATCCACAAACTACATGGACAAGATATCATAAAG
ATGGATGGAAAATATCTGTGAATGGAATGTTACAGCCTATAAATGCTTCAGTA
ATGGAAGCATTACAATTACTGCCACTGCTAATATTACTTCTGGCACAATCAAGGC
AGAAAGCTATAAAAATGAAATGAAAAAAATGGTATATAAAAATAACAAGACAA
CATTTGAAGATTCTGGAAATTATGAGTATCAGAAATTATCTTTTTATAATCTGAC
AATTATTGAGCTGCCAACTACTAAGGCTCCCACAGTTAGGACAACGCAGCCTAC
CACTGTACCCACTACACATCCAACCACAACTCACACTACACAGTTAGACACTAC
AGTGCAGAATAGTACTGTATTGGTTAGGTATTTGTTAAGAGAGGAAAGTACTAC
TGAACAGACAGAGGCTACCTCAAGTGCCTTCAGCAGCACTGCAAATTTAACTTC
GCTTGCTTCGACTAATGAAACCGGAGTATCATTGATGTATGGCCAACATTACCCA
GGTTTGGATATACAAATCACTTTCTTGATTGTCTGTGGGTCTTTATTCTCGCTGT
CCTTCTCTACTTTGTCTGCTGCAAAGCCAGAGAGAAATCTAGTAGGCCCATCTAC
AGGCCAGTAATCGGGGAGCCTCAGCCACTGCAAGTGGAAGGGGGTCTAAGGAA
TCTTCTCTTCTCTTTTTCAGTATGGTGATCAGCCATGATTCCTAGGTTCTTCCTATT
TAACATCCTCTTCTGTCTCTTCAACATCTGCGCTGCCTTCGCGGCCGTCTCGCACG
CCTCGCCCGACTGTCTCGGGCCCTTCCCCACCTACCTCCTCTTTGCCCTGCTCACC
TGCACCTGCGTCTGCAGCATTGTCTGCCTGGTCGTCACCTTCCTGCAGCTCATCG
ACTGGTGCTGCGCGCGCTACAATTATCTCCACCACAGTCCCGAATACAGGGACG
AGAACGTAGCCAGAATCTTAAGGCTCATATGACCATGCAGACTCTGCTCATACT
GCTATTCCTCCTATCTCCTGCCCTTGCTGATGATGATTACTCTAAGTGCAAATTTG
TGGAGCTATGGAATTTCTTAGACTGCTATGATGCTAAATGGATATGCCTTCCTA
TTACTTGGTAATTGTGGGGATAGTCATGGTCTGCTCCTGCACTTTCTTTGCCATCA
TGATCTACCCCTGTTTTGATCTCGGCTGGAACTCTGTTGAGGCATTCACATACAC
ACTAGAAAGCAGTTCACTAGCCTCCACGCCACCACCCACACCGCCTCCCCGCAG

TABLE 7-continued

Nucleic Acid Sequences of Vectors

| SEQ ID NO | Sequence |
|---|---|
| | AAATCAGTTTCCCATGATTCAGTACTTAGAAGAGCCCCCTCCCCGGCCCCCTTCC<br>ACTGTTAGCTACTTTCACATAACCGGCGGCGATGACTGACCACCTGGACCTCGA<br>GATGGACGGCCAGGCCTCCGAGCAGCGCATCCTGCAACTGCGCGTCCGTCAGCA<br>GCAGGAGCGGGCCGCCAAGGAGCTCCTCGATGCCATCAACATCCACCAGTGCAA<br>GAAGGGCATCTTCTGCCTGGTCAAACAGGCAAAGATCACCTACGAGCTCGTGTC<br>CAACGGCAAACAGCATCGCCTCACCTATGAGATGCCCCAGCAGAAGCAGAAGTT<br>CACCTGCATGGTGGGCGTCAACCCCATAGTCATCACCCAGCAGTCGGGCGAGAC<br>CAACGGCTGCATCCACTGCTCCTGCGAAAGCCCCGAGTGCATCTACTCCCTCCTC<br>AAGACCCTTTGCGGACTCCGCGACCTCCTCCCCATGAACTGATGTTGATTAAAAG<br>CCCAAAAACCAATCAGCCCCTTACCCCATTCCCCTCCCACAATTACTCATAAGAA<br>TAAATCATTGGAATTAATGTTTCAATAAAGATCACTTACTTGAAATCTGAAAGTA<br>TGTCTCTGGTGTAGTTGTTCAGCAACACCTCAGTACCCTCCTCCCAGCTCTGGTA<br>TTCCAGTCCCCGGCGGGCGGCAAACTTTCTCCACACCTTGAAAGGGATGTCAAA<br>TTCCTGGTCCACAATTTTCATTGTCTTCCCTCTCAGATGTCAAAGAGGCTCCGGG<br>TGGAAGATGACTTCAACCCCGTCTACCCCATGGCTACGCGCGGAATCAGAATA<br>TCCCCTTCCTCACTCCCCCTTTGTCTCCTCCGATGGATTCCAAAACTTTCCCCCT<br>GGTGTGCTGTCACTCAAATTGGCTGACCCAATCACTATCAGTAATGGCGATGTCT<br>CACTCAAGGTGGGAGGGGGACTCACTGTGGAACAAGATAGTGGAAACCTAAGT<br>GTGAACCCTAAGGCTCCATTGCAAGTTGGAACAGACAAAAAACTGGAATTGGCT<br>TTAGCACCTCCATTTGATGTCAGAGATAACAAGCTAGCTATTCTAGTAGGAGATG<br>GATTAAAGGTAATAGATAGATCAATATCTGATTTGCCAGGATTGTTAAACTATCT<br>TGTAGTTTTGACTGGCAAAGGAATTGGAAATGAAGAATTAAAAAATGACGATGG<br>TAGCAATAAAGGAGTCGGTTTATGTGTGAGAATTGGAGAAGGAGGTGGTTTAAC<br>TTTTGATGATAAAGGTTATTTAGTAGCATGGAACAAGAAACATGACATCCGCAC<br>ACTTTGGACAACTTTAGACCCTTCTCCAAATTGTAAGATAGATATAGAAAAAGA<br>CTCAAAATTAACTTTGGTACTGACAAAGTGCGGAAGTCAGATTTTGGCAAATGT<br>ATCTCTAATTATAGTTAACGGAAAGTTCAAGATCCTTAATAACAAAACAGACCC<br>ATCCCTACCTAAATCATTTAACATCAAACTACTGTTTGATCAAAATGGAGTTCTA<br>TTGGAAAATTCAAACATTGAAAAACAGTACCTAAACTTTAGAAGTGGAGACTCT<br>ATTCTTCCAGAGCCATATAAAAATGCAATTGGATTTATGCCTAATTTACTAGCTT<br>ATGCTAAAGCTACAACTGATCAGTCTAAAATTTATGCAAGGAACACTATATATG<br>GAAATATCTACTTAGATAATCAGCCATATAATCCAGTTGTAATTAAAATTACTTT<br>TAATAATGAAGCAAATAGTGCTTATTCTATCACTTTTAACTATTCATGGACCAAG<br>GACTATGACAATGTCCCTTTTGATTCTACTTCATTTACCTTCTCCTATATCGCCCA<br>AGAATGAAAGACCAATAAACATGTTTCATTTGAAAATTTTCATGTATCTTTATT<br>GATTTTTACACCAGCACGGGTAGTCAGCCTCCCACCACCAGCCCATTTCACAGTG<br>TAAACAATTCTCTCAGCACGGGTGGCCTTAAATAGGGGAATGTTCTGATTAGCA<br>CGGGAACTGGATTTAGTGTCTATAAGCCACACAGTTTCCTGGCAGCCAAACGG<br>GGGTCGGTGATTGAGATGAAGCCGTCCTCTGAAAAGTCATCCAAGCGGGCCTCA<br>CAGTCCAAGGTCACAGTCTGGTGGAATGAGAAGAACGCACAGATTCATACTCGG<br>AAAACAAGATGGGTCTGTGCCTCTCCATCAGCGCCCTCAGCAGTCTTTGCCGCCG<br>GGGCTCGGTGCGGCTGCTGCAGATGGGATCGGGATCGCAAGTCTCTCTGACTAT<br>GATCCCCACAGCCTTCAGCATCAGTCTCCTGGTGCGTCGGGCACAGCACCGCATC<br>CTGATCTCTGCCATGTTCTCACAGTAAGTGCAGCACATAATCACCATGTTATTCA<br>GCAGCCCATAATTCAGGGTGCTCCAGCCAAAACTCATGTTGGGGATGATGGAAC<br>CCACGTGACCATCGTACCAGATGCGGCAGTATATCAG |
| SEQ ID<br>NO: 1447 | CATCATCAATAATATACCTTATTTTGGATTGAAGCCAATATGATAATGAGGGGGT<br>GGAGTTTGTGACGTGGCGCGGGGCGTGGGAACGGGGCGGGTGACGTAGTAGTGT<br>GGCGGAAGTGTGATGTTGTAAGTGTGGCGGAACACATGTAAGCGCCGGATGTGG<br>TAAAAGTGACGTTTTTGGTGTGCGCCGGTGTACACGGGAAGTGACAATTTTCGC<br>GCGGTTTTAGGCGGATGTTGTAGTAAATTTGGGCGTAACCAAGTAATATTTGGCC<br>ATTTTCGCGGGAAAACTGAATAAGAGGAAGTGAAATCTGAATAATTCTGTGTTA<br>CTCATAGCGCGTAATATTTGTCTAGGGCCGCGGGGACTTTGACCGTTTACGTGGA<br>GACTCGCCCAGGTGTTTTTCTCAGGTGTTTTCCGCGTTCCGGGTCAAAGTTGGCG<br>TTTTATTATTATAGTCAGCTGACGCGCAGTGTATTTATACCCGGTGAGTTCCTCA<br>AGAGGCCACTCTTGAGTGCCAGCGAGTAGAGTTTTCTCCTCCGAGCCGCTCCGAC<br>ACCGGGACTGAAAATGAGACATATTATCTGCCACGGAGGTGTTATTACCGAAGA<br>AATGGCCGCCAGTCTTTTGGACCAGCTGATCGAAGAGGTACTGGCTGATAATCTT<br>CCACCTCCTAGCCATTTTGAACCACCTACCCTTCACGAACTGTATGATTTAGACG<br>TGACGGCCCCCGAAGATCCCAACGAGGAGGCGGTTTCGCAGATTTTTCCCGAGT<br>CTGTAATGTTGGCGGTGCAGGAAGGGATTGACTTATTCACTTTTCCGCCGGCGCC<br>CGGTTCTCCGGAGCCGCCTCACCTTTCCCGGCAGCCCGAGCAGCCGGAGCAGAG<br>AGCCTTGGGTCCGGTTTCTATGCCAAACCTTGTGCCGGAGGTGATCGATCTTACC<br>TGCCACGAGGCTGGCTTTCCACCCAGTGACGACGAGGATGAAGAGGGTGAGGA<br>GTTTGTGTTAGATTATGTGGAGCACCCCGGGCACGGTTGCAGGTCTTGTCATTAT<br>CACCGGAGGAATACGGGGGACCCAGATATTATGTGTTCGCTTTGCTATATGAGG<br>ACCTGTGGCATGTTTGTCTACAGTAAGTGAAAATTATGGGCAGTGGGTGATAGA<br>GTGGTGGGTTTGTGTGGTAATTTTTTTTAATTTTTACAGTTTTGTGGTTTAAAG<br>AATTTTGTATTGTGATTTTTAAAAGGTCCTGTGTCTGAACCTGAGCCTGAGCCC<br>GAGCCAGAACCGGAGCCTGCAAGACCTACCCGGCGTCCTAAATTGGTGCCTGCT<br>ATCCTGAGACGCCCGACATCACCTGTGTCTATAGAATGCAATAGTAGTACGGAT<br>AGCTGTGACTCCGGTCCTTCTAACACACCTCCTGAGATACACCCGGTGGTCCCGC<br>TGTGCCCCATTAAACCAGTTGCCGTGAGAGTTGGTGGGCGTCGCCAGGCTGTGG<br>AATGTATCGAGGACTTGCTTAACGAGTCTGGGCAACCTTTGGACTTGAGCTGTAA<br>ACGCCCCAGGCCATAAGGTGTAAACCTGTGATTGCGTGTGTGGTTAACGCCTTTG |

TABLE 7-continued

Nucleic Acid Sequences of Vectors

SEQ ID NO Sequence

TTTGCTGAATGAGTTGATGTAAGTTTAATAAAAAGGGTGAGATAATGTTTAACTT
GCATGGCGTGTTAAATGGGGCGGGGCTTAAAGGGTATATAATGCGCTGTGGGCT
AATCTTGGTTACATTTGACCTCATGGAGGCTTGGGAGTGTTTGGAAGATTTTTCT
GCTGTGCGTAACTTGCTGGAACAGAGCTCTAACAGTACCTCCTGGTTTTGGAGGT
TTCTGTGGGGCTCCTCCCAGGCAAAGTTAGTCTGCAGAATTAAGGAGGATTACA
AGTGGGAATTTGAAGAGCTTTTGAAATCCTGTGGTGAGCTGTTTGATTCTTTGAA
TCTGGGTCACCAGGCGCTTTTCCAAGAGAAGGTCATCAAGACTTTGGATTTTTCC
ACACCGGGGCGCGCTGCGGCTGCTGTTGCTTTTTTGAGTTTTATAAAGGATAAAT
GGAGCGAAGAAACCCATCTGAGCGGGGGGTACCTGCTGGATTTTCTGGCCATGC
ATTTGTGGAGAGCGGTGGTGAGACACAAGAATCGCCTACTACTGTTGTCTTCCGT
CCGCCCGGCAATAATACCGACGGAGGAGCAGCAGCAGCAACAGCAGCAGCAGG
AGGAAGCCAGGCGGCGGCGGCGGCAGGAGCAGAGCCCATGGAACCCGAGAGCC
GGCCTGGACCCTCGGGAATGAATGTTGTACAGGTGGCTGAACTGTTTCCAGAAC
TGAGACGCATTTTAACCATTAACGAGGATGGGCAGGGGCTAAAGGGGGTAAAG
AGGGAGCGGGGGGCTTCTGAGGCTACAGAGGAGGTTAGGAATTTAACTTTTAGC
TTAATGACCAGACACCGTCCTGAGTGTGTTACTTTTCAGCAGATTAAGGATAATT
GCGCTAATGAGCTTGATCTGCTGGCGCAGAAGTATTCCATAGAGCAGCTGACCA
CTTACTGGCTGCAGCCAGGGGATGATTTTGAGGAGGCTATTAGGGTATATGCAA
AGGTGGCACTTAGGCCAGATTGCAAGTACAAGATTAGCAAACTTGTAAATATCA
GGAATTGTTGCTACATTTCTGGGAACGGGGCCGAGGTGGAGATAGATACGGAGG
ATAGGGTGGCCTTTAGATGTAGCATGATAAATATGTGGCCGGGGGTACTTGGCA
TGGACGGGGTGGTTATTATGAATGTGAGGTTTACTGGCCCCAATTTTAGCGGTAC
GGTTTTCCTGGCCAATACCAACCTTATCCTACACGGTGTAAGCTTCTATGGGTTT
AACAATACCTGCGTGGAAGCCTGGACCGATGTAAGGGTTCGAGGCTGTGCCTTT
TACTGCTGCTGGAAGGGGGTGGTGTGTCGCCCCAAAAGCAGGGCTTCAATTAAG
AAATGCCTCTTTGAAAGGTGTACCTTGGGTATCCTGTCTGAGGGTAACTCCAGGG
TGCGCCACAATGTGGCCTCCGACTGTGGTTGCTTCATGCTAGTGAAAAGCGTGGC
TGTGATTAAGCATAACATGGTGTGTGGCAACTGCGAGGACAGGGCCTCTCAGAT
GCTAACCTGCTCGGACGGCAACTGTCACCTGCTGAAGACCATTCACGTAGCCAG
CCACTCTCGCAAGGCCTGGCCAGTGTTTGAGCACAACATACTGACCCGCTGTTCC
TTGCATTTGGGTAACAGGAGGGGGGTGTTCCTACCTTACCAATGCAATTTGAGTC
ACACTAAGATATTGCTTGAGCCCGAAAGCATGTCCAAGGTGAACCTGAACGGGG
TGTTTGACATGACCATGAAGATCTGGAAGGTGCTGAGGTACGATGAGACCCGCA
CCAGGTGCAGACCCTGCGAGTGTGGCGGTAAACATATTAGGAACCAGCCTGTGA
TGCTGGATGTGACCGAGGAGCTGAGGCCCGATCACTTGGTGCTGGCCTGCACCC
GCGCTGAGTTTGGCTCTAGCGATGAAGATACAGATTGAGGTACTGAAATGTGTG
GGCGTGGCTTAAGGGTGGGAAAGAATATATAAGGTGGGGGTCTCATGTAGTTTT
GTATCTGTTTTGCAGCAGCCGCCGCCATGAGCACCAACTCGTTTGATGGAAGCAT
TGTGAGCTCATATTTGACAACGCGCATGCCCCCATGGGCCGGGGTGCGTCAGAA
TGTGATGGGCTCCAGCATTGATGGTCGCCCCGTCCTGCCCCGCAAACTCTACTACC
TTGACCTACGAGACCGTGTCTGGAACGCCGTTGGAGACTGCAGCCTCCGCCGCC
GCTTCAGCCGCTGCAGCCACCGCCCGCGGGATTGTGACTGACTTTGCTTTCCTGA
GCCCGCTTGCAAGCAGTGCAGCTTCCCGTTCATCCGCCCGCGATGACAAGTTGAC
GGCTCTTTTGGCACAATTGGATTCTTTGACCCGGGAACTTAATGTCGTTTCTCAG
CAGCTGTTGGAGCTGCGCCAGCAGGTTTCTGCCCTGAAGGCTTCCTCCCCTCCCA
ATGCGGTTTAAAACATAAATAAAAACCAGACTCTGTTTGGATTTGGATCAAGCA
AGTGTATTGCTGTCTTTATTTAGGGGTTTTGCGCGCGCGGTAGGCCCGGGACCAG
CGGTCTCGGTCGTTGAGGGTCCTGTGTATTTTTTCCAGGACGTGGTAGAGATGGC
TCTGGATGTTCAGATACATGGGCATAAGCCCGTCTCTGGGGTGGAGGTAGCACC
ACTGCAGAGCTTCATGCTGCGGGTGGTGTTGTAGATGATCCAGTCGTAGCAGG
AGCGCTGGGCGTGGTGCCTAAAAATGTCCTTTAGAAGCAAGCTGATTGCCAGGG
GCAAGCCCTTGGTGTAAGTGTTTACAAAGCGGTTAAGCTGGGATGGGTGCATAC
GTGGGGATATGAGATGCATCTTGGACTGTATTTTTAGGTTGGCTATGTTCCCAGC
CATATCCCTCCTGGGATTCATGTTGTGCAGAACCACCAGCACAGTGTATCCGGTG
CACTTGGGAAATTTGTCATGTAGCTTAGAAGGAAATGCGTGGAAGAACTTGGAG
ACGCCCTTGTGACCTCCAAGATTTTCCATGCATTCGTCCATAATGATGGCAATGG
GCCCACGGGCGGCGGCCTGGGCGAAGATATTTCTGGGATCACTAACGTCATAGT
TGTGTTCCAGGATGAGATCGTCATAGGCCATTTTTACAAAGCGCGGGCGGAGGG
TGCCAGACTGCGGTATAATGGTTCCATCCGGCCCAGGGGCGTAGTTACCCTCAC
AGATTTGCATTTCCCACGCTTTGAGTTCAGATGGGGGGATCATGTCTACCTGCGG
GGCGATAAAGAAAACGGTTTCCGGGGTAGGGGAGATCAGCTGGGAAGAAAGCA
GGTTCCTGAGCAGCTGCGACTTACCGCAGCCGGTGGGCCCGTAAATCACACCTA
TTACCGGCTGCAACTGGTAGTTAAGAGAGCTGCAGCTGCCGTCATCCCTGAGCA
AGGGGGCCACTTCGTTAAGCATGTCCCTGACACGCATGTTTTCCCTGACCAAATC
CGCCAGAAGGCGCTCGCCGCCCAGCCGATAGCAGTTCTTGCAAGGAAGCAAAGTT
TTTCAACGGTTTGAGGCCGTCCGCCGTAGGCATGCTTTTGAGCGTTTGACCAAGC
AGTTCCAGGCGGTCCCACAGCTCGGTCACGTGCTCTACGGCATCTCGATCCAGCA
TATCTCCTCGTTTCGCGGGTTGGGGCGGCTTTCGCTGTACGGCAGTAGTCGGTGC
TCGTTCAGACGGGCCAGGGTCATGTCTTTCCACGGGCGCAGGGTCCTCGTCAGC
GTAGTCTGGGTCACGGTAAAGGGGTGCGCTCCGGGCTGCGCGCTGGCCAGGGTG
CGCTTGAGGCTGGTCCTGCTGGTGCTGAAGCGCTGCCGTCTTCGCCCTGCGCGT
CGGCCAGGTAGCATTTGACCATGATGTCATAGTCCAGCCCCTCCGCGGCGTGGC
CCTTGGCGCGCAGCTTGCCCTTGGAGGAGGCGCCGCACGAGGGGCAGTGCAGAC
TTTTGAGGGCGTAGAGCTTGGGCGCGAGAAATACCGATTCCGGGGAGTAGGCAT
CCGCGCCGCAGGCCCCGCAGACGGTCTCGCATTCCACGAGCCAGGTGAGCTCTG
GCCGGTTGGGGTCAAAAACCAGGTTTCCCCCATGCTTTTTGATGCGTTTCTTACC

TABLE 7-continued

Nucleic Acid Sequences of Vectors

SEQ ID NO Sequence

TCTGGTTTCCATGAGCCGGTGTCCACGCTCGGTGACGAAAAGGCTGTCCGTGTCC
CCGTATACAGACTTGAGAGGCCTGTCCTCGAGCGGTGTTCCGCGGTCCTCCTCGT
ATAGAAACTCGGACCACTCTGAGACGAAGGCTCGCGTCCAGGCCAGCACGAAG
GAGGCTAAGTGGGAGGGGTAGCGGTCGTTGTCCACTAGGGGGTCCACTCGCTCC
AGGGTGTGAAGACACATGTCCCCCTCTTCGGCATCAAGGAAGGTGATTGGTTTG
TAGGTGTATGCCACGTGACCGGGTGTTCCTGAAGGGGGGTATAAAAGGGGGTG
GGGGCGCGTTCGTCCTCACTCTCTTCCGCATCGCTGTCTGCGAGGGCCAGCTGTT
GGGGTGAGTACTCCCTCTGGAAAGCGGGCATGACTTCTGCGCTAAGGTTGTCAG
TTTCCAAAAACGAGGAGGATTTGATATTCACCTGGCCCGCGGTGATGCCTTTGAG
GGTGGCCGCGTCCATCTGGTCAGAAAAGACAATCTTTTTGTTGTCAAGCTTGGTG
GCAAACGACCCGTAGAGGGCGTTGGACAGCAACTTGGCGATGGAGCGCAGGGT
TTGGTTTTTGTCGCGATCGGCGCGCTCCTTGGCCGCGATGTTTAGCTGCACGTAT
TCGCGCGCAACGCACCGCCATTCGGGAAAGACGGTGGTGCGCTCGTCGGGCACC
AGGTGCACGCGCCAACCGCGGTTGTGCAGGGTGACAAGGTCAACGCTGGTGGCT
ACCTCTCCGCGTAGGCGCTCGTTGGTCCAGCAGAGGCGGCCGCCCTTGCGCGAG
CAGAATGGCGGTAGGGGGTCTAGCTGCGTCTCGTCCGGGGGGTCCGCGTCCACG
GTAAAGATCCCGGGCAACAGGCGCGCGTCGAAGTAGTCTATCTTGCATCCTTGC
AAGTCTAACGCCTGCTGCCATGCGCGGGCGGCAAGCGCGCGCTCGTATGGGTTG
AGTGGGGACCCCATGGCATGGGTGGGTGAGCGCGGAGGCGTACATGCCGCA
GATGTCGTAAACGTAGAGGGGCTCCCTGAGTATTCCAAGATATGTAGGGTAGCA
TCTTCCACCGCGGATGCTGGCGCGCACGTAATCGTATAGTTCGTGCGAGGGGGC
GAGGAGGTCGGGACCGAGGTTGCTACGGGCGGGCTGCTCTGCTCGAAAGACGAT
CTGCCTGAAGATGGCATGCGAGTTGGATGATATGGTTGGACGCTGGAAGACGTT
GAAGCTGGCGTCTGTGAGACCTACCGCGTCACGCACGAAGGAGGCGTAGGAGTC
GCGCAGCTTGTTGACCAGCTCGGCGGTGACCTGCACGTCTAGGGCGCAGTAGTC
CAGGGTTTCCTTGATGATGTCATACTTATCCTGTCCCTTTTTTTCCACAGCTCGC
GGTTGAGGACAAACTCTTCGCGGTCTTTCCAGTACTCTTGGATCGGAAACCCGTC
GGCCTCCGAACGGTAAGAGCCTAGCATGTAGAACTGGTTGACGGCCTGGTAGGC
GCAGCATCCCTTTTCTACGGGTAGCGCGTATGCCTGCGCGGCCTTCCGGAGCGAG
GTGTGGGTGAGCGCAAAGGTGTCCCTGACCATGACTTTGAGGTACTGGTATTTG
AAGTCAGTGTCGTCGCATCCGCCCTGCTCCCAGAGCAAAAGTCCGTGCGCTTTT
TGGAACGCGGGTTTGGTAGGGCGAAGGTGACATCGTTGAAGAGTATCTTTCCCG
CGCGAGGCATAAAATTGCGTGTGATGCGGAAGGGTCCCGGCACCTCGGAACGGT
TGTTAATTACCTGGGCGGCGAGCACGATCTCGTCAAAGCCGTTGATGTTGTGGCC
CACGATGTAAAGTTCCAAGAAGCGCGGGTGCCCTTAATGGAGGGCAATTTTTT
AAGTTCCTCGTAGGTAAGCTCTTCAGGGGAGCTGAGCCCGTGCTCTGACAGGGC
CCAGTCTGCAAGATGAGGGTTGGAAGCAACGAATGAGCTCCACAGGTCACGGGC
CATTAGCATTTGCAGGTGGTCGCGAAAGGTCCTAAACTGGCGACCTATGGCCAT
TTTTTCTGGGGTGATGCAGTAGAAGGTAAGCGGGTCTTGTTCCCAGCGGTCCCAT
CCAAGGTCCACGGCTAGGTCTCGCGCGGCGGTCACTAGAGGCTCATCTCCGCCG
AACTTCATGACCAGCATGAAGGGCACGAGCTGCTTTCCAAAGGCCCCCATCCAA
GTATAGGTCTCTACATCGTAGGTGACAAAGACGCTCGGTGCGAGGATGCGAG
CCGATCGGGAAGAACTGGATCTCCCGCCACCAGTTGGAGGAGTGGCTGTTGATG
TGGTGAAAGTAGAAGTCCCTGCGACGGGCCGAACACTCGTGCTGGCTTTTGTAA
AAACGTGCGCAGTACTGGCAGCGGTGCACGGGCTGTACATCCTGCACGAGGTTG
ACCTGACGACCGCGCACAAGGAAGCAGAGGGGGAATTTGAGCCCCTCGCCTGCC
GGGTTTGGCTGGTGGTCTTCTACTTCGGCTGCTTGTCCTTGACCGTCTGGCTGCTC
GAGGGGAGTTACGGTGGATCGGACCACCACGCCGCGCGAGCCCAAAGTCCAGA
TGTCCGCGCGCGGCGGTCGGAGCTTGATGACAACATCGCGCAGATGGGAGCTGT
CCATGGTCTGGAGCTCCCGCGGCGTCAGGTCAGGCGGGAGCTCCTGCAGGTTTA
CCTCGCATAGCCGGTCAGGGCGCGGGCTAGGTCCAGGTGATACCTGATTTCCA
GGGGCTGGTTGGTGGCGGCGTTGATGGCTTGCAAGAGGCCGCATCCCCGCGGCG
CGACTACGGTACCGCGCGGCGGGCGGTGGGCCGCGGGGGTGTCCTTGGATGATG
CATCTAAAAGCGGTGACGCGGGCGGGCCCCGGAGGTAGGGGGGGCTCGGGAC
CCGCCGGGAGAGGGGGCAGAGGCACGTCGGCGCCGCGCGCGGGCAGGAGCTGG
TGCTGCGCGCGGAGGTTGCTGGCGAACGCGACGACGCGGCGGTTGATCTCCTGA
ATCTGGCGCCTCTGCGTGAAGACGACGGGCCCGGTGAGCTTGAACCTGAAAGAG
AGTTCGACAGAATCAATTTCGGTGTCGTTGACGGCGGCCTGGCGCAAAATCTCCT
GCACGTCTCCTGAGTTGTCTTGATAGGCGATCTCGGCCATGAACTGCTCGATCTC
TTCCTCCTGGAGATCTCCGCGTCCGGCTGCTCCACGGTGGCGGCGAGGTCGTTG
GAGATGCGGGCCATGAGCTGCGAGAAGGCGTTGAGGCCTCCCTCGTTCCAGACG
CGGCTGTAGACCACGCCCCCTTCGGCATCGCGGGCGCGCATGACCACCTGCGCG
AGATTGAGCTCCACGTGCCGGGCGAAGACGGCGTAGTTTCGCAGGCGCTGAAAG
AGGTAGTTGAGGGTGGTGGCGGTGTGTTCTGCCACGAAGAAGTACATAACCCAG
CGCCGCAACGTGGATTCGTTGATATCCCCAAGGCCTCAAGGCGCTCCATGGCCT
CGTAGAAGTCCACGGCGAAGTTGAAAAACTGGGAGTTGCGCGCCGACACGGTTA
ACTCCTCCTCCAGAAGACGGATGAGCTCGGCGACAGTGTCGCGCACCTCGCGCT
CAAAGGCTACAGGGGCCTCTTCTTCTTCTTCAATCTCCTCTTCCATAAGGGCCTC
CCCTTCTTCTTCTTCTGGCGGCGGTGGGGAGGGGGGACACGGCGGCGACGACG
GCGCACCGGGAGGCGGTCGACAAAGCGCTCGATCATCTCCCCGCGGCGACGGCG
CATGGTCTCGGTGACAGCGCGGCCGTTCTCGCGGGGGCGCAGTTGGAAGACGCC
GCCCGTCATGTCCCGGTTATGGGTTGGCGGGGGGCTGCCGTGCGGCAGGGATAC
GGCGCTAACGATGCATCTCAACAATTGTTGTGTAGGTACTCCGCCACCGAGGGA
CCTGAGCGAGTCCGCATCGACCGGATCGGAAAACCTCTCGAGAAAGGCGTCTAA
CCAGTCACAGTCGCAAGGTAGGCTGAGCACCGTGGCGGGCGGCAGCGGGCGGC
GGTCGGGGTTGTTTCTGGCGGAGGTGCTGCTGATGATGTAATTAAAGTAGGCGG

TABLE 7-continued

Nucleic Acid Sequences of Vectors

| SEQ ID NO | Sequence |
|---|---|
| | TCTTGAGACGGCGGATGGTCGACAGAAGCACCATGTCCTTGGGTCCGGCCTGCT
GAATGCGCAGGCGGTCGGCCATGCCCCAGGCTTCGTTTTGACATCGGCGCAGGT
CTTTGTAGTAGTCTTGCATGAGCCTTTCTACCGGCACTTCTTCTTCTCCTTCCTCTT
GTCCTGCATCTCTTGCATCTATCGCTGCGGCGGCGGCGGAGTTTGGCCGTAGGTG
GCGCCCTCTTCCTCCCATGCGTGTGACCCCGAAGCCCCTCATCGGCTGAAGCAGG
GCCAGGTCGGCGACAACGCGCTCGGCTAATATGGCCTGCTGCACCTGCGTGAGG
GTAGACTGGAAGTCATCCATGTCCACAAAGCGGTGGTATGCGCCCGTGTTGATG
GTGTAAGTGCAGTTGGCCATAACGGACCAGTTAACGGTCTGGTGACCCGGCTGC
GAGAGCTCGGTGTACCTGAGACGCGAGTAAGCCCTTGAGTCAAAGACGTAGTCG
TTGCAAGTCCGCACCAGGTACTGGTATCCCACCAAAAAGTGCGGCGGCGGCTGG
CGGTAGAGGGGCCAGCGTAGGGTGGCCGGGGCTCCGGGGGCGAGGTCTTCCAA
CATAAGGCGATGATATCCGTAGATGTACCTGGACATCCAGGTGATGCCGGCGGC
AGTGGTTGAGGCGCGCGAAAAGTCGCGGACGCGGTTCCAGATGTTGCGCAGCGG
CAAAAAGTGCTCCATGGTCGGGACGCTCTGGCCGGTTAGGCGCGCGCAGTCGTT
GACGCTCTAGACCGTGCAAAAGGAGAGCCTGTAAGCGGGCACTCTTCCGTGGTC
TGGTGGATAAATTCGCAAGGGTATCATGGCGGACGACCGGGGTTCGAACCCCGG
ATCCGGCCGTCCGCCGTGATCCATGCGGTTACCGCCCGCGTGTCGAACCCAGGT
GTGCGACGTCAGACAACGGGGGAGCGCTCCTTTTGGCTTCCTTCCAGGCGCGGC
GGCTGCTGCGCTAGCTTTTTTGGCCACTGGCCGCGCGCGGCGTAAGCGGTTAGGC
TGGAAAGCGAAAGCATTAAGTGGCTCGCTCCCTGTAGCCGGAGGGTTATTTTCC
AAGGGTTGAGTCGCGGGACCCCCGGTTCGAGTCTCGGGCCGGCCGGACTGCGGC
GAACGGGGGTTTGCCTCCCCGTCATGCAAGACCCCGCTTGCAAATTCCTCCGGA
AACAGGGACGAGCCCCTTTTTTGCTTTTCCCAGATGCATCCGGTGCTGCGGCAGA
TGCGCCCCCTCCTCAGCAGCGGCAAGAGCAAGAGCAGCGGCAGACATGCAGG
GCACCCTCCCCTTCTCCTACCGCGTCAGGAGGGGCAACATCCGCGGCTGACGCG
GCGGCAGATGGTGATGACGAACCCCCGCGGCGCCGGGCCCGGCACTACCTGGAC
TTGGAGGAGGGCGAGGGCCTGGCGCGGCTAGGAGCGCCCTCTCCTGAGCGACAC
CCAAGGGTGCAGCTGAAGCGTGACACGCGCGAGGCGTACGTGCCGCGGCAGAA
CCTGTTTCGCGACCGCGAGGGAGAGGAGCCCGAGGAGATGCGGGATCGAAAGT
TCCATGCAGGGCGCGAGTTGCGGCATGGCCTGAACCGCGAGCGGTTGCTGCGCG
AGGAGGACTTTGAGCCCGACGCGCGGACCGGGATTAGTCCCGCGCGCGCACACG
TGGCGGCCGCCGACCTGGTAACCGCGTACGAGCAGACAGGTGAACCAGGAGATTA
ACTTTCAAAAAAGCTTTAACAACCACGTGCGCACGCTTGTGGCGCGCGAGGAGG
TGGCTATAGGACTGATGCATCTGTGGGACTTTGTAAGCGCGCTGGAGCAAAACC
CAAATAGCAAGCCGCTCATGGCGCAGTTGTTTCTTATAGTGCAGCACAGCAGGG
ACAACGAGGCATTCAGGGATGCACTGCTAAACATAGTAGAGCCCGAGGGCCGCT
GGCTACTCGATTTGATAAATATTCTGCAGAGCATAGTGGTGCAGGAGCGCAGCT
TGAGCCTGGCTGACAAGGTGGCCGCCATTAACTATTCCATGCTCAGTCTGGGCA
AGTTTTACGCCCGCAAGATATACCATACCCCTTACGTTCCCATAGACAAGGAGGT
AAAGATCGAGGGGTTCTACATGCGCATGGCGCTGAAGGTGCTTACCTTGAGCGA
CGACCTGGGCGTTTATCGCAACGAGCGCATCCACAAGGCCGTGAGCGTGAGCCG
GCGGCGCGAGCTCAGCGACCGCGAGCTGATGCACAGCCTGCAAAGGGCCCTGGC
TGGCACGGGCAGCGGCGATAGAGAGGCCGAGTCCTACTTTGACGCGGGCGCTGA
CCTGCGCTGGGCCCCAAGCCGACGCGCCCTGGAGGCAGCTGGGGCCGGACCTGG
GCTGGCGGTGGCACCCGCGCGCGCTGGCAACGTCGGCGGCGTGGAGGAATATGA
CGAGGACGATGAGTACGAGCCAGAGGACGGCGAGTACTAAGCGGTGATATTTCT
GATCAGATGATGCAAGACGCAACGGACCCGGCGGTGCGGGCGGCGCTGCAGAG
CCAGCCGTCCGGCCTTAACTCCACGGACGACTGGCGCCAGGTCATGGACCGCAT
CATGTCGCTGACTGCGCGCAACCCTGACGCGTTCCGGCAGCAGCCACAGGCCAA
CCGGCTCTCCGCAATTCTGGAAGCGGTGGTCCCGGCGCGCGCAAACCCCACGCA
CGAGAAGGTGCTGGCGATCGTAAACGCGCTGGCCGAAAACAGGGCCATCCGGTC
CGATGAGGCCGGCCTGGTCTACGACGCGCTGCTTCAGCGCGTGGCTCGTTACAA
CAGCGGCAACGTGCAGACCAACCTGGACCGGCTGGTGGGGGATGTGCGCGAGG
CCGTGGCGCAGCGTGAGCGCGCGCAGCAGCAGGGCAACCTGGGCTCCATGGTTG
CACTAAACGCCTTCCTGAGTACACAGCCCGCCAACGTGCCGCGGGGACAGGAGG
ACTACACCAACTTTGTGAGCGCACTGCGGCTAATGGTGACTGAGACACCGCAAA
GTGAGGTGTACCAGTCCGGGCCAGACTATTTTTTCCAGACCAGTAGACAAGGCC
TGCAGACCGTAAACCTGAGCCAGGCTTTCAAGAACTTGCAGGGGCTGTGGGGGG
TGCGGGCTCCCACAGGCGACCGCGCGACCGTGTCTAGCTTGCTGACGCCCAACT
CGCGCCTGTTGCTGCTGCTAATAGCGCCCTTCACGGACAGTGGCAGCGTGTCCCG
GGACACATACCTAGGTCACTTGCTGACACTGTACCGAGAGGCCATAGGTCAGGC
GCATGTGGACGAGCATACTTTCCAGGAGATTACAAGTGTTAGCCGCGCGCTGGG
GCAGGAGGACACGGGCAGCCTGGAGGCAACCCTAAACTACCTGCTGACCAACC
GGCGGCAGAAGATCCCCTCGTTGCACAGTTTAAACAGCGAGGAGGAGCGCATTT
TGCGCTATGTGCAGCAGAGCGTGAGCCTTAACCTGATGCGCGACGGGGTAACGC
CCAGCGTGGCGCTGGACATGACCGCGCGCAACATGGAACGGGCATGTATGCCT
CAAACCGGCCGTTTATCAATCGCCTAATGGACTACTTGCATCGCGGCGCCGCGT
GAACCCCGAGTATTTCACCAATGCCATCTTGAACCCGCACTGGCTACCGCCCCT
GGTTTCTACACCGGGGGATTCGAGGTGCCCGAGGGTAACGATGGATTCCTCTGG
GACGACATAGACGACAGCGTGTTTTCCCCGCAACCGCAGACCCTGCTAGAGTTG
CAACAGCGCGAGCAGGCAGAGGCGGCGCTGCGAAAGGAAAGCTTCCGCAGGCC
AAGCAGCTTGTCCGATCTAGGCGCTGCGGCCCCGCGGTCAGATGCTAGTAGCCC
ATTTCCAAGCTTGATAGGGTCTCTTACCAGCACTCGCACCACCCGCCCGCGCCTG
CTGGGCGAGGAGGAGTACCTAAACAACTCGCTGCTGCAGCCGCAGCGCGAAAA
GAACCTGCCTCCGGCGTTTCCCAACAACGGGATAGAGAGCCTAGTGGACAAGAT
GAGTAGATGGAAGACGTATGCGCAGGAACACAGGGATGTGCCCGGCCCGCGCC |

TABLE 7-continued

Nucleic Acid Sequences of Vectors

SEQ ID NO Sequence

CGCCCACCCGTCGTCAAAGGCACGACCGTCAGCGGGGTCTGGTGTGGGAGGACG
ATGACTCGGCAGACGACAGCAGCGTCCTGGATTTGGGAGGGAGTGGCAACCCGT
TTGCGCACCTTCGTCCCAGGCTGGGGAGAATGTTTTAAAAAAAAAAAAGCATGA
TGCAAAATAAAAAACTCACCAAGGCCATGGCACCGAGCGTTGGTTTTCTTGTATT
CCCCTTAGTATGCGGCGCGCGGCGATGTATGAGGAAGGTCCTCCTCCCTCCTACG
AGAGCGTGGTGAGCGCGGCGCCAGTGGCGGCGGCGCTGGGTTCCCCCTTCGATG
CTCCCCTGGACCCGCCGTTCGTGCCTCCGCGGTACCTGCGGCCTACCGGGGGGA
GAAACAGCATCCGTTACTCTGAGTTGGCACCCCTATTCGACACCACCCGTGTGTA
CCTTGTGGACAACAAGTCAACGGATGTGGCATCCCTGAACTACCAGAACGACCA
CAGCAACTTTCTAACCACGGTCATTCAAAACAATGACTACAGCCCGGGGGAGGC
AAGCACACAGACCATCAATCTTGACGACCGGTCGCACTGGGGCGGCGACCTGAA
AACCATCCTGCATACCAACATGCCAAATGTGAACGAGTTCATGTTTACCAATAA
GTTTAAGGCGCGGGTGATGGTGTCGCGCTCGCTTACTAAGGACAACAGGTGGA
GCTGAAATATGAGTGGGTGGAGTTCACGCTGCCCGAGGGCAACTACTCCGAGAC
CATGACCATAGACCTTATGAACAACGCGATCGTGGAGCACTACTTGAAAGTGGG
CAGGCAGAACGGGGTTCTGGAAAGCGACATCGGGGTAAAGTTTGACACCCGCA
ACTTCAGACTGGGGTTTGACCCAGTCACTGGTCTTGTCATGCCTGGGGTATATAC
AAACGAAGCCTTCCATCCAGACATCATTTTGCTGCCAGGATGCGGGGTGGACTT
CACCCACAGCCGCCTGAGCAACTTGTTGGGCATCCGCAAGCGGCAACCCTTCCA
GGAGGGCTTTAGGATCACCTACGATGACCTGGAGGGTGGTAACATTCCCGCACT
GTTGGATGTGGACGCCTACCAGGCAAGCTTGAAAGATGACACCGAACAGGGCG
GGGGTGGCGCAGGCGGCGGCAACAACAGTGGCAGCGGCGCGAAGAGAACTCC
AACGCGGCAGCCGCGGCAATGCAGCCGGTGGATGACATGAACGATCATGCCATT
CGCGGCGACACCTTTGCCACACGGGCGGAGGAGAAGCGCGCTGAGGCCGAGGC
AGCGGCCGAAGCTGCCGCCCCCGCTGCGGAGGCTGCACAACCCGAGGTCGAGA
AGCCTCAGAAGAAACCGGTGATTAAACCCCTGACAGAGGACAGCAAGAAACGC
AGTTACAACCTAATAAGTAATGACAGCACCTTCACCCAGTACCGCAGCTGGTAC
CTTGCATACAACTACGGCGACCCTCAGGCCGGGATCCGCTCATGGACCCTGCTTT
GCACTCCTGACGTAACCTGCGGCTCGGAGCAGGTATACTGGTCGTTGCCCGACA
TGATGCAAGACCCCGTGACCTTCCGCTCCACGAGCCAGATCAGCAACTTTCCGGT
GGTGGGCGCCGAGCTGTTGCCCGTGCACTCCAAGAGCTTCTACAACGACCAGGC
CGTCTACTCCCAGCTCATCCGCCAGTTTACCTCTCTGACCCACGTGTTCAATCGCT
TTCCCGAGAACCAGATTTTGGCGCGCCCGCCAGCCCCCACCATCACCACCGTCA
GTGAAAACGTTCCTGCTCTCACAGATCACGGGACGCTACCGCTGCGCAACAGCA
TCGGAGGAGTCCAGCGAGTGACCATTACTGACGCCAGACGCCGCACCTGCCCCT
ACGTTTACAAGGCCCTGGGCATAGTCTCGCCGCGCGTCCTATCGAGCCGCACTTT
TTGAGCAAGCATGTCCATCCTTATATCGCCCAGCAATAACACAGGCTGGGGCCT
GCGCTTCCCAAGCAAGATGTTTGGCGGGGCCAAGAAGCGCTCCGACCAACACCC
AGTGCGCGTGCGCGGGCACTACCGCGCGCCCTGGGGCGCGCACAAACGCGGCCG
CACTGGGCGCACCACCGTCGATGACGCCATCGACGCGGTGGTGGAGGAGGCGCG
CAACTACACGCCCACGCCGCCGCCAGTGTCCACCGTGGACGCGGCCATTCAGAC
CGTGGTGCGCGGAGCCCGGCGCTACGCTAAAATGAAGAGACGGCGGAGGCGCG
TAGCACGTCGCCACCGCCGCCGACCCGGCACTGCCGCCCAACGCGCGGCGGCAG
CCCTGCTTAACCGCGCACGTCGCACCGGCCGACGGGCGGCCATGCGAGCCGCTC
GAAGGCTGGCCGCGGGTATTGTTACTGTGCCCCCCAGGTCCAGGCGACGAGCGG
CCGCCGCAGCAGCCGCGGCCATTAGTGCTATGACTCAGGGTCGCAGGGGCAACG
TGTACTGGGTGCGCGACTCGGTTAGCGGCCTGCGCGTGCCCGTGCGCACCCGCC
CCCCGCGCAACTAGATTGCAATAAAAAACTACTTAGACTCGTACTGTTGTATGTA
TCCAGCGGCGGCGGCGCGCATCGAAGCTATGTCCAAGCGCAAAATCAAAGAAG
AGATGCTCCAGGTCATCGCGCCGGAGATCTATGGCCCCCCGAAGAAGGAAGAGC
AGGATTACAAGCCCCGAAAGCTAAAGCGGGTCAAAAAGAAAAAGAAAGATGAT
GATGATGAACTTGACGACGAGGTGGAACTGTTGCACGCGACCGCGCCCAGGCGG
CGGGTACAGTGGAAAGGTCGACGCGTAAGACGTGTTTTGCGACCCGGCACCACC
GTAGTCTTTACGCCCGGTGAGCGCTCCACCCGCACCTACAAGCGCGTGTATGATG
AGGTGTACGGCGACGAGGACCTGCTTGAGCAGGCCAACGAGCGCCTCGGGGAG
TTTGCCTACGGAAAGCGGCATAAGGACATGCTGGCGTTGCCGCTGGACGAGGGC
AACCCAACACCTAGCCTAAAGCCCGTGACACTGCAGCAGGTGCTGCCCGCGCTT
GCACCGTCCGAAGAAAAGCGCGGCCTAAAGCGCGAGTCTGGTGACTTGGCACCC
ACCGTGCAGCTGATGGTACCCAAGCGTCAGCGACTGGAAGATGTCTTGGAAAAA
ATGACCGTGGAGCCTGGGCTGGAGCCCGAGGTCCGCGTGCGGCCAATCAAGCAG
GTGGCACCGGGACTGGGCGTGCAGACCGTGGACGTTCAGATACCCACCACCAGT
AGCACTAGTATTGCCACTGCCACAGAGGGCATGGAGACACAAACGTCCCCGGTT
GCCTCGGCGGTGGCAGATGCCGCGGTGCAGGCGGCCGCTGCGGCCGCGTCCAAA
ACCTCTACGGAGGTGCAAACGGACCCGTGGATGTTTCGCGTTTCAGCCCCCCGG
CGTCCGCGCCGTTCGAGGAAGTACGGCGCCGCCAGCGCGCTACTGCCCGAATAT
GCCCTACATCCTTCCATCGCGCCTACCCCGGCTATCGTGGCTACACCTACCGCC
CCAGAAGACGAGCAACTACCCGACGCCGAACCACCACTGGAACCCGCCGCCGCC
GTCGCCGTCGCCAGCCCGTGCTGGCCCCGATTTCCGTGCGCAGGGTGGCTCGCG
AAGGAGGCAGGACCCTGGTGCTGCCAACAGCGCGCTACCACCCCAGCATCGTTT
AAAAGCCGGTCTTTGTGGTTCTTGCAGATATGGCCCTCACCTGCCGCCTCCGTTT
CCCGGTGCCGGGATTCCGAGGAAGAATGCACCGTAGGAGGGGCATGCCGGCC
ACGGCCTGACGGGCGGCATGCGTCGTGCGCACCACCGGCGGCGGCGCGCGTCGC
ACCGTCGCATGCGCGGCGGTATCCTGCCCCTCCTTATTCCACTGATTGCCGCGGC
GATTGGCGCCGTGCCCGGAATTGCATCCGTGGCCTTGCAGGCGCAGAGACACTG
ATTAAAAACAAGTTGCATGTGGAAAATCAAATAAAAAGTCTGGACTCTCACGC
TCGCTTGGTCCTGTAACTATTTTGTAGAATGGAAGACATCAACTTTGCGTCACTG

TABLE 7-continued

Nucleic Acid Sequences of Vectors

SEQ ID NO Sequence

```
GCCCCGCGACACGGCTCGCGCCCGTTCATGGGAAACTGGCAAGATATCGGCACC
AGCAATATGAGCGGTGGCGCCTTCAGCTGGGGCTCGCTGTGGAGCGGCATTAAA
AATTTCGGTTCCACCGTTAAGAACTATGGCAGTAAGGCCTGGAACAGCAGCACA
GGCCAGATGCTGAGGGACAAGTTGAAAGAGCAAAACTTTCAGCAAAAGGTGGT
AGATGGTCTGGCCTCTGGCATTAGCGGGGTGGTGGACCTGGCCAACCAGGCAGT
GCAAAATAAGATTAACAGTAAGCTTGATCCCCGCCCTCCCGTAGAGGAGCCTCC
ACCGGCCGTGGAGACAGTGTCTCCAGAGGGGCGCGGCGAAAAGCGTCCGCGCC
CCGACAGGGAAGAAACTCTGGTGACGCAAATAGACGAGCCTCCCTCGTACGAGG
AGGCACTAAAGCAAGGCCTGCCCACCACCCGTCCCATCGCGCCCATGGCTACCG
GAGTGCTGGGCCAGCACACGCCCGTAACGCTGGACCTGCCTCCCCCCGCCGACA
CCCAGCAGAAACCTGTGCTGCCAGGCCCGTCCGCCGTTGTTGTAACCCGTCCTAG
CCGCGCGTCCCTGCGCCGTGCCGCCAGCGGTCCGCGATCGTTGCGGCCCGTAGC
CAGTGGCAACTGGCAAAGCACACTGAACAGCATCGTGGGTCTGGGGGTACAATC
CCTGAAGCGCCGACGATGCTTCTAATAGCTAACGTGTCGTATGTGTGTCATGTAT
GCGTCCATGTCGCCGCCAGAGGAGCTGCTGAGCCGCCGCGCGCCCGCTTTCAA
GATGGCTACCCCTTCGATGATGCCGCAGTGGTCTTACATGCACATCTCGGGCCAG
GACGCCTCGGAGTACCTGAGCCCCGGGCTGGTGCAGTTTGCCCGCGCACCGAG
ACGTACTTCAGCCTGAATAACAAGTTTAGAAACCCCACGGTGGCGCCTACGCAC
GACGTGACCACAGACCGGTCCCAGCGTTTGACGCTGCGGTTTATCCCTGTGGACC
GCGAGGATACTGCGTACTCGTACAAGGCGCGGTTTACCCTAGCTGTGGGTGATA
ACCGTGTGCTGGACATGGCTTCCACGTACTTTGACATTCGCGGCGTGCTGGACCG
GGGCCCCACTTTTAAGCCCTACTCCGGCACTGCCTACAACGCCCTAGCTCCCAAG
GGTGCCCCCAACTCATGCGAGTGGGATGAAGATGATACTCAGGTACAGGTAGCG
GCTGAAGACGATCAAGACGACGACGAAGAAGAGGAACAACTACCTCAGCAGAG
AAATGGCAAAAAAACTCACGTATATGCTCAGGCACCGTTTGCTGGCGAAGCAAT
TAACAAAAACGGCCTGCAGATAGGAACTAACGGTGCAGCCACTGAAGGAAATA
AGGAAATTTACGCAGATAAAACTTATCAACCTGAACCACAAATAGGAGAATCAC
AGTGGAACGAAGCCGAATCGTCCGTAGCAGGTGGAAGGGTTCTTAAAAAGACTA
CTCCCATGAAACCATGCTATGGCTCCTATGCCAGACCTACCAATTCTAACGGAGG
TCAGGGCGTTATGGTTGAACAAAATGGTAAATTGGAAAGTCAAGTAGAAATGCA
ATTTTTTTCAACTTCTGTAAATGCTATGAACGAGGCAAACGCTATTCAACCTAAA
CTAGTGTTGTATAGTGAAGATGTAAATATGGAAACCCCAGACACTCATCTTTCTT
ATAAGCCTGGAAAAAGTGATGATAATTCTAAGGCAATGTTGGGTCAACAATCTA
TGCCAAACAGACCCAATTACATAGCTTTCAGGGACAATTTTATTGGCCTAATGTA
TTACAACAGCACTGGTAACATGGGTGTTCTTGCTGGTCAGGCATCACAGCTAAAT
GCTGTCGTAGATTTGCAAGACAGAAACACAGAGCTGTCCTACCAACTTTTGCTTG
ATTCTATTGGTGATCGAACCAGATACTTTTCCATGTGGAATCAGGCTGTAGACAG
CTACGATCCAGATGTTAGAATTATCGAGAACCATGGAACTGAGGATGAATTGCC
AAATTATTGTTTTCCTCTTGGCGGAATTGGGGTGACGGACACCTATCAAGCTATT
AAGGCTACAAATGGAAATGGAGGCGCCACTACCTGGGCTCAGGACAATACTTTT
GCAGAACGAAATGAAATAGGGGTGGGAAATAACTTTGCCATGGAAATTAACCTG
AATGCCAACCTATGCGAGAAATTTCCTTTACTCCAATATTGCGCTGTACCTGCCAG
ACAAGCTAAAATACAACCCCACCAATGTGGAAATATCTGACAATCCCAACACCT
ACGACTACATGAACAAGCGAGTGGTGCTCCCGGGCTGGTGGATTGCTACATTA
ACCTTGGGGCGCGCTGGTCTCTGGACTACATGGACAACGTTAATCCCTTTAACCA
CCACCGCAATGCGGGCCTGCGTTACCGCTCCATGTTGTTGGGAAACGGCCGCTA
CGTGCCCTTTCACATTCAGGTGCCCCAAAAGTTTTTTGCCATTAAAAACCTCCTC
CTCCTGCCAGGCTCATACACATATGAATGAACTTCAGGAAGGATGTTAACATG
GTTCTGCAGAGCTCTCTGGGAAACGATCTTAGGGTTGACGGGGCTAGCATTAAG
TTTGACAGCATTTGTCTTTACGCCACCTTCTTCCCCATGGCCCACAACACGGCCT
CCACGCTGGAAGCCATGCTTAGAAATGACACCAACGACCAGTCCTTTAATGACT
ATCTTTCCGCCGCCAACATGCTATACCCCATACCCGCCAACGCCACCAACGTGCC
CATCTCTATCCCCTCGCGCAACTGGGCGGCTTTCCGAGGCTGGGCGTTTACGCGC
CTTAAGACTAAGGAAACCCCATCCCTGGGTTCCGGCTACGACCCTTACTATACCT
ACTCTGGCTCCATACCCTACCTAGACGGAACCTTTTACCTTAATCACACCTTCAA
AAAGGTGGCCATCACCTTTGACTCTTCTGTTAGCTGGCCTGGCAATGACCGTCTG
CTTACCCCCAACGAGTTTGAAATCAAGCGTTCAGTCGACGGAGAGGGCTACAAC
GTTGCTCAATGCAACATGACCAAAGACTGGTTCTTGGTACAGATGCTGGCCAAC
TACAACATAGGCTACCAGGGCTTTTATATCCCAGAAAGCTACAAGGACCGCATG
TACTCCTTCTTTAGAAACTTCCAGCCCATGAGCCGTCAGGTGGTGGACGATACCA
AATACAAGGACTACCAACAGGTGGGCATCCTTCACCAGCACAATAACTCTGGCT
TTGTTGGTTACCTCGCTCCCACCATGCGAGAGGGACAGGCTTACCCCGCCAACTT
CCCCTACCCGCTTATAGGCAAGACCGGGTTGACAGTATTACCCAGAAAAGTT
TCTTTGCGACCGCACCCTTTGGCGCATTCCATTCTCCAGTAACTTTATGTCCATGG
GCGCACTCACAGACCTGGGCCAAAACCTTCTCTATGCAAACTCCGCCCACGCGC
TAGACATGACTTTTGAGGTGGATCCCATGGACGAGCCCACCCTTCTTTATGTTTT
GTTTGAAGTCTTTGACGTGGTCCGTGTGCACCAGCCGCACCGCGGCGTCATCGAG
ACCGTGTACCTGCGCACGCCCTTCTCGGCCGGCAACGCCACAACATAAAGAAGC
AAGCAACATCAACAACAACTGCCGCCATGGGCTCCAGTGAGCAGGAACTGAAA
GCCATTGTCAAAGATCTTGGTTGTGGACCATATTTTTTGGGCACCTATGACAAGC
GCTTCCCAGGCTTTGTTTCCCCACACAAGCTCGCCTGTGCCATAGTTAACACGGC
CGGTCGCGAGACTGGGGGCGTACACTGGATGGCCTTTGCCTGGGACCCGCGCTC
AAAAACATGCTACCTTTTTGAGCCCTTTGGCTTTTCTGACCAGCGTCTCAAGCAG
GTTTACCAGTTTGAGTACGAGTCACTTCTGCGCCGTAGCGCCATTGCCTCTTCCC
CCGACCGCTGTATAACGCTGGAAAAGTCCACTCAAAGCGTGCAGGGGCCCAACT
CGGCCGCCTGTGGCCTGTTCTGCTGCATGTTTCTCCACGCCTTCGCCAACTGGCC
```

TABLE 7-continued

Nucleic Acid Sequences of Vectors

SEQ ID NO Sequence

```
CCAAACTCCCATGGATCACAACCCCACCATGAACCTTATTACCGGAGTACCCAA
CTCCATGCTTAACAGTCCCCAGGTACAGCCCACCCTGCGCCGCAACCAGGAACA
GCTCTACAGCTTCCTGGAGCGCCACTCGCCCTACTTCCGCAGACACAGTGCGCAA
ATTAGGAGTGCCACTTCTTTTTGTCACTTGAAAAACATGTAAAAATAATGTACTA
GGAGACACTTTCAATAAAGGCAAATGCTTTTATTTGTACACTCTCGGGTGATTAT
TTACCCCCCACCCTTGTCGTCTGCGCCGTCTAAAAATCAAAGGGGTTCTGCCGCG
CATCGCTATGCGCCACTGGCAGTGACACGTTGCGATACTGGTGTTTAGTGCTCCA
CTTAAACTCAGGCACAACCATTCGCGGCAGCTCGGTAAAGTTTTCACTCCACAG
GCTGCGCACCATCACCAACGCGTTTAGCAGGTCGGGCGCCGATATCTTGAAGTC
GCAGTTGGGGCCTCCGCCCTGCGCGCGCGAGTTGCGATACACAGGGTTGCAGCA
CTGGAACACTATCAGCGCCGGGTTGTGCACGCTGGCCAGCACGCTCTTGTCGGA
GATCAGATCCGCGTCTAGGTCCTCCGCGTTGCTCAGGGCGAACGGAGTCAACTTT
GGTAGCTGCCTTCCCAAAAAGGGCGCGTGCCCAGGCTTTGAGTTGCACTCGCAC
CGTAGTGGCATCAGAAGGTGACCGTGCCCGGTTTGGGCGTTAGGATACAGCGCC
TGCATAAAAGCCTTGATCTGCTTAAAAGCCACCTGAGCCTTTGCGCCTTCAGAGA
AGAACATGCCGCAAGACTTGCCGGAAAACTGATTGGCCGGACAGGCCGCGTCGT
GCACGCAGCACCTTGCGTCGGTGTTGGAGATCTGCACCACATTTCGGCCCCACCG
GTTCTTCACGATCTTGGCTTTGCTAGACTGCTCCTTCAGCGCGCGCTGCCCATTTT
CGCTCGTCACATCCATTTCAATCACGTGCTCCTTATTTATCATAATGCTCCCGTGT
AGACACTTAAGCTCGCCTTCGATCTCAGCGCAGCGGTGCAGCCACAACGCGCAG
CCCGTGGGCTCGTGGTGCTTGTAGGTCACCTCTGCAAACGACTGCAGGTACGCCT
GCAAGAATCGCCCCATCATCGTCACAAAGGTCTTGTTGCTGGTGAATGTCAGCTG
CAACCCGCGGTGCTCCTCGTTTAGCCAGGTCTTGCATACGGCCGCGAGAGCTTCC
ACTTGGTCAGGCAGTAGCTTGAAGTTCGCCTTTAGATCGTTATCCACGTGGTACT
TGTCCATTAGCGCGCGCAGCCTCCATGCCCTTCTCCCACGCAGACACGATCGG
CAGACTCAACGGGTTCATTACCGTGCTTTCACTTTCTGCTTCACTGGGCTCTTCCT
CTTCCTCTTGAGTCCGCATACCCCGCGCCACTGGGTCGTCTTCATTCAGCCGCCG
CACCGTGCGCTTACCTCCCTTGCCGTGCTTGATTAGCACCGGTGGGTTGCTGAAA
CCCACCATTTGTAGCGCCACATCTTCTCTTTCTTCCTCGCTGTCCACAATCACCTC
TGGGGATGGCGGGCGCTCGGACTTGGGAGAGGGGCGCTTCTTTTCTTCTTGGGC
GCGTTGGCCAAATCCGCCGCCGAGGTTGATGGCCGCGGGCTGGGTGTGCGCGGC
ACCAGCGCGTCCTGTGACGAGTCTTCTTCGTCCTCGGACTCGAGACGCCGCCTCA
GCCGCTTTTTTGGGGCGCGCGGGGAGGCGGCGGCGACGGCGACGGGGACGAC
ACGTCCTCCATGGTTGGGGGACGTCGCGCCGCCACCGCGTCCGCGCTCGGGGGTG
GTTTCGCGCTGCTCCTCTTCCCGACTGGCCATTTCCTTCTCCTATAGGCAGAAAA
AGATCATGGAGTCAGTCGAGAAGGAGGACAGCCTAACCGCCCCCTCTGAGTTCG
CCACCACCGCCTCCACCGATGCCGCCAACGCGCCTACCACCTTCCCCGTCGAGGC
ACCCCCGCTTGAGGAGGAGGAAGTGATTATCGAGCAGGACCAAGCAGCTGACCTTGCG
CGAAGACGACGAGGACCGCTCAGTACCAACGAGGATAAAAAGCAAGACCAGG
ACGACGCAGAGGCAAACGAGGAACAAGTCGGGCGGGGGGACCAAAGGCATGGC
GACTACCTAGATGTGGGAGACGACGTGCTGTTGAAGCATCTGCAGCGCCAGTGC
GCCATTATCTGCGACGCGTTGCAAGAGCGCAGCGATGTGCCCCTCGCCATAGCG
GATGTCAGCCTTGCCTACGAACGCCACCTGTTCTCACCGCGCGTACCCCCCAAAC
GCCAAGAAAACGGCACATGCGAGCCCAACCCGCGCCTCAACTTCTACCCCGTAT
TTGCCGTGCCAGAGGTGCTTGCCACCTATCACATCTTTTTCCAAAACTGCAAGAT
ACCCCTATCCTGCCGTGCCAACCGCAGCCGAGCGGACAAGCAGCTGACCTTGCG
ACAGGGCGCTGTCATACCTGATATCGCCTCGCTCGACGAAGTGCCAAAAATCTTT
GAGGGTCTTGGACGCGACGAGAAGCGCGCGGCAAACGCTCTGCAACAGGAAAA
CAACGAAAATGAAAGTTACTCTGGAGTGCTGGTGGAACTTGAGGGTGACAACGC
GCGCCTAGCCGTGCTTAAACGCAGCATCGAGGTCACCCACTTTGCCTACCCGGC
ACTTAACCTGCCCCCCAAGGTTATGAGCACAGTCATGAGCGAGCTGATCGTGCG
CCGTGCACGGCCCCTAGAGAGGGATGCAAACTTGCAAGAACAAACAGAGGAGG
GCCTGCCCGCAGTTGGCGACGAGCAGCTAGCGCGCTGGCTTCAGACGCGCGAGC
CTGCCGACTTGGAGGAGCGACGTAAGCTAATGATGGCCGCAGTGCTCGTTACCG
TGGAGCTTGAGTGCATGCAGCGGTTCTTTGCTAACCCGGAGATGCAGCGCAAGC
TAGAGGAAACGTTGCACTACACCTTTCGCAGGGCTACGTGCGCCAGGCCTGCA
AGATCTCCAACGTGGAGCTCTGCAACCTGGTCTCCTACCTTGGAATTTTGCACGA
AAACCGCCTTGGGCAAAACGTGCTTCATTCCACGCTCAAGGGCGAGGCGCGCCG
CGACTACGTCCGCGACTGCGTTTACTTGTTTCTATGCTACACCTGGCAGACGGCC
ATGGGCGTGTGGCAGCAGTGCCTGGAGGAGCGCAACCTCAAGGAGCTGCAGAA
GCTGCTAAAGCAAACTTGAAGGACCTATGGACGGCCTTCAATGAGCGCTCCGT
GGCCGCGCACCTGGCGGACATCATCTTCCCCGAACGCCTGCTTAAAACCCTGCA
ACAGGGTCTGCCAGACTTTACCAGTCAAAGCATGTTGCAAAACTTTAGGAACTTT
ATCCTAGAGCGCTCAGGAATTCTGCCCGCCACCTGCTGTGCGCTTCCTAGCGACT
TTGTGCCCATTAAGTACCGCGAATGCCCTCCGCCGCTTTGGGTCACTGCTACCT
TCTGCAGCTAGCAAACTACCTTGCCTACCACTCCGACATCATGGAAGACGTGAG
CGGTGACGGCCTACTGAGTGCACTGTCGCTGCAACCTATGTACCCCGCACCGC
TCCCTGGTCTGCAATTCGCAGCTGCTTAGCGAGAGTCAAATTATCGGTACCTTTG
AGCTGCAGGGTCCCTCGCCTGACGAAAAGTCCGCGGCTCCGGGGTTGAAACTCA
CTCCGGGGCTGTGGACGTCGGCTTACCTTCGCAAATTTGTACCTGAGGACTACCA
CGCCCACGAGATTAGGTTCTACGAAGACCAATCCCGCCCGCCAATGCGGAGCT
TACCGCCTGCGTCATTACCCAGGGCCACATCCTTGGCCAATTGCAAGCCATCAAC
AAAGCCCGCCAAGAGTTTCTGCTACGAAAGGGACGGGGGGTTTACTTGGACCCC
CAGTCCGGCGAGGAGCTCAACCCAATCCCCCCGCCGCCGCAGCCCTATCAGCAG
CAGCCGCGGGCCCTTGCTTCCCAGGATGGCACCCAAAAAGAGCTGCAGCTGCC
GCCGCCGCCACCCACGGACGAGGAGGAATACTGGGACAGTCAGGCAGAGGAGG
```

TABLE 7-continued

Nucleic Acid Sequences of Vectors

SEQ ID NO Sequence

TTTTGGACGAGGAGGAGGAGACGATGGAAGACTGGGACAGCCTAGACGAGGAA
GCTTCCGAGGCCGAAGAGGTGTCAGACGAAACACCGTCACCCTCGGTCGCATTC
CCCTCGCCGGCGCCCCAGAAATCGGCAACCGTTCCCAGCATTGCTACAACCTCC
GCTCCTCAGGCGCCGCCGGCACTGCCCGTTCGCCGACCCAATCGTAGATGGGAC
ACCACTGGAACCAGGGCCGGTAAGTCCAAGCAGCCGCCGCCGTTAGCCCAAGAG
CAACAACAGCGCCAAGGCTACCGCTCGTGGCGCGGGCACAAGAACGCCATAGTT
GCTTGCTTGCAAGAGTGTGGGGGCAACATCTCCTTCGCCCGCCGCTTTCTTCTCT
ACCATCACGGCGTGGCCTTCCCCCGTAACATCCTGCATTACTACCGTCATCTCTA
CAGCCCCTACTGCACCGGCGGCAGCGGCAGCAACAGCAGCGGCCACGCAGAAG
CAAAGGCGACCGGATAGCAAGACTCTGACAAAGCCCAAGAAATCCACAGCGGC
GGCAGCAGCAGGAGGAGGAGCACTGCGTCTGGCACCCAACGAACCCGTATCGA
CCCGCGAGCTTAGAAACAGGATTTTTCCCACTCTGTATGCTATATTTCAACAGAG
CAGGGGCCAAGAACAAGAGCTGAAAATAAAAAACAGGTCTCTGCGCTCCCTCAC
CCGCAGCTGCCTGTATCACAAAAGCGAAGATCAGCTTCGGCGCACGCTGGAAGA
CGCGGAGGCTCTCTTCAGCAAATACTGCGCGCTGACTCTTAAGGACTAGTTTCGC
GCCCTTTCTCAGATTTAAGCGCGAAAACTACGTCATCTACAACGGCCACACCCG
GCGCCAGCACCTGTCGTCAGCGCCATTATGAGCAAGGAAATTCCCACGCCCTAC
ATGTGGAGTTACCAGCCACAAATGGGACTTGCGGCTGGAGCTGCCCAAGACTAC
TCAACCCGAATAAACTACATGAGCGCGGGACCCCACATGATATCCCGGGTCAAC
GGTATACGCGCCCACCGAAACCGAATTCTCCTGGAACAGGCGGCCATTACAACC
ACACCTCGTAATAACCTTAATCCCCGTAGTTGGCCCGCTGCCCTGGTTTACCAGG
AAAGTCCCGCTCCCACCACTGTGGTACTTCCCAGAGACGCCCAGGCCGAAGTCC
AAATGACTAACTCAGGGGCGCAGCTTGCGGGCGGCTTTCGTCATAGGGTGCGGT
CGCCAGGGCAGGGTATAACTCACCTGAAAATCAGAGGGCGAGGTATTCAGCTCA
ACGACGAGTCGGTGAGCTCCTCGCTTGGTCTCCGTCCGGACGGAACATTTCGAT
CGGCGGCGCCGGCCGCTCTTCATTCACGCCTCGTCAGGCGATCCTAACTTTGCAG
ACCTCGTCCTCGGAGCCGCGCTCCGGAGGCATTGGAACTCTACAATTTATTGAGG
AGTTCGTGCCTTCGGTTTACTTCAACCCCTTTTCTGGACCTCCTGGCCACTACCCG
GACCAGTTTATTCCCAACTTTGACGCGGTGAAGGACTCGGCGGACGGCTACGAC
TGAATGACTAGTGGAGAGGCAGAGCAACTGCGTCTAACACACCTCGACCACTGC
CGCCGCCACAAGTGCTTTGCCCGCGACTCCGGTGAGTTTTCCTATTTTGAGTTGC
CCGAAGAGCATATCGAGGGCCCGGCGCACGGCGTCCGGCTCACCACCCAGGTAG
AGCTTACACGTAGCTTGATTCGGGAGTTTACCAAGCGCCCCCTGCTAGTGGAGC
GGGAGCGGGGTCCCTGTGTTCTAACCGTGGTTTGCAACTGTCCTAACCCTGGATT
ACATCAAGATCTTTGTTGTCATCTCTGTGCTGAGTATAATAAATACAGAAATTAG
AATCTACTGGGGCTTCTGTCGCCATCCTGTGAACGCCACCGTTTTTACCCACCCA
AAGCAGACCAAAGCAAACCTCACCTCCGGTTTGCACAAGCGGGCCAATAAGTAC
CTTACCTGGTACTTTAACGGCTCTTCATTTGTAATTTACAACAGTTTCCAGCGAG
ACAAAGTAAGTTTGCCACACAACCTTTTCGGCTTCAACTATACCATCAAGAAAA
ACACCACCACCCTCCTTACCTGCCGGGAACGTACGAGTGCGTCACCGGTTGCTGC
GCCCACACCTACAGCCTGACCGTAACCAGACATTACTCCCATTTTCCCAAAACAG
GAGGTGAGCTCAACTTCCGAAAATCAGGGCAAAAAGCATTTTGCTGATTGTAGT
CGGGGTGCTGAGATTTTTTAATTAAGTATATGAGCAATTCAAGTAACTCTACAAG
CTTGTCTAATTTTTCTGGAATTGGGGTCGGGGTTATCCTTACTCTTGTAATTCTGT
TTATTCTTATACTAGCACTTCTGTGCCTTAGGGTTGCCGCTTGCTGCACGCACGTT
TGTATCTATTGTCAGCTTTTTAAACGCTGGGGGCGACATCCAAGATGAGATACAT
AATTTTTATGCATGCTCGCCCTTGCGGCAGTCTGCAGTGCTGCCAAAAAGGTTGAG
TTTAAGGAACCAGCTTGCAATGTTACATTTAAATCCGAAGCTAATGAATGCACC
ACTCTTATAAAATGCACCACAGAACATGAAAAGCTTATTATTCGCCACAAAGAC
AAAATTGGCAAGTATGCTGTATATGCTATTTGGCAGCCAGGTGATACTAACGAC
TATAATGTCACAGTCTTCCAAGGTGAAAATCATAAAACTTTTATGTATAAATTTC
CATTTTATGAAATGTGCGATATTACCATGTACATGAGCAAACAGTACAAGTTGTG
GCCCCCACAAAAGTGTTTAGAGAACACTGGCACCTTTTGTTCCACCGCTCTGCTT
ATTACAGCGCTTGCTTTAGTATGTACCCTACTTTATCTCAAATACAAAAGCAGAC
GCAGTTTTATTGATGAAAAGAAAATGCCTTGATTTTCCGCTTGCTAAACCCTTGC
CAACAAAAGCCAATGTATAATAATGTAACCACCGCGGTGTTACTGCTTGTATTCC
CCTGGACAATTTACTCTATGTGGGATATGCGCCAGGCGGGAAAGATTATACCCA
CAACCTTCAAATCAAACTTTCCTGGACGTTAGCGCCTGACTTCTGCCAGCGCCTG
CACTGCAAATTTGATCAAACCCAGCTTCAGAGAGATGACCGGCTCAACCATCGC
GCCCACAACGGACTATCGCAACACCACTGCTACCGGACTAAAATCTGCCCTAAA
TTTACCCCAAGTTCATGCCTTTGTCAATGACTGGGCGAGCTTGGGCATGTGGTGG
TTTTCCATAGCGCTTATGTTTGTTTGCCTTATTATTATGTGGCTTATTTGTTGCCTA
AAGCGCAGACGCGCCAGACCCCCCATCTATAGGCCTATCATTGTGCTCAACCCA
CACAATGAAAAAATTCATAGATTGGACGGTCTGAAACCATGTTCTCTTCTTTTAC
AGTATGATTAAATGAGACATGATTCCTCGAGTCCTTATATTATTGACCCTTGTTG
CGCTTTTCTGTGCGTGCTCTACATTGGCCGCGGTCGCTCACATCGAAGTAGATTG
CATCCCACCTTTCACAGTTTACCTGCTTTACGGATTTGTCACCCTTATCCTCATCT
GCAGCCTCGTCACTGTAGTCATCGCCTTCATTCAGTTCATTGACTGGATTTGTGT
GCGCATTGCGTACCTTAGGCACCATCCGCAATACAGAGACAGGACTATAGCTGA
TCTTCTCAGAATTCTTTAATTATGAAACGGATTGTCACTTTTGTTTTGCTGATTTT
CTGCGCCCTACCTGTGCTTTGCTCCCAAACCTCAGCGCCTCCCAAAAGACATATT
TCCTGCAGATTCACTCAAATATGGAACATTCCCAGCTGCTACAACAAACAGAGC
GATTTGTCAGAAGCCTGGTTATACGCCATCATCTCTGTCATGGTTTTTTGCAGTA
CCATTTTTGCCCTAGCCATATACCCATACCTTGACATTGGTTGGAATGCCATAGA
TGCCATGAACCACCCTACTTTCCCAGCGCCCAATGTCATACCACTGCAACAGGTT
ATTGCCCCAATCAATCAGCCTCGCCCCCCTTCTCCCACCCCCACTGAGATTAGCT

TABLE 7-continued

Nucleic Acid Sequences of Vectors

| SEQ ID NO | Sequence |
|---|---|
|  | ACTTTAATTTGACAGGTGGAGATGACTGAATCTCTAGATCTAGAATTGGATGGA
ATTAACACCGAACAGCGCCTACTAGAAAGGCGCAAGGCGGCGTCCGAGCGAGA
ACGCCTAAAACAAGAAGTTGAAGACATGGTTAACCTGCACCAGTGTAAAAGAG
GTATCTTTTGTGTGGTCAAGCAGGCCAAACTTACCTACGAAAAAACCACTACCG
GCAACCGCCTTAGCTACAAGCTACCCACCCAGCGCCAAAAACTGGTGCTTATGG
TGGGAGAAAAACCTATCACCGTCACCCAGCACTCGGCAGAAACAGAAGGCTGCC
TGCACTTCCCCTATCAGGGTCCAGAGGACCTCTGCACTCTTATTAAAACCATGTG
TGGCATTAGAGATCTTATTCCATTCAACTAACAATAAACACACAATAAATTACTT
ACTTAAAATCAGTCAGCAAATCTTTGTCCAGCTTATTCAGCATCACCTCCTTTCC
CTCCTCCCAACTCTGGTATTTCAGCAGCCTTTTAGCTGCGAACTTTCTCCAAAGTC
TAAATGGGATGTCAAATTCCTCATGTTCTTGTCCCTCCGCACCCACTATCTTCATA
TTGTTGCAGATGAAACGCGCCAGACCGTCTGAAGACACCTTCAACCCTGTGTAC
CCATATGACACGGAAACCGGCCCTCCAACTGTGCCTTTCCTTACCCCTCCCTTTG
TGTCGCCAAATGGGTTCCAAGAAAGTCCCCCCGGAGTGCTTTCTTTGCGTCTTTC
AGAACCTTTGGTTACCTCACACGGCATGCTTGCGCTAAAAATGGGCAGCGGCCT
GTCCCTGGATCAGGCAGGCAACCTTACATCAAATACAATCACTGTTTCTCAACCG
CTAAAAAAAACAAAGTCCAATATAACTTTGGAAACATCCGCGCCCCTTACAGTC
AGCTCAGGCGCCCTAACCATGGCCACAACTTCGCCTTTGGTGATCTCTGACAACA
CTCTTACCATGCAATCACAAGCACCGCTAACCGTGCAAGACTCAAAACTTAGCA
TTGCTACCAAAGAGCCACTTACAGTGTTAGATGGAAAACTGGCCCTGCAGACAT
CAGCCCCCCTCTCTGCCACTGGTAACAACGCCCTCACTATCACTACCTCACCTCC
TCTTACTACTGCAAATGGTAGTCTGGCTGTTACCATGGAAAACCCACTTTACAAC
AACAATGGAAAACTTGGGCTCAAAATTGGCGGTCCTTTGCAAGTGGCCACCGAC
TCACATGCACTAACACTAGGTACTGGTCAGGGGGTTGCAGTTCATAACAATTTGC
TACATACAAAAGTTACAGGCGCAATAGGGTTTGATACATCTGGCAACATGGAAC
TTAAAACTGGAGATGGCCTCTATGTGGATAGCGCCGGTCCTAACCAAAAACTAC
ATATTAATCTAAATACCACAAAAGGCCTTGCTTTTGACAACACCGCAATAACAA
TTAACGCTGGAAAAGGGTTGGAATTTGAAACAGACTCCTCAAACGGAAATCCCA
TAAAAACAAAAATTGGATCAGGCATACAATATGATACCAATGGAGCTATGGTTG
CAAAACTTGGAACAGGCCTCAGTTTTGACAGCTCCGGAGCCATAACAATGGGCA
GCATAAACAATGACAGACTTACTCTTTGGACAACACCAGACCCATCCCCAAATT
GCAGAATTGCTTCAGATAAAGACTGCAAGCTAACTCTGGCGCTAACAAAATGTG
GCAGTCAAATTTTGGGCACTGTTTCAGCTTTGGCAGTATCAGGTAATATGGCCTC
CATCAATGGAACTCTAAGCAGTGTAAACTTGGTTCTTAGATTTGATGACAACGG
AGTGCTTATGTCAAATTCATCACTGGACAAACAGTATTGGAACTTTAGAAACGG
GGACTCCACTAACGGTCAACCATACACTTATGCTGTTGGGTTTATGCCAAACCTA
AAAGCTTACCCAAAAACTCAAAGTAAAACTGCAAAAAGTAATATTGTTAGCCAG
GTGTATCTTAATGGTGACAAGTCTAAACCATTGCATTTTACTATTACGCTAAATG
GAACAGATGAAACCAACCAAGTAAGCAAATACTCAATATCATTCAGTTGGTCAT
GGAACAGTGGACAATACACTAATGACAAATTTGCCACCAATTCCTATACCTTCTC
CTACATTTCCCAGGAATAAAGAATCGTGAACCTGTTGCATGTTATGTTTCAACGT
GTTTATTTTTCAATTGCAGAAAATTTCAAGTCATTTTTCATTCAGTAGTATAGCCC
CACCACCACATAGCTTAT |
| SEQ ID NO: 1448 | CATCATCAATAATATACCCCACAAAGTAAACAAAAGTTAATATGCAAATGAGTT
TTTGAATTTTAACGGTTTCGGGGCGGAGCCAACGCTGATTGGACGAGAGAAGAC
GATGCAAATGACGTCACGACGCACGGCGTTAACGGTCGCCGCGGAGGCGTGGCC
TAGCCCGGAAGCAAGTCGCGGGGCTGATGACGTATAAAAAAGCGGACTTTAGAC
CCGGAAACGGCCGATTTTCCCGCGGCCACGCCCGGATATGAGGTAATTCTGGGC
GGATGCAAGTGAAATTAGGTCATTTTGGCGCGAAAACTGAATGAGGAAGTGAAA
AGCGAAAATACCGGTCCCTCCCAGGGCGGAATATTTACCGAGGGCCGAGAGAC
TTTGACCGATTACGTGGGGGTTTCGATTGCGGTGTTTTTTCGCGAATTTCCGCGTC
CGTGTCAAAGTCCGGTGTTTATGTCACAGATCAGCTGATCCGCAGGGTATTTAAA
CCAGTCGAGTCCGTCAAGAGGCCACTCTTGAGTGCCAGCGAGTAGAGATTTCTC
TGAGCTCCGCTCCCAGAGACCGAGAAAAATGAGACACCTGCGCCTCCTGCCTTC
AACTGTGCCCGGTGAGCTGGCTGTGCTTATGCTGAGGACTTTGTGGATACAGTA
TTGGAGGACGAACTGCATCCAAGTCCGTTCGAGCTGGGACCCACACTTCAGGAT
CTCTATGATCTGGAGGTAGATGCCCATGATGACGACCCTAACGAGGAGGCTGTG
AATTTAATATTTCCAGAATCTATGATTCTTCAGGCTGACATAGCCAACGAATCTA
CTCCACTTCATACACCGACTCTGTCACCCATACCTGAATTGGAAGAGGAGGACG
AACTAGACCTCCGGTGTTATGAGGAAGGTTTTCCTCCCAGCGATTCAGAGGATG
AACGGGGTGAGCAGACCATGGCTCTGATCTCAGACTATGCTTGTGTGACTGTGG
AGGAACAAGTAGTGATTGAAAATTCTACCGAGCCAGTGGAGGGCTGTAGAAAAT
GCCAGTACCACCGGGATAAGTCTGGAGACCCGAACGCATCATGCGCTCTGTGCT
ATATGAAACAGACTTTCAGCTTTATTTACAGTAAGTGGAGTGAATGTGAGAGAG
GCTGAGTGCTTAACACATCACTGTGTATTGCTTAAACAGCTGTGCTAAGTGTGGT
TTATTTTTGTTTCTAGGTCCGGTGTCAGAGGATGAGTCATCACCCTCAGAAGAAG
ACCACCCGTCTCCCCCTGATCTCACAGATGACACGCCCCTGCAAGTGCACAGAC
CCACCCCAGTCAGAGCCAGTGGCGAGAGGCGAGCAGCTGTTGAAAAATTGAG
GACTTGTTACATGACATGGGTGGGATGAACCTTTGGACCTGAGCTTGAAACGC
CCCAGGAACTAGGCGCAGCTGCGCTTAGTCATGTGTAAATAAAGTTGTACAATA
AAAGTATATGTGACGCATGCAAGGTGTGGTTTATGACTCATGGGCGGGGCTTAG
TCCTATATAAGTGGCAACACCTGGGCACTGGGCACAGACCTTCAGGGAGTTCCT
GATGGATGTGTGGACTATCCTTGCAGACTTTAGCAAGACACGCCGGCTTGTAGA
GGATAGTTCAGACGGGTGCTCCGGGTTCTGGAGACACTGGTTTGGAACTCCTCTA
TCTCGCCTGGTGTACACAGTTAAGAAGGATTATAAAGAGGAATTTGAAAATATT |

TABLE 7-continued

Nucleic Acid Sequences of Vectors

SEQ ID NO Sequence

TTTGCTGACTGCTCTGGCCTGCTAGATTCTCTGAATCTTGGCCACCAGTCCCTTTT
CCAGGAAAGGGTACTCCACAGCCTTGATTTTTCCAGCCCAGGGCGCACTACAGC
CGGGGTTGCTTTTGTGGTTTTTCTGGTTGACAAATGGAGCCAGGACACCCAACTG
AGCAGGGGCTACATCCTGGACTTCGCAGCCATGCACCTGTGGAGGGCCTGGATC
AGGCAGCGGGGACAGAGAATCTTGAATTACTGGCTTCTACAGCCAGCAGCTCCG
GGTCTTCTTCGTCTACACAGACAAACATCCATGTTGGAGGAAGAAATGAGGCAG
GCCATGGACGAGAACCCGAGGAGCGGCCTGGACCCTCCGTCGGAAGAGGAGCT
GGATTGAATCAGGTATCCAGCCTGTACCCAGAGCTTAGCAAGGTGCTGACATCC
ATGGCCAGGGGAGTTAAGAGGGAGAGGAGCGATGGGGGTAATACCGGGATGAT
GACCGAGCTGACGGCCAGCCTGATGAATCGGAAGCGCCCAGAGCGCCTTACCTG
GTACGAGCTACAGCAGGAGTGCAGGGATGAGTTGGGCCTGATGCAGGATAAAT
ATGGCCTGGAGCAGATAAAAACCCATTGGTTGAACCCAGATGAGGATTGGGAGG
AGGCTATTAAGAAGTATGCCAAGATAGCCCTGCGCCCAGATTGCAAGTACATAG
TGACCAAGACCGTGAATATCAGACATGCCTGCTACATCTCGGGGAACGGGGCAG
AGGTGGTCATCGATACCCTGGACAAGGCCGCCTTCAGGTGTTGCATGATGGGAA
TGAGAGCAGGAGTGATGAATATGAATTCCATGATCTTCATGAACATGAAGTTCA
ATGGAGAGAAGTTTAATGGGGTGCTGTTCATGGCCAACAGCCACATGACCCTGC
ATGGCTGCAGTTTCTTCGGCTTCAACAATATGTGCGCAGAGGTCTGGGGCGCTTC
CAAGATCAGGGGATGTAAGTTTTATGGCTGCTGGATGGGCGTGGTCGGAAGACC
CAAGAGCGAGATGTCTGTGAAGCAGTGTGTGTTTGAGAAATGCTACCTGGGAGT
CTCTACCGAGGGCAATGCTAGAGTGAGACACTGCTCTTCCCTGGAGACGGGCTG
CTTCTGCCTGGTGAAGGGCACAGCCTCTCTGAAGCATAATATGGTGAAGGGCTG
CACGGATGAGCGCATGTACAACATGCTGACCTGCGATTCGGGGTCTGCCATAT
CCTGAAGAACATCCATGTGACCTCCCACCCCAGAAAGAAGTGGCCAGTGTTTGA
GAATAACCTGCTGATCAAGTGCCATATGCACCTGGGAGCCAGAAGGGGCACCTT
CCAGCCGTACCAGTGCAACTTTAGCCAGACCAAGCTGCTGTTGGAGAACGATGC
CTTCTCCAGGGTGAACCTGAACGGCATCTTTGACATGGATGTCTCGGTGTACAAG
ATCCTGAGATACGATGAGACCAAGTCCAGGGTGCGCGCTTGCGAGTGCGGGGGA
AGACACACCAGGATGCAGCCAGTGGCCCTGGATGTGACCGAGGAGCTGAGACC
AGACCACCTGGTGATGGCCTGTACCGGGACCGAGTTCAGCTCCAGTGGGAGGA
CACAGATTAGAGGTAGGTCGAGTGAGTAGTGGGCGTGGCTAAGGTGACTATAAA
GGCGGGTGTCTTACGAGGGTCTTTTTGCTTTTCTGCAGACATCATGAACGGGACC
GGCGGGGCCTTCGAAGGGGGGCTTTTTAGCCCTTATTTGACAACCCGCCTGCCGG
GATGGGCCGGAGTTCGTCAGAATGTGATGGGATCGACGGTGGATGGGCGCCCAG
TGCTTCCAGCAAATTCCTCGACCATGACCTACGCGACCGTGGGGAGCTCGTCGCT
CGACAGCACCGCCGCAGCCGCGGCAGCCGCAGCTGCCATGACAGCGACGAGAC
TGGCCTCGAGCTACATGCCCAGCAGCGGCAGCAGCCCCTCTGTGCCCAGTTCCAT
CATCGCCGAGGAGAAACTGCTGGCCCTGCTGGCCGAGCTGGAAGCCCTGAGCCG
CCAGCTGGCCGCCCTGACCCAGCAGGTGTCCGAGCTCCGCGAGCAGCAACAGCA
GCAAAATAAATGATTCAATAAACACAGATTCTGATTCAAACAGCAAAGCATCTT
TATTATTTATTTTTTCGCGCGCGGTAGGCCCTGGTCCACCTCTCCCGATCATTGAG
AGTGCGGTGGATTTTTTCCAGGACCCGGTAGAGGTGGGATTGGATGTTGAGGTA
CATGGGCATGAGCCCGTCCCGGGGGTGGAGGTAGCACCACTGCATGGCCTCGTG
CTCTGGGGTCGTGTTGTAGATGATCCAGTCATAGCAGGGGCGCTGGGCGTGGTG
CTGGATGATGTCTTTGAGAAGGAGACTGATGGCCACGGGGAGCCCCTTGGTGTA
GGTATTGGCAAAGCGGTTGAGCTGGGAGGGATGCATGCGGGGGAGATGATGT
GCAGTTTGGCCTGGATCTTGAGGTTGGCGATGTTGCCACCCAGATCCCGCCGGG
GGTTCATGTTGTGCAGGACCACCAGGACGGTGTAGCCCGTGCACTTGGGGAACT
TGTCATGCAACTTGGAAGGGAATGCGTGGAAGAATTTGGAGACGCCCTTGTGCC
CGCCCAGGTTTTCCATGCATTCATCCATGATGATGGCGATGGGCCGTGGGCTGC
GGCTTTGGCAAAGACGTTTCTGGGGTCAGATACATCATAATTATGCTCCTGGGTG
AGATCATAAGACATTTTAATGAATTTGGGCGGAGGGTGCCAGATTGGGG
ACGATGGTTCCCTCGGGCCCCGGGGCGAAGTTCCCCTCACAGATCTGCATCTCCC
AGGCTTTCATCTCGGAGGGGGGATCATGTCCACCTGCGGGGCGATGAAAAAAA
CGGTTTCCGGGGCTGGGGTGATGAGCTGCGAAGAGAGCAGGTTTCTCAACAGCT
GGGACTTGCCGCACCCGGTCGGGCCGTAGATGACCCCGATGACGGGTTGCAGGT
GGTAGTTCAAGGACATGCAGCTGCCGTCGTCCCGGAGGAGGGGGCACCTCGT
TGAGCATGTCTCTGACTTGGAGGTTTTCCCGAACGAGCTCGCCGAGGAGGCGGT
CCCCGCCCAGCGAGAGGAGCTCTTGCAGGGAAGCAAAGTTTTTCAGGGGCTTGA
GTCCGTCGGCCATGGGCATCTTGGCGAGGGTCTGCGAGAGGAGCTCCAGGCGGT
CCCAGAGCTCGGTGACGTGCTCTACGGCATCTCGATCCAGCAGACTTCCTCGTTT
CGGGGGTTGGGACGACTGCGACTGTAGGGCACGAGACGATGGGCGTCCAGCGC
GGCCAGCGTCATGTCCTTCCAGGGTCTCAGGGTCCGAGTGAGGGTGGTCTCCGTC
ACGGTGAAGGGGTGAGCCCCTGGCTGGGCGCTTGCAAGGGTGCGCTTGAGACTC
ATCCTGCTGGTGCTGAAACGGGCACGGTCTTCGCCCTGCGAGTCGGCGAGATAG
CAGTTGACCATGAGCTCGTAGTTGAGGACCTCGGCGGCGTGGCCCTTGGCGCGG
AGCTTGCCCTTGGAAGAGCGCCCGCAGGCGGGACAGAGGAGGGATTGCAGGGC
GTAGAGCTTGGGGCGAGAAAGACGGACTCGGGAGCGAAAGCGTCCGCTCCGC
AGTGGGCGCAGACGGTCTCGCACTCGACGAGCCAGGTGAGCTCTGGCTGCTCGG
GGTCAAAAACCAGTTTTCCCCCGTTCTTTTTGATGCGCTTCTTACCTCGCGTCTCC
ATGAGTCTGTGTCCGCGCTCGGTGACAAACAGGCTGTCGGTGTCCCCGTAGACG
GACTTGATTGGCCTGTCCTGCAGGGGCGTCCCGCGGTCCTCCTCGTAGAGAAACT
CGGACCACTCTGAGACAAAGGCGCGCGTCCACGCCAAGACAAAGGAGGCCACG
TGCGAGGGGTAGCGGTCGTTGTCCACTAGGGGTCCACCTTTTCCACCGTGTGCA
GACACATGTCCCCCTCCTCCGCATCCAAGAAGGTGATTGGCTTGTAGGTGTAGGC
CACGTGACCGGGGGTCCCCGACGGGGGGGTATAAAAGGGGGCGGGTCTGTGCTC

TABLE 7-continued

Nucleic Acid Sequences of Vectors

| SEQ ID NO | Sequence |
|---|---|
| | GTCCTCACTCTCTTCCGCGTCGCTGTCCACGAGCGCCAGCTGTTGGGGTAGGTAT
TCCCTCTCGAGAGCGGGCATGACCTCGGCACTCAGGTTGTCAGTTTCTAGAAACG
AGGAGGATTTGATGTTGGCTTGCCCTGCCGCGATGCTTTTTAGGAGACTTTCATC
CATCTGGTCAGAAAAGACTATTTTTTTATTGTCAAGCTTGGTGGCGAAGGAGCCA
TAGAGGGCATTGGAGAGAAGCTTGGCGATGGATCTCATTGTCTGATTTTTGTCAC
GGTCGGCGCGCTCCTTGGCCGCGATGTTGAGCTGGACATACTCGCGCGCGACGC
ACTTCCATTCCGGGAAGACGGTGGTGCGCTCGTCGGGCACGATCCTGACGCGCC
AGCCGCGGTTATGCAGGGTGACCAGGTCCACGCTGGTGGCCACCTCGCCGCGCA
GGGGCTCGTTGGTCCAGCAGAGTCTGCCGCCCTTGCGCGAGCAGAACGGTGGCA
GCACATCAAGCAGATGCTCGTCAGGGGGGTCCGCATCGATGGTGAAGATGCCCG
GACAGAGTTCCTTGTCAAAATAATCTATTTTTGAGGATGCATCATCCAAGGCCAT
CTGCCACTCGCGGGCGGCCAGCGCTCGCTCGTAGGGGTTAAGGGCGGACCCCA
GGGCATGGGATGCGTGAGGGCGGAGGCGTACATGCCGCAGATGTCATAGACAT
AGATGGGCTCCGAGAGGATGCCGATGTAGGTGGGATAACAGCGCCCCCCGCGG
ATGCTGGCGCGCACGTAGTCATACAACTCATGCGAGGGGGCCAAGAAGGCGGG
GCCGAGATTGGTGCGCTGGGGCTGCTCGGCGCGGAAGACGATCTGGCGAAAGAT
GGCATGCGAGTTGGAGGAGATGGTGGGCCGTTGGAAGATGTTAAAGTGGGCGTG
GGGCAAGCGGACCGAGTCGCGGATGAAGTGCGCGTAGGAGTCTTGCAGCTTGGC
GACGAGCTCGGCGGTGACGAGGACGTCCATGGCGCAGTAGTCCAGCGTTTCGCG
GATGATGTCATAACCCGCTTCTCCTTTCTTCTCCCACAGCTCGCGGTTGAGGGCG
TACTCCTCGTCATCCTTCCAGTACTCCCGGAGCGGGAATCCTCGATCGTCCGCAC
GGTAAGAGCCCAGCATGTAGAAATGGTTCACGGCCTTGTAGGGACAGCAGCCCT
TTTCCACGGGGAGGGCGTAAGCTTGTGCGGCCTTGCGGAGCGAGGTGTGCGTCA
GGGCGAAGGTGTCCCTGACCATGACTTTCAAGAACTGGTACTTGAAGTCCGAGT
CGTCGCAGCCGCCGTGCTCCCAGAGCTCGAAATCGGTGCGCTTCTTCGAGAGGG
GATTAGGCAGAGCGAAAGTGACGTCATTGAAGAGAATCTTGCCTGCTCGCGGCA
TGAAATTGCGGGTGATGCGGAAAGGGCCCGGGACGGAGGCTCGGTTGTTGATGA
CCTGGGCGGCAAGGACGATCTCGTCGAAGCCGTTGATGTTGTGCCCGACGATGT
AGAGTTCCATGAATCGCGGGCGGCCTTTGATGTGCGGCAGCTTTTTGAGCTCCTC
GTAGGTGAGGTCCTCGGGGCATTGCAGGCCGTGCTGCTCGAGCGCCCACTCCTG
GAGATGTGGGTTGGCTTGCATGAAGGAAGCCCAGAGCTCGCGGGCCATGAGGGT
CTGGAGCTCGTCGCGAAAGAGGCGGAACTGCTGGCCCACGGCCATCTTTTCTGG
GGTGACGCAGTAGAAGGTGAGGGGGTCCCGCTCCCAGCGATCCCAGCGTAAGCG
CACGGCGAGATCGCGAGCGAGGGCGACCAGCTCGGGTTCCCCCGAGAATTTCAT
GACCAGCATGAAGGGGACGAGCTGCTTGCCGAAGGACCCCATCCAGGTGTAGGT
TTCTACATCGTAGGTGACAAAGAGCCGCTCCGTGCGAGGATGAGAGCCGATTGG
GAAGAACTGGATTTCCTGCCACCAGTTGGACGAGTGGCTGTTGATGTGATGAAA
GTAGAAATCCCGCCGGCGAACCGAGCACTCGTGCTGATGCTTGTAAAAGCGTCC
GCAGTACTCGCAGCGCTGCACGGGCTGTACCTCATCCACGAGATACACAGCGCG
TCCCTTGAGGAGGAACTTCAGGAGTGGCGGCCCTGGCTGGTGGCTTTCATGTTCG
CCTGCGTGGGACTCACCCTGGGGCTCCTCGAGGACGGAGAGGCTGACGAGCCCG
CGCGGGAGCCAGGTCCAGATCTCGGCGCGGCGGGGCGGAGAGCGAAGACGAG
GGCGCGCAGTTGGGAGCTGTCCATGGTGTCGCGGAGATCCAGGTCCGGGGGCAG
GGTTCTGAGGTTGACCTCGTAGAGGCGGGTGAGGGCGTGCTTGAGATGCAGATG
GTACTTGATCTCCACGGGTGAGTTGGTGGTCGTGTCCACGCATTGCATGAGCCCG
TAGCTGCGCGGGGCCACGACCGTGCCGCGGTGCGCTTTTAGAAGCGGTGTCGCG
GGCGTGCTCCCGGCGGCAGCGGCGGTTCTGGCCCCGCGGGCAGGGGCGGCAGA
GGCACGTCGGCGTGGCGCTCGGGCAGGTCCCGGTGCTGCGCCCTGAGAGCGCTG
GCGTGCGCGACGACGCGGCGGTTGACATCCTGGATCTGCCGCCTCTGCGTGAAG
ACCACGGGCCCCGTGACTTTGAACCTGAAAGACAGTTCAACAGAATCAATCTCT
GCGTCATTGACGGCGGCCTGACGCAGGATCTCTTGCACGTCGCCCGAGTTGTCCT
GGTAGGCGATCTCGGACATGAACTGTTCGATCTCCTCCTCCTGGAGATCGCCGCG
GCCCGCGCGCTCCACGGTGGCGGCGAGGTCATTGGAGATGCGGCCCATGAGCTG
CGAGAAGGCGCCCAGGCCGCTCTCGTTCCAGACGCGGCTGTAGACCACGTCCCC
GTCGGCGTCGCGTGCGCGCATGACCACCTGCGCGAGGTTGAGCTCCACGTGCCG
CGTGAAGACGGCGTAGTTGCGCAGGCGCTGGAAGAGGTAGTTGAGGGTGGTGG
CGATGTGCTCGGTGACGAAGAAGTACATGATCCAGCGGCGCAGGGGCATCTCGC
TGATGTCGCCGATGGCCTCCAGCCTTTCCATGGCCTCGTAGAAATCCACGGCGAA
GTTGAAAAACTGGGCATTGCGGGCCGAGACCGTGAGCTCGTCTTCCAGGAGCCT
GATGAGCTCGGCGATGGTGACGCGCACCTCGCGCTCGAAATCCCCGGGGGCCTC
CTCTTCTTCCTCTTCTTCCATGACGACCTCTTCTTCTATTTCTTCCTCTGGGGCGG
TGGTGGTGGCGGGCCCGACGACGACGGCGACGCACCGGGAGACGGTCGACGA
AGCGCTCGATCATCTCCCCGCGGCGGCGACGCATGGTTTCGGTGACGGCGGCGAC
CCCGTTCGCGAGGACGCAGCGTGAAGACGCCGCCGGTCATCTCCCGGTAATGGG
GCGGGTCCCGTTGGGCAGCGATAGGGCGCTGACGATGCATCTTATCAATTGCG
GTGTAGGGGACGTGAGCGCGTCGAGATCGACCGGATCGGAGAATCTTTCGAGGA
AAGCGTCTAGCCAATCGCAGTCGCAAGGTAAGCTCAAACACGTAGCAGCCCTGT
GGACGCTGTTAGAATTGCGGTTGCTGATGATGTAATTGAAGTAGGCGTTTTTGAG
GCGGCGGATGGTGGCGAGGAGGACCAGGTCCTTGGGTCCCGCTTGCTGGATGCG
GAGCCGCTCGGCCATGCCCAGGCCTGGCCCTGACACCGGCTCAGGTTCTTGTA
GTAGTCATGCATGAGCTCTCAATGTCATCACTGGCGGAGGCGGAGTCTTCCATG
CGGGTGACCCCGACGCCCTGAGCGGCTGCACGAGCGCCAGGTCGGCGACGACG
CGCTCGGCGAGGATGGCCTGTTGCACGCGGGTGAGGGTGTCCTGGAAGTCATCC
ATGTCGACGAAGCGGTGGTAGGCCCCGGTGTTGATGGTGTAGGTGCAGTTGGCC
ATGAGCGACCAGTTGACGGTCTGCAGGCCGGGTTGCACGACCTCGGAGTACCTG
ATCCGCGAGAAGGCGCGCGAGTCGAAGACGTAGTCGTTGCAGGTGCGCACGAG |

TABLE 7-continued

Nucleic Acid Sequences of Vectors

SEQ ID NO Sequence

GTACTGGTAGCCGACTAGGAAGTGCGGTGGCGGCTGGCGGTAGAGCGGCCAGC
GCTGGGTGGCCGGCGCGCCCGGGGCCAGGTCCTCGAGCATGAGGCGGTGGTAGC
CGTAGAGGTAGCGGGACATCCAGGTGATGCCGGCGGCGGTGGTGGAGGCGCGC
GGGGAACTCGCGGACGCGGTTCCAGATGTTGCGCAGCGGCAGGAAATAGTCCATG
GTCGGCACGGTCTGGCCGGTGAGACGCGCGCAGTCATTGACGCTCTAGAGGCAA
AAACGAAAGCGGTTGAGCGGGCTCTTCCTCCGTAGCCTGGCGGAACGCAAACGG
GTTAGGCCGCGTGTGTACCCCGGTTCGAGTCCCCTCGAATCAGGCTGGAGCCGC
GACTAACGTGGTATTGGCACTCCCGTCTCGACCCGAGCCCGATAGCCGCCAGGA
TACGGCGGAGAGCCCTTTTTGCCGGCCGAGGGGGTCGCTAGACTTGAAAGCGGC
TGAAAACCCCGCCGGGTAGTGGCTCGCGCCCGTAGTCTGGAGAAGCATCGCCAG
GGTTGAGTCGCGGCGAGCGGGACTTGGTCACCCCGCCGATTTAAAGACCCACAG
CCAGCCGACTTCTCCAGTTACGGGAGCGAGCCCCCTTTTTTCTTTTTGCCAGATG
CATCCCGTCCTGCGCCAAATGCGTCCCACCCCCCCGGCGACCACCGCGACCGCG
GCCGTAGCAGGCGCCGGCGCTAGCCAGCCACAGACAGAGATGGACTTGGAAGA
GGGCGAAGGGCTGGCAAGACTGGGGGCGCCGTCCCCGGAGCGACACCCCCGCG
TGCAGCTGCAGAAGGACGTGCGCCCGGCGTACGTGCCTGCGCAGAACCTGTTCA
GGGACCGCAGCGGGGAGGAGCCCGAGGAGATGCGCGACTGCCGGTTTCGGGCG
GGCAGGGAGCTGCGCGAGGGCCTGGACCGCCAGCGCGTGCTGCGCGACGAGGA
TTTCGAGCCGAACGAGCAGACGGGGATCAGCCCCGCGCGCGCACGTGGCGGC
GGCCAGCCTGGTGACGGCCTACGAACAGACGGTGAAGCAGGAGCGCAACTTCC
AAAAGAGTTTCAACAACCACGTGCGCACGCTGATCGCGCGCGAGGAGGTGGCCC
TGGGCCTGATGCACCTGTGGGACCTGGCGGAGGCCATCGTGCAGAACCCGGACA
GCAAGCCTCTGACGGCGCAGCTGTTCCTGGTGGTGCAGCACAGCAGGGACAACG
AGGCGTTCAGGGAGGCACTGCTGAACATCGCCGAGCCCGAGGGTCGCTGGCTGC
TGGAGCTGATCAACATCTTGCAGAGCATCGTAGTGCAGGAGCGCAGCCTGAGCC
TGGCCGAGAAGGTGGCGGCGATCAACTACTCGGTGCTGAGCCTGGGCAAGTTTT
ACGCGCGCAAGATTTACAAGACGCCGTACGTGCCCATAGACAAGGAGGTGAAG
ATAGACAGCTTTTACATGCGCATGGCGCTCAAGGTGCTGACGCTGAGCGACGAC
CTGGGCGTGTACCGCAACGACCGCATCCACAAGGCCGTGAGCACGACGAGCGGCGG
CGCGAGCTAAGCGACCGCGAGCTGATGCTGAGCCTTCGCCGGGCGCTGGTAGGG
GGCGCTGCCGGCGGCGAGGAGTCCTACTTCGACATGGGGGCGGACCTGCATTGG
CAGCCGAGCCGGCGCGCCTTGGAGGCCGCCTACGGTCCAGAGGACTTGGAAGAG
GATGAGGAAGAGGAGGAGGATGCACCCGCTGCGGGGTACTGACGCCTCCGTGA
TGTGTTTTTAGATGCAGCAAGCCCCGGACCCCGCCATAAGGGCGGCGCTGCAAA
GCCAGCCGTCCGGTATAGCATCGGACGACTGGGAGGCCGCGATGCAACGCATCA
TGGCCCTGACGACCCGCAACCCCGAGTCCTTTAGACAACAGCCGCAGGCCAACA
GACTCTCGGCCATTCTGGAGGCGGTGGTCCCCTCTCGGACCAACCCCACGCACG
AGAAGGTGCTGGCGATCGTGAACGCGCTGGCGGAGAACAAGGCCATCCGTCCCG
ACGAGGCCGGGCTGGTGTACAACGCCCTGCTGGAGCGCGTGGGCCGCTACAACA
GCACGAACGTGCAGTCCAACCTGGACCGGCTGGTGACGGACGTGCGCGAGGCCG
TGGCGCAGCGCGAGCGGTTCAAGAACGAGGGCCTGGGCTCGCTGGTGGCGCTGA
ACGCCTTCCTGGCGACGCAGCCGGCGAACGTGCCGCGCGGGCAGGACGATTACA
CCAACTTTATCAGCGCGCTGCGGCTGATGGTGACCGAGGTTCCCCAGAGCGAGG
TGTACCAGTCTGGCCCGGACTACTTTTTCCAGACGAGCCGGCAGGGCTTGCAGA
CGGTGAACCTGAGCCAGGCTTTCAAGAACCTGCGCGGGCTGTGGGGCGTGCAGG
CGCCCGTGGGCGACCGGTCGACGGTGAGCAGCTTGCTGACGCCCAACTCGCGTC
TGCTGCTGCTGCTGATCGCGCCCTTCACCGACAGCGGCAGCGTGAACCGCAACT
CGTACCTGGGCCATCTGCTGACGCTGTACCGCGAGGCCATAGGCCAGGCGCAGG
TGGACGAGCAGACCTTCCAGGAGATCACTAGCGTGAGCCGCGCGCTGGGGCAGA
ACGACACCGACAGTCTGAGGGCCACCCTGAACTTCTTGCTGACCAATAGACAGC
AGAAGATCCCGGCGCAATATGCGCTGTCGGCCGAGGAGGAAAGGATCCTGAGA
TATGTGCAGCAGAGCGTAGGGCTGTTCCTGATGCAGGAGGGGGCCACCCCCAGC
GCCGCGCTGGACATGACCGCGCGCAACATGGAACCTAGCATGTACGCCGCCAAC
CGGCCGTTCATCAATAAGCTGATGGACTACCTGCACCGCGCGGCGGTCATGAAC
ACGGACTACTTTACAAACGCCATCCTGAACCCGCACTGGCTCCCGCCGCCGGGG
TTCTACACGGGCGAGTACGACATGCCCGACCCCAACGACGGGTTCCTGTGGGAC
GACGTGGACAGCGTGGTGTTCTCGCCGACCTTTCAAAAGCGCCAGGAGGCGCCG
CCGAGCGAGGGCGCGGTGGGGAGGAGCCCCTTTCCTAGCTTAGGGAGTTTGCAT
AGCTTGCCGGGCTCGGTGAACAGCGGCAGGGTGAGCCGGCCGCCGCTTGCTGGGC
GAGGACGAGTACCTGAACGACTCGCTGCTGCAGCCGCCACGGGCCAAGAACGCC
ATGGCCAATAACGGTATAGAGAGTCTGGTGGACAAACTGAACCGTTGGAAGACC
TACGCTCAGGACCATAGGGATGCGCCCGCCGCGGCGACAGCGCCACGACCGG
CAGCGGGCCTGGTGTGGGACGACGAGGACTCGGCCGACGATAGCAGCGTGTTG
GACTTGGGCGGGAGCGGTGGGGTCAACCCGTTCGCGCATCTGCAGCCCAAACTG
GGGCGACGGATGTTTTGAAATGCAAAATAAAACTCACCAAGGCCATAGCGTGCG
TTCTCTTCCTTGTTAGAGATGAGGCGTGCGGTGGTGTCTTCCTCTCCTCCTCCCTC
GTACGAGAGCGTGATGGCGCAGGCGACCCTGGAGGTTCCGTTTGTGCCTCCGCG
GTATATGGCTCCTACGGAGGGCAGAAACAGCCATTCGTTACTCGGAGCTGGCTCC
GCAGTACGACACCACTCGCGTGTACTTGGTGGACAACAAGTCGGCGGACATCGC
TTCCCTGAACTACCAAAACGACCACAGCAACTTCCTGACCACGGTGGTGCAGAA
CAACGATTTCACCCCGCCGAGGCCAGCACGCAGACGATAAATTTTGACGACGG
GTCGCGGTGGGCGGTGATCTGAAGACCATTCTGCACACTAACATGCCCAATGT
GAACGAGTACATGTTCACCAGCAAGTTTAAGGCGCGGGTGATGGTGGCTAGGAA
GCATCCAGAGGGGGTAGTTGAAACAGATTTGAGTCAGGATAAGCTTGAATATGA
GTGGTTTGAGTTTACCCTGCCCGAGGGAAACTTTTCCGAGACCATGACCATAGAC
CTGATGAACAACGCCATCTTGGAAAACTACTTGCAAGTGGGGCGGCAAAATGGC

TABLE 7-continued

Nucleic Acid Sequences of Vectors

SEQ ID NO Sequence

GTGCTGGAGAGCGATATCGGAGTCAAGTTTGACAGCAGAAATTTCAAGCTGGGC
TGGGACCCGGTGACCAAGCTGGTGATGCCAGGGGTCTACACCTACGAGGCCTTC
CACCCGGACGTGGTGCTGCTGCCGGGCTGCGGGGTGGATTTCACCGAGAGCCGC
CTGAGCAACCTCCTGGGCATTCGCAAGAAGCAACCTTTCCAAGAGGGCTTCAGA
ATCATGTATGAGGATCTAGAAGGTGGCAACATCCCCGCCCTCCTTGATGTGCCCA
AGTACTTGGAAAGCAAGAAGAAGTTGAAGACGAAACTAAAAATGCAGCTGCG
GCTACAGCCGATACAACCACTAGGGGTGATACATTTGCAACTCCAGCGCAAGAG
ACAGCAGCTGATAAGAAGGTAGAAGTCTTGCCCATTGAAAAGGATGAGAGTGGT
AGAAGTTACAACCTGATCCAGGGGACCCACGACACGCTGTACCGCAGTTGGTAC
CTGTCCTATACCTACGGGGACCCCGAGAAGGGGGTGCAGTCGTGGACGCTGCTC
ACCACCCCGGACGTTACCTGCGGCGCGGAGCAAGTCTACTGGTCACTGCCGGAC
CTCATGCAAGACCCCGTCACCTTCCGCTCCACCCAGCAAGTCAGCAACTACCCCG
TGGTCGGCGCCGAGCTCATGCCCTTCCGCGCCAAGAGCTTTTACAACGACCTCGC
CGTCTACTCCCAGCTCATCCGCAGCTACACCTCCCTCACCCACGTCTTCAACCGC
TTCCCCGACAACCAGATCCTCTGCCGCCCGCCCGCGCCCACCATCACCACCGTCA
GTGAAAACGTGCCTGCTCTCACAGATCACGGGACGCTACCGCTGCGCAGCAGTA
TCCGCGGAGTCCAGCGAGTGACCGTCACTGACGCCCGTCGCCGCACCTGTCCCT
ACGTCTACAAGGCCCTGGGCATAGTCGCGCCGCGCGTGCTTTCCAGTCGCACCTT
CTAAAAAAATGTCTATTCTCATCTCGCCCAGCAATAACACCGGCTGGGGTCTTAC
TAGACCCAGCACCATGTACGGAGGAGCCAAGAAGCGCTCCCAGCAGCACCCCGT
CCGCGTCCGCGGCCACTTCCGCGCTCCCTGGGGCGCTTACAAGCGCGGGCGGAC
TTCCACCGCCGTGCGCACCACCGTCGACGACGTCATCGACTCGGTGGTCGCCGA
CGCGCGCAACTACACTCCCGCCCCCTCCACCGTGGACGCGGTCATCGACAGCGT
GGTGGCCGACGCGCGCGACTATGCCAGACGCAAGAGCCGGCGGCGACGGATCG
CCAGGCGCCACCGGAGCACGCCCGCCATGCGCGCCGCCCGGGCTCTGCTGCGCC
GCGCCAGACGCACGGGCCGCCGGGCCATGATGCGAGCCGCGCGCCGCGCTGCCA
CTGCACCCACCCCCGCAGGCAGGACTCGCAGACGAGCGGCCGCCGCCGCCGCTG
CGGCCATCTCTAGCATGACCAGACCCAGGCGCGGAAACGTGTACTGGGTGCGCG
ACTCCGTCACGGGCGTGCGCGTGCCCGTGCGCACCCGTCCTCCTCGTCCCTGATC
TAATGCTTGTGTCCTCCCCCGCAAGCGACGATGTCAAAGCGCAAATCAAGGAG
GAGATGCTCCAGGTCGTCGCCCCGGAGATTTACGGACCACCCCAGGCGGACCAG
AAACCCCGCAAAATCAAGCGGGTTAAAAAAAAGGATGAGGTGGACGAGGGGGC
AGTAGAGTTTGTGCGCGAGTTCGCTCCGCGGCGGCGCGTAAATTGGAAGGGGCG
CAGGGTGCAGCACGTGTTGCGGCCCGGCACGGCGGTGGTGTTCACGCCCGGCGA
GCGGTCCTCGGTCAGGAGCAAGCGTAGCTATGACGAGGTGTACGGCGACGACGA
CATCCTGGACCAGGCGGCGGAGCGGGCGGGCGAGTTCGCCTACGGGAAGCGGT
CGCGCGAAGAGGAGCTGATCTCGCTGCCGCTGGACGAAAGCAACCCCACGCCGA
GCCTGAAGCCCGTGACCCTGCAGCAGGTGCTGCCCCAGGCGGTGCTGCTGCCGA
GCCGCGGGGTCAAGCGCGAGGGCGAGAGCATGTACCCGACCATGCAGATCATG
GTGCCCAAGCGCCGGCGCGTGGAGGACGTGCTGGACACCGTGAAAATGGATGTG
GAGCCCGAGGTCAAGGTGCGCCCCATCAAGCAGGTGGCGCCGGGCCTGGGCGTG
CAAACCGTGGACATTCAGATCCCCACCGACATGGATGTCGACAAAAAACCCTCG
ACCAGCATCGAGGTGCAAACCGACCCCTGGCTCCCAGCCTCCACCGCTACCGTC
TCCACTTCTACCGCCGCCACGGCTACCGAGCCTCCCAGGAGGCGAAGATGGGGC
GCCGCCAGCCGGCTGATGCCCAACTACGTGTTGCATCCTTCCATCATCCCGACGC
CGGGCTACCGCGGCACCCGGTACTACGCCAGCCGCCGGCGCCCAGCCAGCAAAC
GCCGCCGCCGCACCGCCACCCGCCGCCGTCTGGCCCCCGCCCGCGTGCGCCGCG
TGACCACGCGCCGGGCCGCTCGCTCGTTCTGCCCACCGTGCGCTACCACCCCAG
CATCCTTTAATTCGTGTGCTGTGATACTGTTGCAGAGAGATGGCTCTCACTTGCC
GCCTGCGCATCCCCGTCCCGAATTACCGAGGAAGATCCCGCCGCAGGAGAGGCA
TGGCAGGCAGCGGCCTGAACCGCCGCCGGCGGCGGGCCATGCGCAGGCGCCTG
AGTGGCGGCTTTCTGCCCGCGCTCATCCCCATAATCGCCGCGGCCATCGGCACGA
TCCCGGGCATAGCTTCCGTTGCGCTGCAGGCGTCGCAGCGCCGTTGATGTGCGA
ATAAAAGCCTCTTTAGACTCTGACACACCTGGTCCTGTATATTTTTAGAATGGAA
GACATCAATTTTGCGTCCCTGGCTCCGCGGCACGGCACGCGGCCGTTCATGGGC
ACCTGGAACGAGATCGGCACCAGCCAGCTGAACGGGGGCGCCTTCAATTGGAGC
AGTGTCTGGAGCGGGCTTAAAAATTTCGGCTCGACGCTCCGGACCTATGGGAAC
AAGGCCTGGAATAGTAGCACGGGGCAGTTGCTAAGGGAAAAGCTCAAAGACCA
GAACTTTCAGCAGAAGGTGGTGGACGGGCTGGCCTCGGGCATTAACGGGGTGGT
GGACATCGCGAACCAGGCCGTGCAGCGCGAGATAAACAGCCGCCTGGACCCGC
GGCCGCCCACGGTGGTGGAGATGGAAGATGCAACTCTTCCGCCGCCCAAAGGCG
AGAAGCGGCCGCGGCCCGACGCGGAGGAGACGATCCTGCAGGTGGACGAGCCG
CCCTCGTACGAGGAGGCCGTCAAGGCCGGCATGCCCACCACGCGCATCATCGCG
CCGCTGGCCACGGGTGTAATGAAACCCGCCACCCTTGACCTGCCTCCACCACCC
GCGCCCGCTCCACCGAAGGCAACTCCGGTTGTGCAGGCCCCCCCGGTGGCGACC
GCCGTGCGCCGCGTCCCCGCCCGCCGCCAGGCCCAGAACTGGCAGAGCACGTTG
CACAGTATCGTAGGCCTGGGAGTGAAAAGTCTGAAGCGCCGCCGATGCTATTGA
AAGAGAGGAAAGAGGACACTAAAGGGAGAGCTTAACTTGTATGTGCCTTACCGC
CAGAGAACGCGCGAAGATGGCCACCCCCTCGATGATGCCGCAGTGGGCGTACAT
GCACATCGCCGGGCAGGACGCCTCGGAGTACCTGAGCCCGGGTCTGGTGCAGTT
TGCCCGCGCCACCGACACGTACTTCAGCCTGGGCAACAAGTTTAGGAACCCCAC
GGTGGCCCCGACCCACGATGTGACCACGGACCGGTCCCAGCGTCTGACGCTGCG
CTTCGTGCCCGTGGATCGCGAGGACACCACGTACTCGTACAAGGCGCGCTTCAC
TCTGGCCGTGGGCGACAACCGGGTGCTAGACATGGCCAGCACTTACTTTGACAT
CCGCGGCGTCCTGGACCGCGGTCCCAGCTTCAAACCCTACTCGGGACAGCTTA
CAACAGCCTGGCCCCCAAGGGCGCCCCCAACTCCAGTCAGTGGGAACAGAAAA

TABLE 7-continued

Nucleic Acid Sequences of Vectors

SEQ ID NO Sequence

```
AGGCCAATGCTGGAGAACAAAAGGAAACACATACTTATGGTGTAGCTCCTATGG
GTGGAGAAAACATTACAATTAGCGGTTTGCAAATTGGAACAGATACTACAAATG
GCAAACAAGACCCGATATATGCTAATAAGCTGTATCAACCAGAGCCTCAAGTAG
GAGAAGAAAACTGGCAGGAAACAGAAGCCTTCTATGGAGGAAGGGCTCTTAAA
AAGGAAACCAAGATGAAACCATGCTATGGCTCATTTGCCAGACCCACAAATGAA
AAAGGAGGACAGGCAAAACTAAGAGACCCTGAAAAAAGTCAAGAAGATTTTGA
CATAGACCTAGCATTCTTTGATACTCCGGGAGGAACTTTAACAGGTGGTGGAAC
GGAATACAAAGCAGACATTGTTATGTGCACTGAAAATGTTAATCTTGAAACCCC
GGACACCCACGTGGTGTATAAACCAGGCAAAGATGATGACAGTTCAGAAATCAA
CTTGGTTCAGCAGTCCATGCCCAACAGACCTAACTACATCGGCTTCAGGGACAA
CTTTGTGGGTCTCATGTACTACAACAGCACTGGCAACATGGGTGTGCTGGCCGGT
CAGGCTTCTCAGTTGAATGCTGTGGTCGACTTGCAAGACAGAAACACAGAGCTG
TCTTACCAGCTCTTGCTAGATTCTCTGGGCGACAGAACCAGGTACTTTAGCATGT
GGAACTCTGCGGTGGACAGCTATGATCCCGATGTCAGGATCATTGAGAATCACG
GTGTGGAAGATGAACTTCCCAACTATTGCTTCCCATTGGATGGGTCTGGCACCAA
TGCTGCTTATGAAGGTGTAAAAGTTAAAAATGGACAAGATGGGGATCAAGAGA
GCGAATGGGAAAAAGACACCAATGTGGCAGATCGAAACCAATATGCAAGGGC
AACATCTACGCCATGGAGATCAACCTCCAGGCCAACCTGTGGAAGAGTTTTCTG
TACTCGAACGTGGCGCTGTACCTGCCCGACTCCTACAAGTACACGCCGGCCAAC
GTCACGCTGCCCACCAACACCAACACCTACGAGTACATGAATGGCCGCGTGGTA
GCCCCCTCGCTGGTGGACGCCTACATCAACATCGGCGCCCGCTGGTCGCTGGATC
CCATGGACAACGTCAACCCCTTCAACCACCACCGCAACGCGGGCCTGCGCTACC
GCTCCATGCTTCTGGGCAACGGCCGCTACGTGCCCTTCCACATCCAAGTGCCCCA
AAAGTTCTTTGCCATCAAGAACCTGCTCCTGCTTCCCGGCTCCTACACCTACGAG
TGGAACTTCCGCAAGGATGTCAACATGATCCTGCAAAGTTCCCTCGGCAACGAC
CTGCGCGTCGACGGCGCCTCCGTCCGCTTCGACAGCGTCAACCTCTATGCCACCT
TCTTCCCCATGGCGCACAACACCGCCTCCACCCTGGAAGCCATGCTGCGCAACG
ACACCAACGACCAGTCCTTCAACGACTACCTCTCAGCCGCCAACATGCTCTACCC
CATCCCGGCCAAGGCCACCAACGTGCCCATCTCCATCCCCTCGCGCAACTGGGC
CGCCTTCCGCGGATGGAGTTTCACCCGGCTCAAGACCAAAGAAACTCCCTCCCTC
GGCTCGGGTTTCGACCCCTACTTTGTCTACTCGGGTTCCATCCCCTACCTCGACG
GGACCTTCTACCTCAACCACACCTTCAAGAAGGTCTCCATCATGTTCGACTCCTC
GGTCAGCTGGCCCGGCAACGACCGGCTGCTCACGCCGAACGAGTTCGAGATCAA
GCGCAGCGTCGACGGGGAGGGCTACAATGTGGCCCAATGCAACATGACCAAGG
ACTGGTTCCTCGTCCAGATGCTCTCCCACTACAACATCGGCTACCAGGGCTTCCA
TGTGCCAGAGGGTTACAAGGACCGCATGTACTCCTTCTTCCGCAACTTCCAGCCC
ATGAGCAGGCAGGTGGTCGATGAGATCAACTACAAGGACTACAAGGCCGTCACC
CTGCCATTCCAGCACAACAACTCGGGCTTCACCGGCTACCTGCACCCACCATGC
GTCAGGGGCAGCCCTACCCCGCCAACTTCCCCTACCCGCTCATCGGCCAGACAG
CCGTGCCCTCCGTCACCCAGAAAAAGTTCCTCTGCGACAGGGTCATGTGGCGCA
TCCCCTTCTCCAGCAACTTCATGTCCATGGGCGCCCTCACCGACCTGGGTCAGAA
CATGCTCTACGCCAACTCGGCCCACGCGCTCGACATGACCTTCGAGGTGGACCC
CATGGATGAGCCCACCCTCCTCTATCTTCTCTTTGAAGTTTTCGACGTGGTCAGA
GTGCACCAGCCGCACCGCGGCGTCATCGAGGCCGTCTACCTGCGCACGCCCTTCT
CCGCCGGCAACGCCACCACCTAAGCATGAGCGGCTCCAGCGAACGAGAGCTCGC
GGCCATCGTGCGCGACCTGGGCTGCGGGCCCTACTTTTTGGGTACCCACGACAA
GCGCTTCCCGGGTTTCCTCGCCGGCGACAAGCTGGCCTGCGCCATCGTCAACACG
GCCGGCCGCGAGACCGGGGCGTGCACTGGCTCGCCTTCGGCTGGAACCCGCGC
TCGCGCACCTGCTACATGTTCGACCCCTTTGGGTTCTCGGACCGCCGGCTCAAGC
AGATTTACAGCTTCGAGTACGAGGCCATGCTGCGCCGCAGCGCCCTGGCCTCCTC
GCCCGACCGCTGTCTCAGCCTCGAACAGTCCACCCAGACCGTGCAGGGGCCCGA
CTCCGCCGCCTGCGGACTTTTCTGTTGCATGTTCTTGCATGCCTTCGTGCACTGGC
CCGACCGACCCATGGACGGAAACCCCACCATGAACTTGCTGACGGGGGTGCCCA
ACGGCATGCTACAATCGCCACAGGTGCTGCCCACCCTCCGGCGCAACCAGGAGG
AGCTCTACCGCTTCCTCGCGCGCCACTCCCCTTACTTTCGCTCCCACCGCGCCGC
CATCGAACACGCCACCGCTTTTGACAAAATGAAACAACTGCGTGTATCTCAATA
AACAGCACTTTTATTTTACATGCACTGGAGTATATGCAAGTTATTTAAAAGTCGA
AGGGGTTCTCGCGCTCGTCGTTGTGCGCCGCGCTGGGAGGGCCACGTTGCGGA
ACTGGTACTTGGGCTGCCACTTGAACTCGGGGATCACCAGTTTGGGCACTGGGG
TCTCGGGGAAGGTCTCGCTCCACATGCGCCGGCTCATCTGCAGGGCGCCCAGCA
TGTCAGGCGCGGAGATCTTGAAATCGCAGTTGGGCCGGTGCTCTGCGCGCGCG
AGTTGCGGTACACGGGGTTGCAGCACTGGAACACCATCAGACTGGGGTACTTCA
CACTGGCCAACACGCTCTTGTCGCTGATCTGATCCTTGTCCAGATCCTCGGCGTT
GCTCAGGCCGAACGGGGTCATCTTGCACAGCTGGCGGCCCAGGAAGGGCACGCT
CTGAGGCTTGTGGTTACACTCGCAGTGCACGGGCATCAGCATCATCCCCGCGCC
GCGCTGCATATTCGGGTAGAGGGCCTTGACGAAGGCCGCGATCTGCTTGAAAGC
TTGCTGGGCCTTGGCCCCCTCGCTGAAAAACAGGCCGCAGCTCTTCCCGCTGAAC
TGATTATTCCCGCACCCGGCATCATGGACGCAGCAGCGCGCGTCATGGCTGGTC
AGTTGCACCACGCTCCGTCCCCAGCGGTTCTGGGTCACCTTGGCCTTGCTGGGTT
GCTCCTTCAGCGCACGCTGCCCGTTCTCACTGGTCACATCCATCTCCACCACGTG
GTCCTTGTGGATCATCACCGTCCCATGCAGACACTTGAGCTGGCCTTCCACCTCG
GTGCAGCCGTGGTCCCACAGGGCACTGCCGGTGCACTCCCAGTTCTTGTGCGCG
ATCCCGCTGTGCTGAAGATGTAACCTTGCAACAGGCGACCCATGATGGTGCTA
AAGCTCTTCGGGTGGTGAAGGTCAGTTGCAGACCGCGGGCCTCCTCGTTCATCC
AGGTCTGGCACATCTTTTGGAAGATCTCGGTCTGCTCGGGCATGAGCTTGTAAGC
ATCGCGCAGGCCGCTGTCGACGCGGTAGCGTTCCATCAGCACATTCATGGTATCC
```

TABLE 7-continued

Nucleic Acid Sequences of Vectors

SEQ ID NO Sequence

ATGCCCTTCTCCCAGGACGAGACCAGAGGCAGACTCAGGGGGTTGCGCACGTTC
AGAACACCGGGGGTCGCGGGCTCGACGATGCGTTTTCCGTCCTTGCCTTCCTTCA
ACAGAACCGGCGGCTGGCTGAATCCCACTCCCACGATCACGGCTTCTTCCTGGG
GCATCTCTTCGTCTGGGTCTACTTTGGTCACATGCTTGGTCTTTCTGGCTTGCTTC
TTTTTTGGAGGGCTGTCCACGGGGACCACGTCCTCCTCGGAAGACCCGGATCCCA
CCCGCTGATACTTTCGGCGCTTGGTTGGCAGAGGAGGTGGCGGCGAGGGGCTCC
TCTCCTGCTCCGGCGGATAGCGCGCTGAACCGTGGCCCCGGGGCGGAGTGGCCT
CTCGGTCCATGAACCGGCGCACGTCCTGACTGCCGCCGGCCATTGTTTCCTAGGG
GAAGATGGAGGAGCAGCCGCGTAAGCAGGAGCAGGAGGAGGACTTAACCACCC
ACGAGCAACCAAAAATCGAGCAGGACCTGGGCTTCGAAGAGCCGGCTCGTCTAG
AACCCCCACAGGATGAACAGGAGCACGAGCAAGACGCAGGCCAGGAGGAGACC
GACGCTGGGCTCGAGCATGGCTATCTGGGAGGAGAGGAGGATGTGCTGCTCAAA
CACCTGCAGCGCCAGTCCCTCATCCTCCGGGACGCCCTGGCCGACCGGAGCGAA
ACCCCCCTCAGCGTCGAGGAGCTGTGTCGGGCCTACGAGCTCAACCTCTTCTCGC
CGCGCGTGCCCCCCAAACGCCAGCCCAACGGCACATGCGAGCCCAACCCGCGTC
TCAACTTCTATCCCGTCTTTGCGGTCCCCGAGGCCCTCGCCACCTATCACATCTTT
TTCAAGAACCAAAAGATCCCCGTCTCCTGCCGCGCCAACCGCACCCGCGCCGAC
GCGCTCCTCGCTCTGGGGCCCGGCGCGCGCATACCTGATATCGCTTCCCTGGAAG
AGGTGCCCAAGATCTTCGAAGGGCTCGGTCGGGACGAGACGCGCGCGGCGAAC
GCTCTGAAAGAAACAGCAGAGGAAGAGGGTCACACTAGCGCCCTGGTAGAGTT
GGAAGGTGACAACGCCAGGCTGGCCGTGCTCAAGCGCAGCGTCGAGCTCACCCA
CTTTGCCTACCCCGCCGTCAACCTCCCGCCCAAGGTCATGCGTCGCATCATGGAT
CAGCTCATCATGCCCCACATCGAGGCCCTCGATGAAAGTCAGGAGCAGCGCCCC
GAGGACGCCCGGCCCGTGGTCAGCGACGAGATGCTCGCGCGCTGGCTCGGGACC
CGCGACCCCCAGGCTTTGGAACAGCGGCGCAAGCTGATGCTGGCCGTGGTCCTG
GTCACCCTCGAGCTCGAATGCATGCGCCGCTTCTTCAGCGACCCCGAGACCCTGC
GCAAGGTCGAGGAGACCCTGCACTACACTTTCAGGCACGGTTTCGTCAGGCAGG
CCTGCAAGATCTGCAACGTGGAGCTGACCAACCTGGTCTCCTGCCTGGGGATCCT
GCACGAGAACCGCTGGGACAGACCGTGCTCCACTCGACCCTGAAGGGCGAGGC
GCGGCGGGACTATGTCCGCGACTGCGTCTTTCTCTTTCTGCCACACATGGCAA
GCAGCCATGGGCGTGTGGCAGCAGTGTCTCGAGGACGAGAACCTGAAGGAACT
GGACAAGCTTCTTGCTAGAAACCTTAAAAAGCTGTGGACAGGCTTCGACGAGCG
CACCGTCGCCTCGGACCTGGCCGAGATCGTGTTCCCCGAGCGCCTAAGGCAGAC
GCTGAAAGGCGGGCTGCCCGACTTCATGAGCCAGAGCATGTTGCAAAACTACCG
CACTTTCATTCTCGAGCGATCTGGATGCTGCCCGCCACCTGCAACGCCTTCCCC
TCAGACTTTGTCCCGCTGAGCTACCGCGAGTGTCCCCCGCCGCTGTGGAGCCACT
GTTACCTCTTGCAGCTGGCCAACTACATCGCCTACCACTCGGACGTGATCGAGGA
CGTGAGCGGCGAGGGGCTGCTCGAATGCCACTGCCGCTGCAACCTGTGCTCCCC
GCACCGCTCCCTGGTCTGCAACCCCCAGCTCCTTAGCGAGACCCAGGTCATTGGT
ACCTTCGAGCTGCAAGGTCCGCAGGAGTCCACCGCTCCGCTGAAACTCACGCCG
GGGTTGTGGACTTCCGCGTACCTGCGCAAATTTGTACCCGAGGACTACCACGCCC
ATGAGATAAAGTTCTTCGAGGACCAATCGCGTCCGCAGCACGCGGATCTCACGG
CCTGCGTCATCACCCAGGGCACGATCCTCGCCCAATTGCACGCCATCCAAAAAT
CCCGCCAAGAGTTTCTTCTGAAAAAGGGTAGAGGGGTCTACCTGGACCCCCAGA
CGGGCGAGGTGCTCAACCCGGGTCTCCCCCAGCATGCCGAGGAAGAAGCAGGA
GCCGCTAGTGGAGGAGATGGAAGAAGAATGGGACAGCCAGGCAGAGGAGGACG
AATGGGAGGAGGAGACAGAGGAGGAAGAATTGGAAGAGGTGGAAGAGGAGCA
GGCAACAGAGCAGCCCGTCGCCGCACCATCCGCGCCGGCAGCCCCGCCGGTCAC
GGATACAACCTCCGCAGCTCCGGCCAAGCCTCCTCGTAGATGGGATCGAGTGAA
GGGTGACGGTAAGCACGAGCGGCAGGGCTACCGATCATGGAGGGCCCACAAAG
CCGCGATCATCGCCTGCTTGCAAGACTGCGGGGGGAACATCGCTTTCGCCCGCC
GCTACCTGCTCTTCCACCGCGGGGTGAACATCCCCCGCAACGTGTTGCATTACTA
CCGTCACCTTCACAGCTAAGAAAAAGCAAGTAAGAGGAGTCGTCGGAGGAGGA
GGAGGCCTGAGGATCGCGGCGAACGAGCCCTCGACCACCAGGGAGCTGAGGAA
CCGGATCTTCCCCACTCTTTATGCCATTTTTCAGCAGAGTCGAGGTCAGCAGCAA
GAGCTCAAAGTAAAAAACCGGTCTCTGCGCTCGCTCACCCGCAGTTGCTTGTACC
ACAAAAACGAAGATCAGCTGCAGCGCACTCTCGAAGACGCCGAGGCTCTGTTCC
ACAAGTACTGCGCGCTCACTCTTAAAGACTAAGGCGCGCCCACCCGGAAAAAG
GCGGGAATTACCTCATCGCCACCATGAGCAAGGAGATTCCCACCCCTTACATGT
GGGAGCTATCAGCCCCAGATGGGCTTGGCCGCGGGCGCCTCCCAGGACTACTCCA
CCCGCATGAATTGGCTCAGTGCCGGCCCCTCGATGATCTCACGGGTCAACGGGG
TCCGTAACCATCGAAACCAGATATTGTTGGAGCAGGCGGCGGTCACCTCCACGC
CCAGGGCAAAGCTCAACCCGCGTAATTGGCCCTCCACCCTGGTGTATCAGGAAA
TCCCCGGGCCGACTACCGTACTACTTCCGCGTGACGCACTGGCCGAAGTCCGCAT
GACTAACTCAGGTGTCCAGCTGGCCGGCGGCGCTTCCCGGTGCCCGCTCCGCCC
ACAATCGGGTATAAAAACCCTGGTGATCCGAGGCAGAGGCACACAGCTCAACG
ACGAGTTGGTGAGCTCTTCGATCGGTCTGCGACCGGACGGAGTGTTCCAACTAG
CCGGAGCCGGGAGATCGTCCTTCACTCCCAACCAGGCCTACCTGACCTTGCAGA
GCAGCTCTTCGGAGCCTCGCTCCGGAGGCATCGGAACCCTCCAGTTTGTGGAGG
AGTTTGTGCCCTCGGTCTACTTCAACCCCTTCTCGGGATCGCCAGGCCTCTACCC
GGACGAGTTCATACCGAACTTCGACGCAGTGAGAGAAGCGGTGGACGCTACG
ACTGAATGTCCCATGGTGACTCGGCTGAGCTCGCTCGGTTGAGGCATCTGGACC
ACTGCCGCCGCCTGCGCTGCTTCGCCCGGGAGAGCTGCGGACTCATCTACTTTGA
GTTTCCCGAGGAGCACCCCAACGGCCCTGCACACGGAGTGCGGATCACCGTAGA
GGGCACCACCGAGTCTCACCTGGTCAGGTTCTTCACCCAGCAACCCTTCCTGGTC
GAGCGGGACCGGGGCGCCACCACCTACACCGTCTACTGCATCTGTCCGACCCCG

TABLE 7-continued

Nucleic Acid Sequences of Vectors

| SEQ ID NO | Sequence |
|---|---|
| | AAGTTGCATGAGAATTTTTGCTGTACTCTTTGTGGTGAGTTTAATAAAAGCTAAA |
| | CTCTTGCAATACTCTGGACCTTGTCGTCATCAACTCAACGAGACCGTCTACCTTA |
| | CCAACCAGACTGAGGTAAAACTCACCTGCAGACCACACAAGACCTATATCATCT |
| | GGTTCTTCGAGAACACCTCATTTGCAGTCTCCAACACTCACTGCAACGACGGTGT |
| | TGAACTTCCCAACAACCTTTCCAGTGGACTGAGTTACGATACACGTAGAGCTAA |
| | GCTCATCCTCTACAATCCTTTTGTAGAGGGAACCTACCAGTGCCAGAGCGGACCT |
| | TGTACTCACACCTTCCATTTGGTGAACGTTACCGGCAGCAGCACAGCCGCTCCAG |
| | AAACTAACCTTCCTTCTGATACTATCAAACCTCGTTTCGGAGGTGAGCTAAGGCT |
| | TCCCCCTTCTGAGGAGGGGGTTAGCCCTTACGAAGTGGTCGGGTATTTGATTTTA |
| | GGGGTGGTCCTGGGTGGGTGCATAGCGGTGCTAGCTCAGCTGCCTTGCTGGGTA |
| | GAAATCAAAATCTTTATATGCTGGGTCAGACATTGTGGGGAGGAACTATGAAGG |
| | GGCTCTTGCTGATTATCCTTTCCCTGGTGGGGGGTGTGCTGTCATGCCACGAACA |
| | GCCACGATGTAACATCACCACAGGCAATGAGAGGAGTGTCATATGCACAGTAGT |
| | CATCAAATGCGAGCATGAATGCCCTCTCAACATCACATTCAAAAACCGTACCAT |
| | GGGGAATGCATGGGTGGGCGACTGGGAACCAGGAGATGAGCAGAACTACACGG |
| | TCACTGTCCATGGTAGCGATGGAAATCACACTTTCGGTTTCAAATTCATTTTTGA |
| | AGTCATGTGTGATATCACACTGCATGTGGCTAGACTTCATGGCTTGTGGCCCCCT |
| | ACCAAGGAAAACATGGTTGGGTTTTCTTTGGCTTTTGTGATCATGGCCTGCTTTA |
| | TGTCAGGTCTGCTGGTAGGAGCTCTAGTGTGGTTCCTGAAACGCAAGCCCAGGT |
| | ATGGAAATGAGGAAAAGGAAAAATTGCTATAAATTCTTTTTCTTTTCACAGCACC |
| | ATGAATACTTTGACCAGTGTCGTGCTGCTCTCTCTTCTTGTAGCTTTTAGTCAGGC |
| | AGGAATTATTAACTTAAATGTATCATGGGGAATGAATCTAACTTTAGTGGGACC |
| | CTCAGACCTGCCAGTTACATGGTATGATGGAAAGGGAATGCAGTTTTGTGATGG |
| | AAATACAATTAAGAACCCACAAATCAAGCATAGCTGTAATCAACAGAATCTAAC |
| | TTTACTTAATGCTGACAAGTCTCATGAAAGAACTTACCTAGGTTACAGACATGAC |
| | AGTAAGGAAAAAGTAGACTATAAGGTTACAGTCATACCACCTCCTCCAGCCACT |
| | CGCAAGCCTTTGTCAGAGCCTCATTATGTTACTGTGACTATGGGCGATAACATAA |
| | CTTTAGTGGGACCCTCAGACCTGCCAGTTACATGGTATGATGGAGAAGGAAATA |
| | AATTCTGCGATGGAGAAAAAGTTGAACATGCAGAATTTAATCATACATGTAACA |
| | TCCAGAACCTGACACTGCTCTTTGTCAACTTAACGCATAATGGAGCATACATTGG |
| | TTATAACAAAGACGGTTCTGATAGAGAATTATATGAGGTGTCAGTCAAAACCTT |
| | GTTTCAGAACGGGGCTGGACAAAGTAAGGTTGAACAAGGTAATAAAGGGAAAC |
| | CTAATACTGCTCAAAGTGGTGGTAAAAAAACCAAAACAGAACATAGAAACCAG |
| | AGTCCAAAAAGAAAATCAACAAATAACCTTCAGCCAACAACACAATTGTATGTTAGG |
| | CCTTTTACTAATGTTAGTTTAACTGGACCTCCAAATGGCAAGGTTACTTGGTATG |
| | ATGGCGAACTTAATGATCCATGTGAACAAAAGTACAAACTCAGAACTTTTTGCA |
| | ATCAGCAAAATCTAACTTTAATTAATGTAAGCAGCACTTATGATGGCATCTATTA |
| | TGGCACTGATGAAAAAGATAAGGCAAATCGTTACAGAATAAAAGTAAATACTAC |
| | AAATCACAAAACTGTTAAAATTAAGCCACATACCAAAGAACCTCCTGCTGTACA |
| | AGAAAAACAGTTTGAATTACAAGATGCAGAAACTGATGAAAACGAATCAAAAA |
| | TTCCCTCAGCTACTGTGGCAATCGTGGTGGGAGTGATTGCGGGCTTTGTAACTCT |
| | GATCATTGTCTTCATATGCTACATCTGCTGCCGCAAGCGTCCCAGGTCATACAAT |
| | CATATGGTAGACCCACTACTCAGCTTCTCTTACTGAAACTCAGTCACTCTCATTT |
| | CAGAACCATGAAGGCTTTCACAGCTTGCGTTCTGATTAGCATAGTCACACTTAGT |
| | TCAGCTGCAATGATTAATGTTAATGTCACTAGAGGTGGTAAAATTACATTGAATG |
| | GGACTTATCCACAAACTACATGGACAAGATATCATAAAGATGGATGGAAAAATA |
| | TCTGTGAATGGAATGTTACTGCATATAAATGCTTCAATAATGGAAGCATTACTAT |
| | TACTGCCACTGCCAACATTACTTCTGGCACATACAAAGCTGAAAGCTATAAAA |
| | TGAAATCAAAAAACTAACCTATAAAACAACAAAACCACATTTGAAGATTCTGG |
| | AAATTATGAACATCAAAAATTATCTTTTTATATGTTGACAATAATTGAACTGCCT |
| | ACAACTAAGGCTCCCACCACAGTTAGGACAACTACAGAAACAACCACACATCCA |
| | ACCACTACTCACACTACAGTGCAAAATACTACTTTATTGATTGGGTTTTTACTGA |
| | GAGAGAATGAAAGTACTACTGAACAGACAGAGGCTACCTCAAGTGCCTTCAGCA |
| | GCACTGCAAATTTAACTTCGCTTGCTTGGACTAATGAAACCGGAGTATCATTGAT |
| | GCATGGCCAGCCTTACTCAGGTTTGGATATTCAAATTACTTTTCTGGTTGTCTGTG |
| | GGATCTTTATTCTTGTGGTTCTTCTGTACTTTGTCTGCTGCAAAGCCAGAGAGAA |
| | ATCTAGGAGGCCCATCTACAGGCCAGTGATTGGGGAACCTCAGCCACTCCAAGT |
| | GGATGGAGGCTTAAGGAATCTTCTTCTCTTTTACAGTATGGTGATCAGCCATG |
| | ATTCCTAGGTTCTTCCTATTTAACATCCTCTTTTGTCTCTTCAACATCTGTGCTGC |
| | CTTCGCGGCCGTCTCGCACGCCTCGCCCGACTGTCTAGGGCCTTTCCCCACCTAC |
| | CTCCTCTTTGCCCTGCTCACCTGCACCTGCGTCTGCAGCATTGTCTGCGTGGTCAT |
| | CACCTTCCTGCAGCTCATCGACTGGTGCTGCGCGCTATAATTATCTCCACCAC |
| | AGTCCCGAATCAGGGACGAGAACGTAGCCAGAATCTTAAGGCTCATCTGACCA |
| | TGCAGACTCTGCTCATGCTGCTATCCCTCCTATCCCCTGCCCTCGCCACTTCTGCT |
| | GACTCTAAATGCAAATTCGCGGAGATATGGAATTTCTTAGATTGCTATCAGGAG |
| | AAAATTGATATGCCCTCCTATTACTTGGTGATTGTGGGAATAGTCATGGTCTGCT |
| | CCTGCACTTTCTTTGCCATCATGATCTACCCCTGTTTTGATCTCGGCTGGAACTCT |
| | GTTGAGGCATTCACATACACACTAGAAAGCAGTTCACTAGCCTCCACGCCACCG |
| | CCCACACCGCCTCCCGCAGAAATCAGTTCCCACTGATTCAGTACTTAGAAGAG |
| | CCCCCTCCCCGGCCCCCTTCCACTGTTAGCTACTTTCACATAACCGGCGGCGATG |
| | ACTGACCACCACCTGGACCTCGAGATGGACGGCCAGGCCTCCGAGCAGCCGATC |
| | CTGCAACTGCGCGTCCGTCAGCAGCAGGAGCGGGCCGCCAAGGAGCTCCTCGAT |
| | GCCATCAACATCCACCAGTGCAAGAAGGGCATCTTCTGCCTTGTCAAACAGGCA |
| | AAGATCACCTACGAGCTCGTGTCCGGCGGCAAGCAGCATCGCCTCACCTATGAG |
| | CTGCCCCAGCAGAAGCAGAAGTTCACCTGCATGGTGGGCGTCAACCCCATAGTC |
| | ATCACCCAGCAGTCGGGCGAGACCAGCGGCTGCATCCACTGCTCCTGCGAAAGC |

TABLE 7-continued

Nucleic Acid Sequences of Vectors

| SEQ ID NO | Sequence |
|---|---|
| | CCCGAGTGCATATACTCCCTCCTCAAGACCCTTTGCGGACTCCGCGACCTCCTCC<br>CCATGAACTGATGTTGATTAAAAGCCCGAAAACCAATCAGACCATTCCCCCATTT<br>CCCCATTCCCAATTACTCATAAAATAAATCATTGGAATTAATCATTCAATAAAAA<br>TCACTTACTTGAAATCTGAAAGTATGTCTCTGGTGTAGTTGTTCAACAGCACCTC<br>GGTACCCTCCTCCCAGCTCTGGTACTCCAGTCCCCGGCGGGCGGCGAACTTCCTC<br>CACACCTTGAAAGGGATGTCAAATTCCTGGTCCACAATTTTCATTGTCTTCCCTC<br>TCAGATGGCAAAGAGGCTCCGGGTGGAAGATGACTTCAACCCCGTCTACCCCTA<br>TGGCTACGCGCGGAATCAGAATATCCCCTTCCTCACTCCCCCCTTTGTCTCCTCC<br>GATGGATTCCAAAACTTCCCCCCTGGGGTCCTGTCACTCAAACTAGCTGACCCAA<br>TAGCCATCGTCAATGGGAATGTCTCACTCAAAGTGGGAGGGGTCTCACTTTGC<br>AAGATGGAACTGGAAAACTAACAGTCAATGCTGATCCACCTTTGCAACTTACAA<br>ACAACAAATTAGGGATTGCTTTGGACGCTCCATTTGATGTTATAGATAATAAACT<br>CACGTTGTTAGCGGGCCATGGCTTGTCTATTATAACAAAAGAAACATCAACACT<br>GCCTGGCTTGATTAATACTCTTGTAGTATTAACTGGAAAGGGTATTGGAACAGA<br>ATCAACAGATAATGGCGGAAGCGTATGTGTTAGAGTTGGAGAAGGTGGCGGCTT<br>ATCATTTAATAATGATGGAGACTTGGTAGCATTTAATAAAAAAGAAGATAAGCG<br>CACCCTATGGACAACTCCAGACACATCTCCAAATTGCAAGATTGATCAGGATAA<br>GGACTCTAAGTTAACTCTGGTCCTTACAAAGTGTGGAAGTCAAATATTGGCTAAT<br>GTGTCATTAATTGTCGTAGCTGGTAAGTACAAAATTATCAATAACAATACTCAAC<br>CAGCTCTCAAAGGATTTACCATTAAATTATTGTTTGATGAAAATGGAGTACTTAT<br>GGAATCTTCAAATCTTGGTAAATCATATTGGAACTTTAGAAATGAAAATTCAATT<br>ATGTCAACAGCTTATGAAAAGCTATTGGATTCATGCCTAATTTGGTAGCCTATC<br>CAAAACCTACCGCTGGCTCTAAAAAATATGCAAGAGATATAGTTTATGGAAACA<br>TCTACCTTGGTGGAAAGCCAGATCAACCAGTAACCATTAAAACTACCTTTAATCA<br>GGAAACTGGATGTGAATATTCTATCACATTTGATTTTAGTTGGGCCAAGACTTAT<br>GTAAATGTTGAATTTGAAACAACCTCTTTTACCTTTTCCTATATCGCCCAAGAAT<br>GAAAGACCAATAAACGTGTTTTTCATTTCAAAATTTTCATGTATCTTTATTGATTT<br>TTACACCAGCACGGGTAGTCAGTCTCCCACCACCAGCCCATTTCACAGTATAAAC<br>AATTCTCTCAGCACGGGTGGCCTTAAATAGGGAAATGTTCTGATTAGTGCGGGA<br>ACTGGACTTGGGGTCTATAATCCACACAGTTTCCTGGCGAGCCAAGCGGGGATC<br>GGTGATTGAGATGAAGCCGTCCTCTGAAAAGTCATCCAAGCGGGCCTCACAGTC<br>CAAGGTCACAGTCTGGTGGAATGAGAAGAACGCACAGATTCATACTCGGAAAAC<br>AGGATGGGTCTGTGCCTCTCCATCAGCGCCCTCAGCAGTCTCTGCCGTCGGGGCT<br>CTGTGCGGCTGCTGCAGATGGGATCGGGATCGCAAGTCTCTCTGACTATGATCCC<br>CACAGCCTTCAGCATCAGCCTCCTGGTGCGACGGGCACAGCACCGCATCCTGAT<br>CTCTGCCATGTTCTCACAGTAAGTGCAGCACATAATCACCATGTTATTCAGCAGC<br>CCATAATTCAGGGTGCTCCAGCCAAAGCTCATGTTGGGGATAATGGAACCCACG<br>TGACCATCGTACCAGATGCGGCAGTATATCAGGTGCCTGCCCCTCATAAACACA<br>CTGCCCATATACATGATCTCTTTGGGCATGTTTCTGTTCACAATCTGACGGTACC<br>AGGGGAAGCGCTGGTTGAACATGCACCCGTAAATGACTCTCCTGAACCACACGG<br>CCAGCAGGGTGCCTCCCGCCCGA |
| SEQ ID NO: 1449 | CATCATCAATAATATACCTTATAGATGGAATGGTGCCAATATGTAAATGAGGTG<br>ATTTTAAAAAGTGTGGGCTGTGTGGTAATTGGCTGTGGGGTTAACGGCTAAAAG<br>GGGCGGCGCGGCCGTGGGAAAATGACGTTTTTTGGGGGTGGAGTGTTTTTGCAA<br>GTTGTCGCGGTAAATGTGACGTAAACAAAGGCTTTTTTTCTCACGGAACTACTTA<br>GTGTTCCCACGGTATTTAACAGGAAATGAGGTAGTTTTGGCCGGATGCAAGTAA<br>AAATTGTTCATTTTCGCGCGAAAACTAAATGAGGAAGTGGTTTTCTGAATAATGC<br>GGTATTTATGGCAGGGTGGAGTATTTGTTCAGGGCCAGGTAGACTTTGACCCATT<br>ACGTGGAGGTTTCGATTACCGCGGAGGTTTCGATTACCGTGTTTTTTACCTAAAT<br>TTCCGCGTACCGTGTGAAAGTCTTCTGTTTTTACGTAGGTGTCAGCTGATCGCTA<br>CGGTATTTATACCTCAGGGTTTGTGTCAAGAGGCCACTCTTGAGTGCCAGCGAGA<br>AGAGTTTTCTCCTCTGCGCCGGCAGTTTAATATTAAAAAAATGAGACACTTGCGA<br>TTTCTGCCTCAGGAAATAATTTCTGCTGAGACTGGAAACGAAATACTGGAGTTTG<br>TGGTGCACGCCCTGATGGGAGACGATCCGGAGCCACCTGTGCAGCTTTTTGAGC<br>CTCCTACGCTTCAGGAACTGTATGATTTAGAGGTAGAGGGATCGGAGGATTCTA<br>ATGAGGAAGCTGTGAATGGCTTTTTTACCGATTCTATGCTTTTAGCTGCTAATGA<br>AGGATTAGAATTAGATCCGCCTTTGGACACTTTCGATACTCCAGGGGTGATTGTG<br>GAAAGCGGTACAGGTGTAAGAAAATTACCTGATTTGGGTTCCGTGGACTGTGAT<br>TTGCACTGCTATGAAGACGGGTTTCCTTTGAGTGATGAGGAGGACCGTGAAAAG<br>GAGCAGTTTATGCAGACTGCAGCGGGTGAGGGAGTGAAGGCTGCCAGTGTTGGT<br>TTTCAGTTGGATTGCCCGGAGCTTCCTGGACATGGCTGTAAGTCTTGTGAATTTC<br>ACAGGAAAAATACTGGAGTAAAGGAACTGTTATGTTCGCTTTGTTATATGAGAG<br>CGCACTGCCACTTTATTTACAGTAAGTGTGTTTAAGTTAAAATTTAAAGGAATAT<br>GCTGTTTTTCACATGTATATTGAGTGGGAGATTTGTGCTTCTTATTATAGGTCCTG<br>TGTCTGATGCTGATGAGTCACCATCTCCTGATTCTACTACCTCACCTCCTGAGATT<br>CAAGCACCTGTTCCTGTGGACGTGCACAAGCCCATTCCTGTAAAGCTTAAGCCTG<br>GAAAACGTCCAGCAGTGGAAAAACTTGAGGACTTGTTACAGGGTGGGGACGGA<br>CCTTTGGACTTGAGTACACGGAAACGGCCAAGACAATAAGTGTTTACTTAAGGT<br>GACGTCAATATTTGTGTGAGAGTGCAATGTAATAAAAATATGTTAACTGTTCACT<br>GGTTTTTATTGCTTTTTGGGCGGGACTCAGGTATATAAGTAGAAGCAGACCTGT<br>GTGGTTAGCTCATAGAAGCTGGCTTTGATTCATGGAGGTTTGGGCCATTTTGGAA<br>GACCTTAGAAAGACTAGGCAACTGTTAGAGAACGCTTCGGACGGAGTCTCCGGT<br>TTTTGGAGATTCTGGTTCGCTAGTGAAATAGCTAGGGTAGTTTTTAGGATAAAAC<br>AGGACTATAAAGAAGAATTTGAAAAGTTGTTGGTAGATTGCCCAGGACTTTTTG<br>AAGCTCTTAATTTGGGTCATCAAGTTCACTTTAAAGAAAAAGTTTTATCAGTTTT |

TABLE 7-continued

Nucleic Acid Sequences of Vectors

SEQ ID NO Sequence

```
AGACTTTTCGACCCCAGGTAGAACTGCTGCTGCTGTGGCTTTTCTTACTTTTATAT
TAGATAAATGGATCCCGCAGACTCATTTCAGCAGGGGATACGTTTTGGATTTCGT
AGCCACAGCATTGTGGAGAACATGGAAGGTTCGCAAGATGAGGACAATCTTAGG
TTACTGGCCAGTGCAGCCTTTGGGTGTAGCGGGAATCCTGAGGCATCCACCGGT
CATGCCAGCGGTTCTGGAGGAGGAACAGCAAGAGGACAACCCGAGAGCCGGCC
TGGACCCTCCAGTGGAGGAGGCGGAGTAGCTGACTTGTCTTCTGAACTGCAACG
GGTGCTTACTGGATCTACGTCCACTGGACGGGATAGGGGCGTTAAAAGGGAGAG
GGCATCTAGTGGTACTGATGCTAGATCTGAGTTGGCTTTAAGTTTAATGAGTCGC
AGACGTCCTGAAACCATTTGGTGGCATGAGGTCCAGAAAGAGGGAAGGGATGA
AGTTTCTGTATTGCAGGAGAAATATTCACTGGAACAGGTGAAAACATGTTGGTT
GGAGCCTGAGGATGATTGGGAGGTGGCCATTAAAAATTATGCCAAGATAGCTTT
GAGGCCTGATAAACAGTATAAGATTACTAGACGGATTAATATCCGGAATGCTTG
TTACATATCTGGAAATGGGGCTGAGGTGGTAATAGATACTCCAGACAAGACAGT
TATTAGATGCTGCATGATGGATATGTGGCCTGGAGTAGTCGGTATGGAAGCAGT
AACTTTTGTAAATGTTAAGTTTAGGGGAGATGGTTATAATGGAATAGTGTTTATG
GCCAATACCAAACTTATATTGCATGGTTGTAGCTTTTTTGGTTTTAACAATACCT
GTGTAGATGCCTGGGGACAGGTTAGTGTACGGGGATGTAGTTTCTATGCGTGTTG
GATTGCCACAGCTGGCAGAACCAAGAGTCAATTGTCTCTGAAAAAATGCATATT
CCAAAGATGTAACCTGGGCATTCTTAATGAAGGCGAAGCAAGGGTCCGCCACTG
CGCTTCTACAGATACTGGATGTTTTATTTTAATTAAGGGCAATGCCAGCGTAAAG
CATAACATGATTTGCGGTGCTTCCGATGAGAGGCCTTATCAAATGCTCACTTGTG
CCGGTGGGCATTGTAACATGCTGGCTACTGTGCATATTGTTTCTCATCAACGCAA
AAAATGGCCTGTTTTTGATCACAATGTGTTGACCAAGTGTACCATGCATGCAGGT
GGGCGTAGAGGAATGTTTATGCCTTACCAGTGTAACATGAATCATGTAAAAGTG
TTGTTAGAACCAGATGCCTTTTCCAGAATGAGTCTAACAGGAATGTTTGACATGA
ACATGCAAATCTGGAAGATCCTGAGGTATGATGATACAAGATCGAGGGTGCGCG
CATGCGAATGCGGAGGCAAGCATGCCAGGTTCCAACCGGTGTGTGTAGATGTGA
CTGAAGATCTGAGACCGGATCATTTGGTTATTGCCCGCACTGGAGCAGAGTTCG
GATCCAGTGGAGAAGAAACTGACTAAGGTGAGTATTGGGAAAACTTTGGGGTGG
GATTTTCAGATGGACAGATTGAGTAAAAATTTGTTTTTCTGTCTTGCAGCTGTCA
TGAGTGGAAACGCTTCTTTTAATGGGGGAGTCTTCAGCCCTTATCTGACAGGGCG
TCTCCCATCCTGGGCAGGAGTTCGTCAGAATGTTATGGGATCTACTGTGGATGGA
AGACCCGTCCAACCCGCCAATTCTTCAACGCTGACCTATGCTACTTTAAGTTCTT
CACCTTTGGACCCAGCTGCAGCCGCCGCTGCCGCCTCTGTTGCCGCTAACACTGT
GCTTGGAATGGGTTACTATGGAAGCATCCTGGCTAATTCCACTTCCTCTAATAAC
CCTTCTACCCTGACTCAGGACAAGTTACTTGTCCTTTTGGCCCAGCTGGAGGCTT
TGACCCAACGTCTGGGTGAACTTTCTCAGCAGGTGGCCGAGTTGCGAGTACAAA
CTGAGTCTGCTGTTGGCACGGCAAAGTCTAAATAAAAAAATTCCAGAATCAATG
AATAAATAAACGAGCTTGTTGTTGATTTAAAATCAAGTGTTTTTTATTTCATTTTT
CGCGCACGGTATGCCCTAGACCACCGATCTCGATCATTGAGAACACGGTGGATT
TTTTCCAAAATCCTATAAAGGTGGGATTGAATGTTTAGATACATGGGCATTAGGC
CGTCTTTGGGGTGGAGATAGCTCCATTGAAGGGATTCATGCTCCGGGGTAGTGTT
GTAAATTACCCAGTCATAACAAGGTCGCTGTGCATGGTGTTGCACAATATCTTTT
AGAAGTAGGCTGATTGCCACAGATAAGCCCTTGGTGTAGGTGTTTACAAACCGG
TTGAGCTGGGAGGGGTGCATTCGGGGTGAAATTATGTGCATTTTGGATTGGATTT
TTAAGTTGGCAATATTGCCGCCAAGATCTCGTCTTGGGTTCATGTTATGAAGTAC
CACCAAGACGGTGTATCCGGTACATTTAGGAAATTTATCGTGCAGCTTGGATGG
AAAAGCGTGGAAAAATTTGGAGACACCCTTGTGTCCTCCGAGATTTTCCATGCA
CTCATCCATGATAATAGCAATAGGGCCGTGGGCAGCAGCGCGGGCAAACACGTT
CCGTGGGTCTGACACATCATAGTTATGTTCCTGAGTTAAATCATCATAGGCCATT
TTAATAAATTTGGGACGGAGAGTACCCGATTGGGGTATGAATGTTCCTTCGGGC
CCCGGAGCATAGTTCCCCTCACAGATTTGCATTTCCCAAGCTTTCAGTTCCGAGG
GTGGAATCATGTCCACCTGGGGGGCTATAAAGAACACCGTTTCTGGGGCTGGAG
TAATTAGTTGGGATGATAGCAAGTTTCTGAGCAATTGAGATTTGCCACATCCGGT
GGGGCCATAAATGATTCCGATTACAGGTTGCAGTTGGTAGTTTAGGGAACGGCA
ACTGCCGTCTTCTCGAAGCAAGGGGGCCACCTCGTTCATCATTTCCCTTACATGC
ATATTTTCCCGCACCAAATCCATTAGGAGGCGCTCTCCTCCTAGTGATAGAAGTT
CTTGTAGTGAGGAAAAGTTTTTCAGCGGTTTTAGCCGTCAGCCATGGGCATTTT
GGAGAGAGTCTGTTGCAAAAGTTCTAGTCTGTTCCACAGTTCAGTGATGTGTTCT
ATGGCATCTCGATCCAGCAGACCTCCTCGTTTCGCGGGTTTGGACGGCTCCTGGA
GTAGGGTATGAGACGATGGGCGTCCAGCGCTGCCAGGGTTCGGTCCTTCCAGGG
TCTCAAAGTTCGGGTCAGGGTTGTTTCCGTCACAGTGAAGGGGTGTGCGCCTGCT
TGGGCGCTTGCCAGGGTGCGCTTCAGACTCATCCTGCTGGTCGAAAACTTGTGCC
GCTTGGCGCCCTGTATGTCGGCCAAGTAGCAGTTTACCATGAGTTCGTAGTTGAG
CGCCTCGGCTGCGTGGCCCTTGGCGCGGAGCTTACCTTTGGAAGTTTTCTTGCAT
ACCGGGCAGTATAGGCATTTCAGCGCATACAGCTTGGGCGCAAGGAAAATGGAT
TCTGGGGAGTATGCATCCGCGCCGCAGGAGGCGCAAACAGTTTCACATTCCACC
AGCCAGGTTAAATCCGGTTCATTGGGGTCAAAAACAAGTTTTCCGCCATATTTTT
TGATGCGTTTCTTACCTTTGGTCTCCATGAGTTGGTGTCCTCGTTGAGTGACAAA
CAGGCTGTCCGTGTCCCGTAGACTGATTTTACAGGCCTCTTTTCCAGTGGAGTG
CCTCGGTCTTCTTCGTATAGGAACTCTGACCACTCTGATACAAAGGCGCGCGTCC
AGGCCAGCACAAAGGAGGCTATGTGGGAGGGGTAGCGATCGTTGTCAACCAGG
GGGTCCACCTTTTCCAAAGTATGCAAACACATGTCACTCTTCAACATCCAGGA
ATGTGATTGGCTTGTAGGTGTATTTCACGTGACCTGGGGTCCCAGCTGGGGGGT
ATAAAAGGGGGCGGTTCTCTGCTCTTCCTCACTGTCTTCCGGATCGCTGTCCAGG
AACGTCAGCTGTTGGGGTAGGTATTCCCTCTCGAAGGCGGGCATGACCTCTGCA
```

TABLE 7-continued

Nucleic Acid Sequences of Vectors

SEQ ID NO Sequence

CTCAGGTTGTCAGTTTCTAAGAACGAGGAGGATTTGATATTGACAGTGCCGCTTG
AGATGCCTTTCATGAGGTTTTCGTCCATTTGGTCAGAAAACACAATTTTTTATTG
TCAAGTTTGGTGGCAAATGATCCATACAGGGCGTTGGATAAAAGTTTGGCAATG
GATCGCATGGTTTGGTTCTTTTCCTTGTCCGCGCTCTTTGGCAGCGATGTTGAG
TTGGACATACTCGCGTGCCAGGCACTTCCATTCGGGGAAGATAGTTGTCAATTCA
TCTGGCACAATTCTCACTTGCCACCCTCGGTTATGCAAGGTAATTAAATCCACAC
TGGTGGCCACCTCGCCTCGAAGGGGTTCGTTGGTCCAGCAGAGCCTACCTCCTTT
CCTAGAACAGAAAGGTGGAAGTGGGTCTAGCATAAGTTCATCGGGAGGGTCTGC
ATCCATGGTAAAGATTCCAGGAAGTAAATCCTTATCAAAATAGCTGATGGGAGT
GGGGTCATCTAAGGCCATTTGCCATTCTCGAGCTGCCAGTGCGCGCTCATATGGG
TTAAGGGGACTGCCCCAGGGCATGGGATGGGTGAGTGCAGAGGCATACATGCCA
CAGATGTCATAGACGTAGATGGGATCCTCAAAGATGCCTATGTAGGTTGGATAG
CATCGCCCCCTCTGATACTTGCTCGCACATAGTCATATAGTTCATGTGACGGCG
CTAGCAGCCCCGGACCCAAGTTGGTGCGATTGGGTTTTTCTGTTCTGTAGACAAT
CTGGCGAAAGATGGCGTGAGAATTGGAAGAGATGGTGGGTCTTTGAAAAATGTT
GAAGTGGGCATGAGGTAGACCTACAGAGTCTCTGATAAAGTGGGCATAAGATTC
TTCAAGCTTGGTTACCAGTTCGGCAGTGACAAGTACGTCCAGGGCGCAGTAGTC
AAGTGTTTCTTGAATGATGTCATAACCTGGTTGGTTTTTCTTTTCCCACAGTTCGC
GGTTCAGAAGGTATTCTTCGCGATCCTTCCAGTACTCTTCTAGCGGAAACCCGTC
TTTGTCTGCACGGTAAGATCCTAGCATGTAGAACTGATTAACTGCCTTGTAAGGG
CAGCAGCCCTTCTCTACGGGTAGAGAGTATGCTTGAGCAGCTTTTCGTAGCGAA
GCGTGAGTAAGGGCGAAGGTGTCTCTAACCATGACTTTGAGAAATTGGTATTTA
AAGTCCATGTCGTCACAGGCTCCCTGTTCCCAGAGTTGGAAGTCTACCCGTTTCT
TGTAGGCGGGGTTGGGCAAAGCGAAAGTAACATCGTTGAAGAGAATCTTACCGG
CTCTGGGCATAAAATTGCGAGTGATGCGAAAAGGCTGTGGTACTTCCGCTCGAT
TGTTGATCACCTGGGCAGCTAGGACGATCTCGTCGAAGCCGTTGATGTTGTGTCC
TACAATGTATAATTCTATGAAACGCGGCGTGCCTCTGACGTGAGGTAGCTTATTG
AGCTCATCAAAGGTTAGGTCTGTAGGGTCAGATAAGGCGTAGTGTTCAAGGGCC
CATTCGTGCAGATGAGGATTTGCATGTAGGAATGATGACCAAAGATCCACCGCC
AGTGCTGTTTGTAACTGGTCCCGATACTGACGAAAATGCTGGCCAATTGCCATTT
TTTCTGGAGTGACACAGTAGAAGGTTTCGGGATCTTGTTGCCATCGATCCCACTT
AAGTTTAATGGCTAGATCGTGGGCCATGTTGACGAGACGCTCTTCTCCTGAGAGT
TTCATGACCAGCATGAAAGGAACTAGTTGTTTGCCAAAGGACCCCATCCAGGTG
TAAGTTTCCACATCGTAGGTCAGGAAGAGTCTTTCTGTGCGAGGATGAGAGCCG
ATCGGGAAAAACTGGATTTCCTGCCACCAGTTGGAGGATTGGCTGTTGATGTGA
TGGAAGTAGAAGTTTCTGCGGCGCGCCGAGCATTCGTGTTTGTGCTTGTACAGAC
GGCCGCAGTAGTCGCAGCGTTGCACGGGTTGTATCTCGTGAATGAGCTGTACCT
GGCTTCCCTTGACGAGAAATTTCAGTGGGAAGCCGAGGCCTGGCGATTGTATCT
CGTGCTCTTCTATATTCGCTGTATTGGCCTGTTCATCTTCTGTTTCAATGGTGGTC
ATGCTGACGAGCCCCGCGGGAGGCAAGTCCAGACCTCGGCGCGGGAGGGGCG
GAGCTGAAGGACGAGAGCGCGCAGGCTGGAGCTGTCCAGAGTCCTGAGACGCT
GCGGACTCAGGTTAGTAGGTAGGGACAGAAGATTAACTTGCATAATCTTTTCCA
GGGCGTGCGGGAGGTTTAGATGGTACTTGATTTCCACAGGTTCGTTTGTAGAGAC
GTCAATGGCTTGCAGGGTTCCGTGTCCTTTGGGTGCCACTACCGTACCTTTGTTTT
TTCTTTTGATCGGCGGTGGCTCTCTTGCTTCTTGCATGCTTAAAAGCGGTGACGG
GGACGCGCGCCGGGCGGCAGCGGTTGTTCCGGACCCGGGGGCATGGCTGGTAGT
GGCACGTCGGCGCCGCGCACGGGCAGGTTCTGGTACTGCGCTCTGAGAAGACTT
GCGTGCGCCACCACGCGTCGATTGACGTCTTGTATCTGACGTCTTTGGGTGAAAG
CTACCGGCCCCGTGAGCTTGAACCTGAAAGAGAGTTCAACAGAATCAATTTCGG
TATCGTTAATAGCAGCTTGTCTCAGTATTTCTTGTACGTCACCAGAGTTGTCCTG
GTAGGCGATCTCCGCCATGAACTGCTCGATTTCTTCCTCCTGAAGATCTCCGCGA
CCCGCTCTCTCGACGGTGGCCGCGAGGTCATTGGAGATACGGCCCATGAGTTGG
GAGAATGCATTCATGCCCGCCTCGTTCCAGACGCGGCTGTAAACCACGGCCCCC
TCGGAGTCTCTTGCGCGCATCACCACCTGAGCGAGGTTAAGCTCCACGTGTCTGG
TGAAGACCGCATAGTTGCATAGGCGCTGAAAAAGGTAGTTGAGTGTGGTGGCGA
TGTGTTCGGCGACAAAGAAATACATGATCCATCGTCTCAGCGGCATTTCGCTGAC
ATCGCCCAGAGCTTCCAAGCGCTCCATGGCCTCGTAGAAGTCCACGGCAAAATT
AAAAAACTGGGAGTTTCGCGCGGACACGGTCAATTCCTCCTGAGAAGACGGAT
GAGTTCGGCTATGGTGGCCCGTACTTCGCGTTCAAAGGCTCCCGGCATCTCTTCT
TCCTCTTCTATCTCTTCTTCCACTAACATCTCTTCTTCGTCCTTCAGGCGGGGCGG
AGGGGGCACGCGGCGACGTCGACGGCGCACGGGCAAACGGTCGATGAATCGTT
CAATGACCTCTCCGCGGCGGCGGCGCATGGTTTCAGTGACGGCGCGGCCGTTCT
CGCGCGGTCGCAGAGTAAAAACACCGCCGCGCATCTCCTTAAAGTGGTGACTGG
GAGGTTCTCCGTTTGGGAGGGAAAGGGCGCTGATTATACATTTTATTAATTGGCC
CGTAGGGACTGCGCGCAGAGATCTGATCGTGTCAAGATCCACGGGATCTGAAAA
CCTTTCAACGAAAGCGTCTAACCAGTCACAGTCACAAGGTAGGCTGAGTACGGC
TTCTTGTGGGCGGGGTGGTTATGTGTTCGGTCTGGGTCTTCTATTCCTTCTTCAT
CTCGGGAAGGTAAGACGATGCTGCTGGTGATGAAATTAAAGTAGGCAGTTCTAA
GACGGCGGATGGTGGCGAGGAGCACCAGGTCTTTGGGTCCGGCTTGCTGGATAC
GCAGGCGATTGGCCATTCCCCAAGCATTATTCTGACATCTAGCCAGATCTTTGTA
GTAGTCTTGCATCAGCCGTTCTACGGGCACTTCTTCTTCACCCGTTCTGCCATGCA
TACGTGTGAGTCCAAACCCGCGCATTGGTTGGACCAGTGCCAAGTCAGCTACGA
CTCTTTCGGCGAGGATGGCTTGCTGTACTTGGGTGAGGGTGGCTTGAAAGTCATC
AAAATCCACGAAGCGGTGGTAAGCCCCGGTATTGATGGTGTAAGCACAGTTGGC
CATGACTGACCAGTTAACTGTTTGGTGACCAGGGCGCACGAGCTCGGTGTATTTA
AGGCGCGAATAGGCGCGGGTGTCAAAGATGTAATCGTTGCAGGTGCGCACCAGA

TABLE 7-continued

Nucleic Acid Sequences of Vectors

SEQ ID NO Sequence

```
TACTGGTACCCTATAAGAAAATGCGGTGGTGGTTGGCGGTAGAGAGGCCATTGT
TCTGTAGCTGGAGCGCCGGGGGCGAGGTCTTCCAACATAAGGCGGTGATAGCCG
TAAATGTACCTGGACATCCAGGTGATTCCTGCGGCGGTAGTGGAAGCCCGAGGA
AACTCGCGTACGCGGTTCCAAATGTTGCGTAGCGGCATGAAGTAGTTCATTGTA
GGCACGGTTTGACCAGTGAGGCGCGCGCAGTCATTGATGCTCTATAGACACGAA
GAAAATGAAAGCGTTCAGCGACTCGACTCTGTAGCCTGGAGGAACGTGAACGGG
TTGGGTCGCGGTGTACCCCGGTTCAAGACTTGTACTCGAGCCGGCCGGAGCCGC
GGCTAACGTGGTATTGGCACTCCCGTCTCGACCCAGCCTACAAAAATCCAGGAT
ACGGAATCGAGTCGTTTTGCTGGTTGCTGAATGGCAGGGAAGTGAGTCCTATTTT
TTTTTTTGCCGCTCAGATGCATCCCGTGCTGCGACAGATGCGTCCCCAACAACAG
CCCCCCTCGCAGCAGCAGCAACCACAAAAGGCTGTCCCTGCAACTACTGCAACT
GCCGCCGTGAGCGGTGCGGACAGCCCGCCTATGATCTGGACTTGGAAGAGGGC
GAAGGACTGGCACGTCTAGGTGCGCCCTCGCCCGAGCGGCATCCGCGAGTTCAA
CTGAAAAAGATTCTCGCGAGGCGTATGTGCCCCAACAGAACCTATTTAGAGAC
AGAAGCGGCGAGGAGCCAGAGGAGATGCGAGCTTCCCGCTTTAACGCGGGTCGT
GAGCTGCGTCACGGTTTGGACCGAAGACGAGTGTTGCGGGACGAGGATTTCGAA
GTTGATGAAGTGACAGGGATCAGTCCTGCCAGGGCACACGTGGCTGCAGCCAAC
CTTGTATCGGCTTACGAGCAGACAGTAAAGGAAGAGCGTAACTTCCAAAAGTCT
TTTAATAATCATGTGCGAACCCTGATTGCCCGCGAAGAAGTTACCCTTGGTTTGA
TGCATTTGTGGGATTTGATGGAAGCTATCATTCAGAACCCTACTAGCAAACCTCT
GACCGCACAGCTGTTTCTGGTGGTGCAACACAGCAGAGACAACGAGGCTTTCAG
AGAGGCGCTGCTCAACATCACTGAACCCGAGGGGAGATGGTTGTATGATCTTAT
CAACATTTTACAGAGTATCATAGTGCAGGAGCGGAGCCTGGGCCTGGCCGAAAA
GGTGGCTGCCATCAATTACTCGGTTTTAAGTTTGGGAAAATATTACGCTCGCAAG
ATCTACAAGACTCCATACGTTCCCATAGACAAGGAGGTGAAGATAGATGGGTTC
TACATGCGCATGACGCTCAAGGTCTTGACCCTGAGCGATGATCTTGGGGTGTACC
GCAATGACAGAATGCATCGCGCCGTGAGCGCCAGTAGGAGGCGCGAGTTAAGC
GACAGGGAACTGATGCACAGTTTGCAAAGAGCTCTGACTGGAGCTGGAACAGA
GGGTGAGAATTACTTTGACATGGGAGCTGACTTGCAGTGGCAGCCTAGTCGCAG
GGCTCTAAGCGCCGCGACGGCAGGATGTGAGCTTCCTTACATAGAAGAGGCGGA
TGAAGGCGAGGAGGAAGAGGGCGAGTACTTGGAAGACTGATGGCGCAACCCGT
GTTTTTTGCTAGATGGAACAGCAAGCACCGGATCCCGCAATGCGGGCGGCGCTG
CAGAGCCAGCCGTCCGGCATTAACTCCTCGGACGATTGGACCCAGGCCATGCAA
CGTATCATGGCGTTGACGACTCGCAACCCCGAAGCCTTTAGACAGCAACCCCAG
GCCAACCGTCTATCGGCCATCATGGAAGCTGTAGTGCCTTCCCGCTCTAATCCCA
CTCATGAGAAGGTCCTGGCCATTGTGAACGCGTTGGTGGAGAACAAAGCTATTC
GTCCAGATGAGGCCGGACTGGTATACAACGCTCTTTTAGAACGCGTGGCTCGCT
ACAACAGTAGCAATGTACAAACCAATTTGGACCGTATGATAACAGATGTACGCG
AAGCCGTGTCTCAGCGTGAAAGGTTCCAGCGCGACGCCAACCTGGGTTCGCTAG
TGGCGTTAAATGCTTTTTTGAGTACTCAGCCTGCTAATGTGCCGCGTGGTCAACA
GGATTATACTAACTTTTTGAGTGCGTTGAGACTGATGGTATCTGAAGTACCTCAG
AGCGAAGTGTATCAGTCCGGACCTGACTACTTCTTTCAGACTAGCAGACAGGGT
TTGCAGACGGTAAATCTGAGCCAAGCTTTTAAAAACCTTAAAGGTTTGTGGGGA
GTGCATGCCCCGGTAGGAGAAAGAGCAACCGTGTCTAGCCTTGTTAACTCCAAAC
TCCCGCCTACTACTACTGTTGGTAGCTCCTTTCACCGACAGCGGCAGCATCGACC
GTAATTCCTATTTGGGTTACCTACTAAACCTGTATCGCGAAGCCATAGGGCAAAG
CCAGGTGGACGAGCAGACCTATCAAGAAATTACCCAAGTCAGTCGCGCTTTGGG
TCAGGAAGACACTGGCAGTTTGGAAGCCACTCTGAACTTCTTGCTTACCAATCGG
TCTCAGAAGATCCCTCCTCAATATGCTCTTACTGCGGAGGAGGAGAGGATCCTTA
GATATGTGCAGCAGAGCGTGGGATTGTTTTTGATGCAAGAGGGGGCAACTCCGA
CTGCGGCATTGGACATGACAGCGCGAAATATGGAGCCCAGCATGTATGCCAGTA
ACCGGCCTTTCATTAACAAACTGCTAGACTACTTGCACAGAGCTGCCGCTATGAA
CTCTGATTATTTTACCAATGCCATCTTAAACCCGCACTGGCTGCCCCCACCTGGT
TTCTACACGGGCGAATATGACATGCCCGACCCTAATGACGGGTTTCTGTGGGAC
GACGTGGACAGTAATGTTTTTTCACCTCTTTTTGATCATCGCACGTGGAAAAAGG
AAGGCGGCGATAGAATGCATTCTTCTGCATCGCTGTCCGGGGTCATGGGTGCTA
CCGCGGCTGAGCCCGAGTCTGCAAGTCCTTTTCCTAGTCTACCCTTTTCTTTACAC
AGTGTACGTAGCAGCGAAGTGGGTAGAATAAGTCGCCCGAGTTTAATGGGCGAA
GAGGAATACCTAAACGATTCCTTGCTTAGACCGGCGAGAGAAAAAAATTTCCCA
AACAATGGAATAGAAAGTTTGGTGGATAAGATGAGTAGATGGAAGACTTATGCT
CAGGATCACAGAGACGAGCCTGGGATCATGGGGACTACAAGTAGAGCGAGCCG
TAGACGCCAGCGTCATGACAGACAGAGGGGTCTTGTGTGGGAAGATGAGGATTC
GGCCGATGATAGCAGCGTGTTGGACTTGGGTGGGAGAGGAAGGGGCAACCCGTT
TGCTCATTTGCGCCCTCGCTTGGGTGGTATGTTGTAAAAAAAAATAAAAAGGAA
AACTCACCAAGGCCATGGCGACGAGCGTACGTTCGTTCTTCTTTATTATCTGTGT
CTAGTATAATGAGGCGAGTCGTGCTAGGCGGAGCGGTGGTGTATCCGGAGGGTC
CTCCTCCTTCGTACGAGAGCGTGATGCAGCAGCAGGCGACGGCGGTGATGCAAT
CCCCACTGGAGGCTCCCTTTGTACCTCCGCGATACCTGGCACCTACGGAGGGCA
GAAACAGCATTCGTTACTCGGAACTGGCACCTCAGTACGATACCACCAGGTTGT
ATCTGGTGGACAACAAGTCGGCGGACATTGCTTCTCTGAACTATCAGAATGACC
ACAGCAACTTCTTGACCACGGTGGTGCAGAACAATGACTTTACCCCTACGGAGG
CCAGTACCCAGACCATTAACTTTGATGAACGATCGCGGTGGGCGGTCAGCTAA
AGACCATCATGCATACTAACATGCCCAACGTAAACGAGTATATGTTTAGTAACA
ACTTCAAAGCGCGTGTGATGGTGTCCAGAAAACCTCCCGAAGGTGCTGCAGTTG
GGGATACATATGATCACAAGCAGGATATTTTGGAATATGAGTGGTTTGAGTTTA
CTTTGCCAGAAGGCAACTTTTCAGTTACTATGACCATTGATTTGATGAACAATGC
```

TABLE 7-continued

Nucleic Acid Sequences of Vectors

SEQ ID NO Sequence

CATCATAGATAACTACTTGAAAGTGGGCAGACAGAATGGAGTGCTTGAAAGTGA
CATTGGTGTTAAGTTCGACACCAGGAACTTCAAGCTGGGATGGGATCCCGAAAC
CAAGTTGATTATGCCTGGAGTGTATACGTATGAAGCCTTTCATCCTGACATTGTC
TTACTGCCTGGCTGTGGAGTGGACTTTACCGAAAGTCGTTTGAGCAACCTTCTTG
GTATCAGAAAAAAACAGCCATTTCAAGAGGGTTTTAAGATTTTGTATGAAGATT
TAGAAGGAGGTAATATTCCGGCCCTCTTGGATGTAGATGCCTATGAGAACAGTA
AGAAAGAACAAAAAGCCAAAATAGAAGCTGCTGCGGAAGCTAAGGCAAACATA
GTTGCCAGCGACTCTACAAGGGTTGCTAACGCTGGAGAGGTCAGAGGAGACAAT
TTTGCACCAACACCTGTTCCGACTGCAGAATCATTATTGGCCGATGTATCTGGAG
GAACGGACGTGAAACTCACTATTCAACCTGTAGAAAAAGATAGTAAGAATAGA
AGCTATAATGTGTTGGAAGATAAAATCAACACAGCCTATCGCAGTTGGTACCTTT
CGTACAATTATGGCGATCCCGAAAAAGGAGTGCGTTCCTGGACATTGCTCACCA
CCTCAGATGTCACCTGCGGAGCAGAGCAGGTCTACTGGTCGCTTCCAGACATGA
TGCAGGATCCTGTCACTTTCCGCTCCACTAGACAAGTCAGCAACTACCCTGTGGT
GGGTGCAGAGCTTATGCCCGTCTTCTCAAAGAGCTTCTACAACGAACAAGCTGT
GTACTCCCAGCAGCTCCGCCAGTCCACCTCGCTTACGCACGTCTTCAACCGCTTT
CCTGAGAACCAGATTTTAATCCGTCCGCCGGCGCCCACCATTACCACCGTCAGTG
AAAACGTTCCTGCTCTCACAGATCACGGGACCCTGCCGTTGCGCAGCAGTATCC
GGGGAGTCCAACGTGTGACCGTTACTGACGCCAGACGCCGCACCTGTCCCTACG
TGTACAAGGCACTGGGCATAGTCGCACCGCGCGTCCTTTCAAGCCGCACTTTCTA
AAAAAATGTCCATTCTTATCTCGCCCAGTAATAACACCGGTTGGGGTCTGCGCGC
TCCAAGCAAGATGTACGGAGGCGCACGCAAACGTTCTACCCAACATCCCGTGCG
TGTTCGCGGTCATTTTCGCGCTCCATGGGGTGCCCTCAAGGGCCGCACTCGCGTT
CGAACCACCGTCGATGATGTAATCGATGAGGTGGTTGCCGACGCCCGTAATTAT
ACTCCTACTGCGCTACATCTACTGTGGATGCAGTTATTGACAGTGTAGTGGCTG
ACGCTCGCAACTATGCTCGACGTAAGAGCCGGCGAAGGCGCATTGCCAGACGCC
ACCGAGCTACCACTGCCATGCGAGCCGCAAGAGCTCTGCTACGAAGAGCTAGAC
GCGTGGGACGAAGAGCCATGCTTAGGGCGGCCAGACGTGCAGCTTCGGGCGCCA
GCGCCGGCAGGTCCCGCAGGCAAGCAGCCGCTGTCGCAGCGGCGACTATTGCCG
ACATGGCCCAAACGCGAAGAGGCAATGTATACTGGGTGCGTGACGCTGCCACCG
GTCAACGTGTACCCGTGCGCACCCGTCCCCCTCGCACTTAGAAGATACTGAGCA
GTCTCCGATGTTGTGTCCCAGCGGCGAGGATGTCCAAGCGCAAATACAAGGAAG
AAATGCTGCAGGTTATCGCACCTGAAGTCTACGGCCAACCGCTGAAGGATGAAA
AAAAACCCCGCAAAATCAAGCGGGCTAAAAAGGACAAAAAAGAAGAGGAAGA
TGGCGATGATGGGCTGGCGGAGTTTGTGCGCGAGTTTGCCCCACGGCGACGCGT
GCAATGGCGTGGACGCAAAGTTCGACATTTGTTGAGACCTGGAACTTCGGTGGT
CTTTACACCCGGCGAGCGTTCAAGCGCTACTTTTAAGCGTTCCTATGATGAGGTG
TACGGGGATGATGATATTCTTGAGCAGGCGGCTGACCGATTAGGCGAGTTTGCT
TATGGCAAGCGTAGTAGAATAAATCCCAAGGATGAGACAGTGTCCATACCCTTG
GATCATGGAAATCCCACCCCTAGTCTTAAACCGGTCACTTTGCAGCAAGTGTTAC
CCGTAACTCCGCGAACAGGTGTTAAACGCGAAGGTGAAGATTTGTATCCCACTA
TGCAACTAATGGTACCCAAACGCCAAAAGTTGGAGGACGTTTTGGAGAAAGTAA
AAGTGGATCCAGATATTCAACCTGAGGTTAAAGTGAGACCCATTAAGCAGGTAG
CGCCTGGTCTGGGAGTACAAACTGTAGACATTAAGATTCCCACTGAAAGTATGG
AAGTGCAAACTGAACCCGCAAAGCCTACTGCCACCTCCACTGAAGTGCAAACGG
ATCCATGGATGCCGATGCCTATTACAACTGACGCCGCCGGTCCCACTCGAAGAT
CCCGACGAAAGTACGGTCCAGCAAGTCTGTTGATGCCCAACTATGTTGTACACC
CATCTATTATTCCTACTCCTGGTTACCGAGGCACTCGCTACTATCGCAGCCGAAA
CAGTACCTCCCGCCGTCGCCGAAGACACCTGCAAATCGCAGTCGTCGCCGTAG
ACGCACAAGCAAACCGACTCCCGGCGCCCTGGTGCGGCAAGTGTACCGCAATAG
TAGTGCGGAACCTTTGACACTGCCGCGTGCGCGTTACCATCCAAGTATCATCACT
TAATCAATGTTGCCGCTGCCTCCTTGCAGATATGGCCCTCACTTGTCGCCTTCGC
GTTCCCATCACTGGTTACCGAGGAAGAAATTCGCGCCGTAGAAGAGGGATGTTG
GGGCGCGGAATGCGACGCTACAGGCGACGGCGTGCTATCCGCAAGCAATTGCGG
GGTGGTTTTTTGCCAGCCTTAATTCCAATTATCGCTGCTGCAATTGGCGCGATAC
CAGGCATAGCTTCCGTGGCGGTTCAGGCCTCGCAACGACATTGACATTGGAAAA
AAAAAAGTATAAATAAAAAAAAATACAATGGACTCTGACACTCCTGGTCCTGTG
ACTATGTTTTCTTAGAGATGGAAGACATCAATTTTTTCATCCTTGGCTCCGCGACA
CGGCACGAAGCCGTACATGGGCACCTGGAGCGACATCGGCACGAGCCAACTGA
ACGGGGGCGCCTTCAATTGGAGCAGTATCTGGAGCGGGCTTAAAAATTTTGGCT
CAACCATAAAAACATACGGGAACAAAGCTTGGAACAGCAGTACAGGACAGGCG
CTTAGAAATAAACTTAAAGACCAGAACTTTGAACAAAAAGTAGTCGATGGGATA
GCTTCCGGCATCAATGGAGTGGTAGATTTGGCTAATCAGGCTGTGCAGAAAAAG
ATAAACAGTCGTTTGGACCCGCCGCCAGCAACCCAGGTGAAATGCAAGTGGAG
GAAGAAATTCCTCCGCCAGAAAAACAAGGCGACAAGCGTCCGCGTCCCGATTTG
GAAGAGACGCTGGTGACGCGCGTAGATGAACCGCCTTCTTATGAGGAAGCAACG
AAGCTTGGAATGCCCACCACTAGACCGATAGCCCCTATGGCTACCGGGGTGATG
AAACCTTCTCAGTTGCATCGACCCGTCACTTTGGATTTGCCCCCTCCCCCTGCTGC
TACTGCTGTACCCGCTTCTAAGCCTGTCGCTGCCCCGAAACCAGTCGCCGTAGCC
AGGTCACGTCCCGGGGCGCTCCTCGTCCAAATGCGCACTGGCAAAATACTCTG
AACAGCATTGTGGGTCTAGGCGTGCAAAGTGTAAAACGCCGTGCGTCGCTTTTAA
TTAAATATGGAGTAGCGCTTAACTTGCCTATCTGTGTATATGTGTCATTACACGC
CGTCACAGCAGCAGAGGAAAAAGGAAGAGGTCGTGCGTCGACGCTGAGTTAC
TTTCAAGATGGCCACCCCATCGATGCTGCCCCAGTGGGCATACATGCACATCGCC
GGACAGGATGCTTCGGAGTACCTGAGTCCGGGTCTGGTGCAGTTCGCCCGCGCC
ACAGACACCTACTTCAATCTGGGAAATAAGTTTAGAAATCCCACCGTAGCGCCG

TABLE 7-continued

Nucleic Acid Sequences of Vectors

SEQ ID NO Sequence

ACCCACGATGTGACCACCGATCGTAGCCAGCGGCTCATGTTGCGCTTCGTGCCCG
TTGACCGGGAGGACAATACATACTCTTACAAAGTGCGGTACACACTGGCCGTGG
GCGACAACAGAGTGCTGGATATGGCCAGCACGTTCTTTGACATTAGGGGCGTGT
TGGACAGAGGTCCCAGTTTCAAACCCTATTCTGGTACGGCTTACAACTCTCTGGC
TCCTAAAGGCGCTCCAAATACATCTCAGTGGATTGCAGAAGGTGTAAAAAATGG
TGAGGAGCGCGTAACAGAAGAGGAAAACAATACTACTACTTACACTTTTGGCAA
TGCTCCCGTAAAAGCTGAAGCTGAAATTACAAAAGAAGGACTCCCAATAGGTTT
GAAAGTTTCAGATGAAGAAAGTAAACCGATTTATGCTGATAAAACATATCAGCC
AGAACCTCAGCTGGGAGATGAAACTTGGACTGACCTTGATGGAAAGACCGAAA
AGTATGGGGGCAGGGCTCTCAAACCAGATACTAAAATGAAACCATGCTACGGGT
CCTTTGCCAAACCTACTACTGTGAAAGGCGGTCAGGCAAAACCAAAACAACGG
AGCAGCCAAATCAGAAAGTCGAATATGATATTGACATGGAGTTTTTTGATGCGG
CATCACAGAAAACAAACTTAAGTCCTAAAATTGTCATGTATGCAGAAAATGTAA
ATTTGGAAACTCCAGACACTCATGTAGTGTACAAACCTGAATCAGAAGACACAA
GTTCCGAAGCTAATTTGGGACAACAGTCTATGCCCAACAGACCCAACTACATTG
GCTTCAGAGATAACTTTATTGGACTTATGTACTATAACAGTACTGGTAACATGGG
GGTGCTGGCTGGTCAAGCGTCTCAGTTAAATGCAGTGGTTGACTTGCAGGACAG
AAACACAGAACTTTCTTACCAACTCTTGCTTGACTCTCTGGGCGACAGAACCAGA
TACTTTAGCATGTGGAATCAGGCTGTGGACAGTTATGATCCTGATGTACGTGTTA
TTGAAAATCATGGTGTGGAAGATGAACTTCCAAACTATTGTTTTCCACTGAATGG
CATAGGGGTTCCAACAACCAGTTACAAATCAATAGTTTCAAATGGAGACAATGC
ACCTAATTGGAAGGAACCTGAAGTAAATGGAACAAGTGAGATCAGACAGGGTA
ATTTGTCTGCCATGGAAATTAACCTTCAAGCAATCTATGGCGAAGTTTCCTTTA
TTCCAATGTGGCTCTGTATCTCCCAGACTCGTACAAATACACCCCGTCCAATGTC
ACTCTTCCAGAAAACAAAAACACCTACGACTACATGAACGGGGGGTGGTGCCG
CCATCTCTAGTAGACACCTATGTGAACATTGGCGCCAGGTGGTCTCTGGATGCTA
TGGACAATGTCAACCCATTCAACCACCACCGTAACGCTGGCTTGCGTTACCGATC
CATGCTTCTGGGTAACGGACGTTATGTGCCTTTCCACATACAAGTGCCTCAAAAA
TTCTTCGCTGTCAAAAACCTGCTGCTTCTCCCAGGCTCCTACACTTATGAGTGGA
ACTTCAGAAAGGATGTGAACATGGTGCTACAGAGTTCCCTTGGTAACGACCTAC
GGGTAGATGGCGCCAGCATCAGTTTCACGAGCATCAACCTCTATGCTACCTTTTT
CCCCATGGCTCACAACACCGCTTCCACCCTTGAAGCCATGCTGCGGAATGACAC
CAATGATCAGTCATTCAACGACTACCTATCTGCAGCTAACATGCTCTATCCCATT
CCTGCCAATGCAACCAATATTCCCATTTCCATTCCTTCTCGCAACTGGGCGGCTT
TCAGAGGCTGGTCATTTACCAGACTCAAAACCAAAGAAACTCCCTCTTTGGGGT
CTGGATTTGACCCCTACTTTGTCTATTCTGGTTCTATTCCCTACCTGGATGGTACC
TTCTACCTGAACCACACTTTTAAGAAGGTTTCCATCATGTTTGACTCTTCAGTGA
GCTGGCCTGGAAATGACAGGTTACTATCTCCCAACGAATTTGAAATAAAGCGCA
CTGTGGATGGCGAAGGCTACAACGTAGCCCAATGCAACATGACCAAAGACTGGT
TCTTGGTACAGATGCTCGCCAACTACAACATCGGCTATCAGGGCTTCTACATTCC
AGAAGGATACAAAGATCGCATGTATTCATTTTTCAGAAACTTCCAGCCCATGAG
CAGGCAGGTGGTTGATGAGGTCAATTACAAAGACTTCAAGGCCGTCGCCATACC
CTACCAACACAACAACTCTGGCTTTGTGGGTTACATGGCTCCGACCATGCGCCAA
GGTCAACCCTATCCCGCTAACTATCCCTATCCACTCATTGGAACAACTGCCGTAA
ATAGTGTTACGCAGAAAAAGTTCTTGTGTGACAGAACCATGTGGCGCATACCGT
TCTCGAGCAACTTCATGTCTATGGGGGCCCTTACAGACTTGGGACAGAACATGCT
TTATGCCAACTCAGCTCATGCTCTGGACATGACCTTTGAGGTGGATCCCATGGAT
GAGCCCACCCTGCTTTATCTTCTCTTGAAGTTTTCGACGTGGTCAGAGTGCATC
AGCCACATCGCGGCATCATCGAGACAGTCTACCTGCGTACACCGTTCTCGGCCG
GTAACGCTACCACGTAAAAAGCTTCTTGCTTCTTGCAAACAGCAGCAGCTGCAA
CCATGGCCTGCGGATCCCAAAACGGCTCCAGCGAGCAAGAGCTCAGAGCCATTG
TCCAAGACCTGGGTTGCGGACCCTATTTTTTGGGAACCTACGATAAGCGCTTCCC
GGGGTTCATGGCCCCCGATAAGCTCGCCTGTGCCATTGTAAACACGGCCGGACG
TGAGACGGGGGGAGAGCACTGGTTGGCTTTCGGTTGGAACCCACGTTCTAACAC
CTGCTACCTTTTTGATCCTTTTGGATTCTCGGATGATCGTCTTAAACAGATTTACC
AGTTTGAATATGAGGGTCTCCTGCGCCGCAGCGCTCTTGCTACCAAGGACCGCTG
TATTACGCTGGAAAAATCTACCCAGACCGTGCAGGGCCCCGTTCTGCCGCCTGC
GGACTTTTCTGCTGCATGTTCCTTCATGCCTTTGTGCACTGGCCTGACCGTCCCAT
GGACGGAAACCCCACCATGAAATTGCTGACTGGAGTGCCAAACAACATGCTTCA
TTCTCCTAAAGTCCAGCCCACCCTGTGTGACAATCAAAAAGCACTCTACCATTTT
CTCAATACCCATTCGCCTTATTTTCGCTCCCATCGTACACACATCGAAAGGGCCA
CTGCGTTCGACCGTATGGATGTGCAATAATGACTCATGTAAACAACGTGTTGAAT
AAACAGCACTTTATTTTTTACATGTATCAAGGCTCTGGATTACTTATTTATTTACA
AGTCGAATGGGTTCTGACGAGAATCAGAATGACCCGCGGGCAGTGATACGTTGC
GGAACTGATACTTGGGTTGCCACTTGAATTCGGGAATCACCAACTTGGGAACCG
GTATATCGGTAGGATGTCACTCCACAGCTTTCTGGTCAGCTGCAAAGCTCCCAG
CAGGTCAGGAGCCGAAATCTTGAAATCACAATTAGGACCAGTGCTCTGAGCGCG
AGAGTTGCGGTACACCGGATTGCAGCACTGAAACACCATCAGCGACGGATGTCT
CACGCTTGCCAGCACGGTGGGATCTGCAATCATGCCCACATCCAGATCTTCAGC
ATTGGCAATGCTGAACGGGGTCATCTTGCAGGTCTGCCTACCCATGGCGGGCAC
CCAATTAGGCTTGTGGTTGCAATCGCAGTGCAGGGGATTAGTATCATCTTGCCC
TGATCCTGTCTGATTCCTGGATACACGGCTCTCATGAAAGCATCATATTGCTTGA
AAGCCTGCTGGGCTTTACTACCCTCGGTATAGAACATCCCGCAGGACCTGCTCGA
AAACTGGTTAGCTGCGCAGCCGGCATCATTCACACAGCAGCGGGCGTCATTGTT
GGCTATTTGCACCACACTTCTGCCCCAGCGGTTTTGGGTGATTTTGGTTCGCTCG
GGATTCTCCTTCAAGGCTCGTTGTCCATTCTCGCTGGCCACATCCATCTCGATAA

TABLE 7-continued

Nucleic Acid Sequences of Vectors

SEQ ID NO Sequence

TCTGCTCCTTCTGAATCATAATAGTGCCATGCAGGCACTTCAGCTTGCCCTCATA
ATCATTGCAGCCATGAGGCCACAACGCACAGCCTGTACATTCCCAATTATGGTG
GGCGATCTGAGAAAAAGAATGTATCATTCCCTGCAGAAATCTTCCCATCATCGT
GCTCAGTGTCTTGTGACTAGTGAAAGTTAACTGGACGCCTCGGTGCTCCTCGTTT
ACGTACTGGTGACAGATGCGCTTGTATTGTTCGTGCTGCTCAGGCATTAGTTTAA
AAGAGGTTCTAAGTTCGTTATCCAGCCTGTACTTCTCCATAAGTACACACATCAC
TTCCATGCCCTTCTCCCAAGCAGACACCAGGGGCAAGCTAATCGGATTCTTAACA
GTACAGGCAGCAGCTCCTTTAGCCAGAGGATCATCTTTGGCAATCTTTTCAATGC
TTCTTTTGCCATCCTTCTCAACGATGCGCACGGGCGGGTAGCTGAAACCTACTGC
TACAAGCTGCGCCTCTTCTCTTTCTTCTTCGCTGTCTTGACTGATGTCTTGCATGG
GAACATGTTTGGTCTTCCTTGGCTTCTTTTTGGGGGGTATCGGGGGAGGAGGACT
GTCGCTCCGTTCCGGAGACAGGGAGGATTGTGAAGTTTCGCTCACCATTACCAA
CTGACTGTCGGTAGAAGAACCTGACCCCACACGGCGACAGGTGTTTCTCTTCGG
GGGCAGAGGTGGAGGCGATTGCGAAGGGCTGCGGTCCGACCTGGAAGGCGGAT
GACTGGCAGAACCCCTTCCGCGTTCGGGGGTGTGCTCCCTGTGGCGGTCGCTTAA
CTGATTTCCTTCGCGGCTGGCCATTGTGTTCTCCTAGGCAGAGAAACAACAGACA
TGGAAACTCAGCCATTGCTGTCAACATCGCCACAAGTGCCATCACATCTCGTCGT
CAGCGACGAGGAAAAGGAGCAGAGCTTAACCATTCCACCGCCCAGTCCTGCCAC
CACCTCTACCCTAGAAGATAAGGAGGTCGACGCATCTCATGACATGCAGAATAA
AAAAGCGAAAGAGTCTGAAACAGACATCGAGCAAGACCCGGGCTATGTGACAC
CGGTGGAACACGAGGAAGAGTTGAAACGCTTTCTAGAGAGAGGAGGATGAAAAC
TGCCCAAAACAGCAAGCGGATAACTATCACCAAGATGCTGGAAATAGGGATCA
GAACACCGACTACCTCATAGGGCTTGACGGGGAAGACGCGCTCCTTAAACATCT
AGCAAGACAGTCACTCATAGTCAAGGATGCATTATTGGACAGAACTGAAGTGCC
CATCAGTGTGGAAGAGCTCAGCCGCGCCTACGAGCTTAACCTTTTTTCACCTCGT
ACTCCCCCAAACGCCAGCCAAACGGCACCTGCGAGCCAAATCCTCGCTTAAAC
TTTTATCCAGCTTTTGCTGTGCCAGAAGTACTGGCTACTTATCACATCTTTTTTAA
AAATCAAAAAATTCCAGTCTCCTGCCGCGCTAATCGCACCCGCGCTGACGCCCT
ACTTAATCTGGGACCTGGTTCACGCTTACCTGATATAGCTTCCTTGGAAGAGGTT
CCAAAAATCTTCGAGGGTCTGGGCAATAATGAGACTCGGGCCGCAAATGCTCTG
CAAAAGGGAGAAAATGGCATGGATGAGCATCACAGCGTTCTGGTGGAATTGGA
GGGCGATAATGCCAGACTCGCAGTACTCAAGCGAAGCGTCGAGGTCACACACTT
TGCATACCCCGCTGTCAACCTGCCCCCTAAAGTCATGACGGCGGTCATGGACCA
GTTACTCATTAAGCGCGCAAGTCCCCTTTCAGAAGACATGCATGACCCAGACGC
CTGTGATGAGGGTAAACCAGTGGTCAGTGATGAGCAGCTAACCCGATGGCTGGG
CACCGACTCTCCCCGGGATTTGGAAGAGCGTCGCAAGCTTATGATGGCCGTAGT
GCTGGTTACCGTAGAACTAGAGTGTCTCCGGCGTTTCTTTACCGATTCAGAAACC
TTGCGCAAACTCGAAGAGAATCTGCACTACACTTTTAGACACGGCTTTGTGCGGC
AGGCGTGCAAGATATCTAACGTGGAACTCACCAACCTGGTTTCCTACATGGGTA
TTCTGCATGAGAATCGTCTAGGACAAAGCGTGCTGCACAGCACCCTTAAGGGGG
AAGCCCGCCGTGATTACATCCGCGATTGTGTCTATCTCTACCTGTGCCACACGTG
GCAAACCGGCATGGGTGTATGGCAGCAATGTTTAGAAGAACAGAACTTGAAAG
AGCTTAACAAGCTCTTACAGAAATCTCTTAAGGTTCTGTGGACAGGGTTCGACG
AGCGCACCGTCGCTTCCGACCTGGCAGACCTCATCTTCCCAGAGCGTCTTAGGGT
TACTTTGCGAAACGGACTGCCTGACTTTATGAGCCAGAGCATGCTTAACAATTTT
CGCTCTTTCATCCTGGAACGCTCCGGTATCCTGCCCGCCACCTGCTGCGCACTGC
CCTCCGACTTTGTGCCTCTCACCTACCGCGAGTGCCCCCGCCGCTATGGAGTCA
CTGCTACCTGTTCCGTCTGGCCAACTACCTCTCCTACCACTGGATGTGATCGAG
GATGTGAGCGGAGACGGCTTGCTGGAGTGTCACTGCCGCTGCAATCTGTGCACG
CCCCACCGGTCCCTAGCTTGCAACCCCCAGTTGATGAGCGAAACCCAGATAATA
GGCACCTTTGAACTGCAAGGCCCCAGCAGCCAAGGCGATGGGTCTTCTCCTGGG
CAAAGTTTAAAACTGACCCCGGGACTGTGGACCTCTGCCTACTTGCGCAAGTTTG
CCCCGGAAGATTACCACCCCTATGAAATCAAGTTCTATGAGGACCAATCACAGC
CTCCAAAGGCCGAACTTTCGGCCTGCGTCATCACCCAGGGGGCAATTCTAGCCC
AATTGCAAGCCATCCAAAAATCCCGCAAGAATTTCTACTAAAAAAGGGTAAGG
GGGTCTACCTTGACCCCCAGACCGGCGAGGAACTCAACACAAGGTTCCCTCAGG
ATGTCCAACGACGAGAAAGCAAGAAGTTGAAGGTGCAGCCGCCGCCCCAGA
AGATATGGAGGAAGATTGGGACAGTCAGGCAGAGGAAGCGGAGGAGGACAGTC
TGGAGGACAGTCTGGAGGAAGACAGTTTGGAGGAGGAAAACGAGGAGGCAGAG
GAGGTGGAAGAAGTAACCGCCGGCAAACAGTTATCCCCGGCTGCGGAGACAAG
CAACAGCGCTATCATCTCCGCTCCGAGTCGAGGAACGCGGCGGCGTCCCAGCAG
TAGATGGGACGAGACCGGACGCTTCCCAAACCCAACCACCGCTTCCAAAACCGG
TAAGAAGGATCGGCAGGGATACAAGTCCTGGCGGGGGCATAAGAATGCCATCA
TCTCCTGCTTGCATGAGTGCGGGGAAACATATCCTTCACGCGACGCTACTTGCT
ATTCCACCATGGGTGAACTTTCCGCGCAATGTTTTGCATTACTACCGTCACCTC
CACAGCCCCTACTATAGCCAGCAAATCCCGGCAGTCTCGACAGAAAAAGACAGC
GGCGGCGACCTCCAACAGAAAACCAGCAGCGGCAGTTAAAAAATACACAACAA
GTGCAGCAACAGGAGGATTAAAGATTACAGCCAACGAGCCAGCGCAAACCCGA
GAGCTAAGAAATCGGATCTTTCCAACCCTGTATGCCATCTTCCAGCAGAGTCGG
GGCCAAGAGCAGGAACTGAAAATAAAAAACCGATCTTTGCGTTCGCTCACCAGA
AGTTGTTTGTATCACAAGAGCGAAGATCAACTTCAGCGACTCTTGAGGACGCC
GAGGCTCTCTTCAACAAGTACTGCGCGCTGACTCTTAAAGAGTAGGCAGCGACC
GCGCTTATTCAAAAAAGGCGGGAATTACATCATCCTCGTCATGAGTAAAGAAAT
TCCCACGCCTTACATGTGGAGTTATCAGCCCCAAATGGGATTGCGGCAGGCGC
CTCCCAGGACTACTCCACCCGCATGAATTGGCTCAGCGCCGGGCCTTCTATGATT
TCTCGAGTTAATGATATACGCGCCTACCGAAACCAAATACTTTTGGAACAGTCA

TABLE 7-continued

Nucleic Acid Sequences of Vectors

SEQ ID NO Sequence

```
GCTCTTACCACCACGCCCCGCCAACACCTTAATCCCCGAAATTGGCCTGCCGCCC
TAGTGTACCAGGAAAGTCCCGCTCCCACCACTGTATTACTTCCTCGAGACGCCCA
GGCCGAAGTCCAAATGACTAATGCAGGTGCGCAGTTAGCTGGCGGCTCCACCCT
ATGTCGTCACAGGCCTCGGCATAATATAAAACGCCTGGTAATCAGAGGCAGAGG
TATCCAGCTCAACGACGAGTCGGTGAGCTCTCCGCTTGGTCTACGACCAGACGG
AATCTTTCAAATTGCCGGCTGCGGGAGATCTTCCTTCACCCCTCGTCAGACTGTT
TTGACTTTGGAAAGTTCGTCTTCGCAACCCCGCTCGGGCGGAATCGGGACCGTTC
AATTTGTGGAGGAGTTTACTCCCTCTGTCTACTTTAACCCTTTCTCCGGATCTCCT
GGGCACTACCCGGACGAGTTCATACCGAACTTCGACGCAATTAGCGAGTCAGTG
GACGGCTACGATTGATGTCTGGTGACGCGGCTGAGCTATCTCGGCTGCGACATTT
AGACCACTGCCGCCGCTTTCGCTGCTTTGCCCGGGAACTCATTGAGTTCATTTAC
TTCGAACTCCCCAAGGATCACCCTCAAGGTCCGGCCCACGGAGTGCGGATTACT
ATCGAAGGCAAAATAGACTCTCGCCTGCATCGAATTTTCTCCCAGGCGGCCCGTGC
TGATCGAGCGAGACCAGGGAAACACCACGGTTTCCATCTACTGCATTTGTAATC
ACCCAGGATTGCATGAAAGCCTTTGCTGTCTTATGTGTACTGAGTTTAATAAAAA
CTGAATTAAGACTCTCCTACGGACTGCCGCTTCTTCAACCCGGATTTTACAACCA
GAAGAACGAAACTTTTCCTCTCGTCCAGGACTCTGTTAACTTCACCTTTCCTACT
CACAAACCAGAAGCTCAACGACAACACCGCTTTTCCAGAAGCATTTTCCCTACT
AATACTACTTTCAAAACCGGAGGTGAGCTCCACAGTCTCCCCACAGAAAACCCT
TGGGTGGAAGCGGGCCTTGTAGTGCTAGGAATTCTTGCGGGTGGGCTTGTGATT
ATTCTTTGCTACCTATACACACCTTGCTTCACTTTCCTAGTGGTGTTGTGGTATTG
GTTTAAAAAATGGGGCCCATACTAGTCTTGCTTGTTTTACTTTCGCTTTTGGAAG
CGGGTTCTGCCAATTACGATCCATGTCTAGACTTTGACCCAGAAAACTGCACACT
TACTTTTGCACCCGACACAAGCCGCATCTGTGGAGTTCTTATTAAGTGCGGATGG
GAATGCAGGTCCGTTGAAATTACACACAATAACAAAACCTGGAACAATACCTTA
TCCACCACATGGGAGCCAGGAGTTCCCCAGTGGTACACTGTCTCTGTCCGAGGTC
CTGACGGTTCCATCCGCATTAGTAACAACACTTTCATTTTTTCTAAAATGTGCGA
TCTGGCCATGTTCATGAGCAAACAGTATTCTCTATGGCCTCCCAGCAAGGACAAC
ATTGTAACGTTCTCCATTGCTTATTGCTTGTGCGCTTGCCTTCTTACTGCTTTACT
GTGCGTATGCATACACCTGCTTGTAACCACTCGTATCAAAAACGCCAATAACAA
AGAAAAAATGCCTTAACCTCTTTCTGTTTACAGACATGGCTTTTCTTACAGCTCT
CATACTTGTCAGCATTGTCACTGCCGCTCACGGACAAACAGTCGTCTCTATCCCT
CTAGGTCATAATTACACTCTCATAGGACCCCCAATCACTTCAGAGGTCATTTGGA
CCAAACTGGGAAGCGTTGATTACTTTGATATAATCTGTAACAAACAAAACCAA
TAATAGTAACCTGCAACATACAAAATCTTACATTAATTAATGTTAGCAAAGTTTA
CAGCGGTTACTATTATGGTTATGACAGATACAGTAGTCAATATAGAAATTACTTG
GTTCGTGTTACCCAGTCCAAAACCACGAAAATGCCAAATATGGCAGAAATTCGA
TCCGATGACAATTCTCTAGAAACTTTTACATCTTCCACCACACCTGACGAAAAAA
ATATCCCAGATTCAATGATTGCAATTATCGCAGCGGTGGCAGTGGTGATGGCAC
TACCAGTAATATGCATGCTTTTATATGCTTGTCGCTACAAGAAGTTTCATCCTAA
AAAACAAGATCTCCTACTAAGGCTTAACATTTAATTTCTTTTTACACAGCCATGG
TTTCCACTACCACATTCCTTATGCTTACTAGTATAGCAACTCTGACTTCTGCTCGC
TCACACCTCACTGTAACTATAGGCTCAAACTGCACACTAAAAGGACCTCAAGGT
GGTCATGTCTTTTGGTGGAGAATATATGACAATGGATGGTTTACAAAACCATGTG
ACCAACCTGGTAGATTTTTCTGCAACGGCAGAGACCTAACCATTATCAACGTGA
CAGCAAATGACAAAGGCTTCTATTATGGAACGACTATAAAAGTAGTTTAGATT
ATAACATTATTGTACTGCCATCCACCACTCCAGCACCCCGCAAAACTACTTTCTC
TAGCAGCAGTGCCGCTAACAATACAATTTCCAATCCAACCTTTACCGCGCTTTTA
AAACGCACTGTGAATAATTCTACAACAATTTCCACTTCAACAATCAGCATCATCG
CTGTCGTGACAATTGGAATATCTATTCTTGTTTTTACCATAACCTACTACACCTGC
TGCTATAAAAAAGACGAACATAAAGGTGATCCATTACTTAGATTTGATATTTAAT
TTGTTCTTTTTTTTTTATTTACAGTATGGTGAACACCAATCATGGTACCTAGAAA
TTTCTTCTTCACCATACTCATCTGTGCTTTTAATGTTTGCGCTACTTTCACAGCAG
TAGCCACAGCAAGCCCAGACTGTATAGGAGCATTTGCTTCCTATGCACTGTTTGC
TTTTGTCACTTGCATCTGCGTATGTAGCATAGTCTGCCTGGTTATTAATTTTTTCC
AACTTCTAGACTGGATCCTTGTGCGAATTGCCTACCTGCGCCACCATCCCGAATA
CCGCAACCAAAATATCGCGGCACTTCTTAGACTTATCTAAAACCATGCAGGCTAT
ACTACCAATATTTTGCTTCTATTGCTTCCCTACGCTGTCTCAACCCCAGCTACCT
ATAGTACTCCACCAGAACACCTTAGAAAATGCAAATTCCAACAACCGTGGTCAT
TTCTTGCTTGCTATCGAGAAAAATCTGAAATTCCCCAACTTTAATAATGATTGC
TGGAATAATTAATGTAATCTGTTGCACCATAATTTCATTTCTAATCTACCCCTAT
TTGATTTTGGCTGGAACGCTCCCAATGCACATGATCATCCCCAAGACCCAGAGG
AACACATTCCCTACATAACATGCAACAACCAATAGCGCTAATAGAATACGAAA
GTGAACCACAACCCCCACTACTCCCTGCTATTAGTTACTTCAACCTAACCGGCGG
AGATGACTGAAACACTCACCACCTCCAATTCCGCCGAGGATCTGCTTGATATGG
ACGGCCGCGTCAGAACAGCGACTCGCCCAACTACGCATCCGCCAGCAGCAGG
AACGCGTGGCCAAAGAGCTCAGAGATGTCATCCAAATTCACCAATGCAAAAAG
GCATATTCTGTTTGGTAAAACAAGCCAAAATATCCTACGAGATCACCGCTACCA
ACCATCGCCTCTCTTACGAGCTTGGCCCCAACGACAAAATTTACCTGCATGGT
GGGAATCAACCCCATAGTTATCACCCAACAAAGTGGAGATACTAAGGGTTGCAT
TCACTGCTCCTGCGAATCCATTGAGTGCACCTACACCCTGCTGAAGACCCTATGC
GGACTAAGAGACCTGCTACCCATGAATTAAAAAAATGATTAATAAAAAATCACT
TACTTGAAATCAGCAATAAGGTCTCTATTGAATTTTCTCCCAGCAGCACCTCAC
TTCCCTCTTCCCAACTCTGGTATTCTAAACCCGTTCAGCGGCATACTTTCTCCAT
ACTTTAAAGGGGATGTCAAATTTTAGCTCCTCTCCTGTACCCACAATCTTCATCT
CTTTCTTCCCAGATGACCAAGAGAGTCCGGCTCAGTGACTCCTTCAACCCTGTCT
```

TABLE 7-continued

Nucleic Acid Sequences of Vectors

| SEQ ID NO | Sequence |
|---|---|
| | ACCCCTATGAAGATGAAAGCACCTCCCAACACCCCTTTATAAACCCAGGGTTTAT
TTCCCCAAATGGCTTCACCCAAAGCCCAGACGGAGTTCTTACTTTAAAATGTTTA
ACCCCGCTAACAACCACAGGCGGGTCTCTACAGCTAAAAGTGGGAGGGGGACTT
ACAGTAGATGACACTGATGGGACCTTACAAGAAAACATAGGTACCACCACACCA
CTTGTTAAGACTGGGCACTCTATAGGTTTATCCCTAGGAGCCGGATTGGGAACA
GATGAAAATAAACTTTGTACCAAATTGGGAAAAGGACTTACATTCAATTCAAAC
AACATTTGCATTGATGACAATATTAACACCCTGTGGACAGGAATTAACCCCACC
GAAGCCAACTGTCAAATGATGGACTCCAGTGAATCTAATGATTGCAAATTAATT
CTAACACTAGTTAAAACTGGAGCCCTAGTCACTGCATTTGTTTATGTTATAGGAG
TATCTAACAATTTTAATATGCTAACTACATACAGAAATATAAATTTTACTGCGGA
GCTGTTTTTGATTCTGCGGGTAATTTACTAACTAGCCTGTCATCCCTAAAAACTC
CACTTAATCATAAATCAGGACAAAACATGGCTACTGGTGCCATTACTAATGCTA
AAAGTTTCATGCCCAGCACAACTGCTTATCCTTTCAATAATAATTCTAGAGAAAA
AGAAAACTACATTTACGGAACCTGTCACTACACAGCTAGTGATCACACTGCTTTT
CCCATTGACATATCTGTCATGCTTAACCAAAGAGCAATAAGAGCTGATACATCA
TATTGTATTCGTATAACTTGGTCCTGGAACACAGGAGATGCCCCAGAGGGGCAA
ACCTCTGCTACAACCCTAGTTACCTCCCCATTTACCTTTTACTACATCAGAGAAG
ACGACTGACAAATAAAGTTTAACTTGTTTATTTGAAAATCAATTCACAAACTTCG
AGTAGTTATTTTGCCTCCCCCTTCCCATTTAACAGAATATACCAATCTCTCCCCAC
GCACAGCTTTAAACATTTGGATACCATTAGAGATAGACATGGTTTTAGATTCCAC
ATTCCAAACAGTTTCAGAGCGAGCCAATCTGGGGTCAGTGATAGATAAAAATCC
ATCGGGATAGTCTTTTAAAGCGCTTTCACAGTCCAACTGCTGCGGATGCGACTCC
GGAGTCTGGATCACGGTCATCTGGAAGAAGAACGATGGGAATCATAATCCGAAA
ACGGGATCGGGCGATTGTGTCTCATCAAACCCACAAGCAGCCGCTGTCTGCGTC
GCTCCGTGCGACTGCTGTTTATGGGATCGGGATCCACAGTGTCCTGAAGCATGAT
TTTAATAGCCCTTAACATTAACTTTCTGGTGCGATGCGCGCAGCAACGCATTCTT
ATTTCACTTAGATTAATACAGTAGGTACAGCACATTATTACAATATTGTTTAATA
AACCATAATTAAAAGCACTCCAGCCAAAACTCATATCTGATATAATCGCCCCTG
CATGACCATCATACCAAAGTTTAATATAAATTAAATGACGTTCCCTCAAAAACA
CACTACCCACATACATGATCTCTTTTGGCATGTGCATATTAACAATCTGTCTGTA
CCATGGACAACGTTGGTTAATCATGCAGCCCAATATAACCTTCCGGAACCACAC
TGCCAACACCGCTCCCCCAGCCATGCATTGAAGTGAACCCTGCTGATTACAATG
ACAATGAAGAATCCAATTCTCTCGACCATGAATCACTTGAGAATGAAAAATATC
TATAGTAGCACAACATAGACATAAATGCATGCATCTTCTCATAATTTTTAACTCC
TCAGGATTTAGAAACATATCCCAAGGAATAGGAAGCTCTTGCAGAACAGTAAAG
CTGGCAGAACAAGGAAGACCACGAACACAACTTACACTATG |
| SEQ ID NO: 1450 | CATCATCAATAATATACCCCACAAAGTAAACAAAAGTTAATATGCAAATGAGCT
TTTAAATTTTAACGGTTTTAGGGCAGGGCCAATGTTAATTGGTTAACAAGCGGTA
ATGCAGTTGACGTCAAGACGCACGGCCGGCGGTTGCCGCAGAGGCGTGGCCTAG
CCCGGAAGCAAGTCGCAGGGCCGATGACGTATAAAAAAGCGGACTTTAAACCC
GGAAACGGCCGATTTTCCCACGGCCACGCCCGGATATGAGGTAATTTTGGGCGG
TTGCAAGTAAAATTAGGACATGGTGGCGCCAAAACTGAATGAGGAAGTGAAAA
GCGAAAAATACCGGTCCCGCCCAGGGCGGAATATTTACCGAGGGCCAACAGACT
TTGACCGATTACGTGGGGTTTCGATTACGGTGTTTTTTTCGCCAATTTCCGCGTCC
GTGTTAAATCCGGTGTTTATGTTACACATCAGCTGATCCACAGGGTATTTAAACC
AGTTAAGTCCGTCAAGAGACTACTCTTGAGTGCCAGCGAGTAGAGTTTTCTCTAA
ACTGTGCTCCCAAAGTTTAAGAAAAATGAGACACCTGCACCTCCTGTCTTCAACT
GTGCCTATTGACATGGCCGCATTATTGCTGGAGGACTATGTAAATACAATATTGG
AGGACGAACTGCATTTATCTCCGTTTGAGCTGGGACCCCACACTTCAGGACCTATA
TGATTTGGAGGTAAATGCCCAGGAGAACGACCCAAACGAAGAGGCTGTGAATTT
AATATTTCCAGAATCTATGATTCTTCAGGCTGACATAGCCAGCGAAGCTGTACCT
ACTTCAGTTTATACACCGACTCTGCCGCCTATACCTAAATTGGAAGAGGAGGAT
AAGCTAGACCTTCGGTGTTATGAGGAAGGTTTTCCTCCCAGCGATTCAGAGGAC
GAACGGGGTGAGCAGAGCGTGGCTATAATCTCAGACTATGCGTGTGTGGTTGTG
GAAAATCATTTTGTGTTGGACAATCCTGAGGTGCCAGGGCAAGGCTGTAAATCC
TGTCAATATCACCGGGAACAGACCGGAGACCCAAATGCTTCCTGCGCTCTGTGTT
ACATGAAAATGAGCTTCAGCTTTATTTACAGTAAGTGGAGTAAATGTAAGAGAG
GCTAAGTGCTTAAGACATTACTGTGCTTTGCTTGAACAGCTGTACTAAGTGTGGT
TTATTTTTGTTACTAGGTCCGGTGTCAGAGGATGAGTCATCACCCTTAGAAGAAG
ACCACCCGTCTCCCCCTGATCTTACAAATGACACGCCCCTGCAAGTGCGCAAACC
CACCCCGGTTAGACCGAGTGGCGAGAGGCGAGCGGCTGTTTACAAAATTGAGGA
TTTGTTGCAGGACGTGGGTGGGAATGAACCTTTGAACCTGAGCTTGAAACGCCC
CAGGAACTAGGCGCAGCTGTGCTTAGTCATGTGTAAATAAAGTTGTACAATAAA
AGTATGTGTGACGCATGCAAGGTGTGGTTTATGACTCATGGGCGGGCTTAGTC
CTATATAAGTGGTAACACCTGGGCACTTAGGCACAAACTTTAGGAAGTTCCTAA
TGGATGTGTGGAGTATTCTTGGGGAATTTAACAAGACACGCCGGCTTGTGGAGG
ATAGTTCAGACGGGTGCTCCGGGTTTTGGAGACACTGGTTTGGAACTCCTCTATC
TCGCCTGGTGTACACAGTTAAGAAGGATTATAGCGAGGAATTTGAAAATCTTTTT
GCCGACTGTTCTGGCCTGCTAGATTCTTTAAATTTTGGCCACCAGTCCCTTTTCCA
GGAAAGGGTACTCCACAGCCTTGATTTTTCCAGCCCAGGGCGCACTACAGCCGG
GGTTGCTTTTGTGGTTTTTTGGTTGACAAATGGAGCCAGGACACCCAACTAAGC
AGGGGCTACATTCTGGACTTTGCAGCCATGCACCTGTGGAGGGCCTGGATGAGG
CAGCGGGACAGAGAATCTTGAACTACTGGCTTTTACAGCCAGCAGCGTCGGGT
CTTCTTCATCTACACAGACAAACATCCATGTTGGAGGAAGAAATGAGGGAGGCC
ATGGACGAGAACCCGAGGAGCGGCCTGGACCCTCCGTCGGAAGAGGAGCTGGA |

TABLE 7-continued

Nucleic Acid Sequences of Vectors

SEQ ID NO Sequence

TTAAATGAGGTATCCAGCCTGTACCCAGAGCTTAGCAAGGTGCTGACATCCATG
GCCAGGGGAGTGAAGAGGGAGAGGAGCGATGGGGGCAATACCGGGCTGATGAC
CGAGCTAACTGCCAGCCTGATGAATCGCAAGCGCCCAGAGCGTATTACCTGGCA
CGAGCTACAGCAGGAGTGCAGGGATGAGATAGGCCTGATGCAGGATAAATATG
GCCTGGAGCAAATAAAAACCCATTGGTTGAACCCAGACGAGGATTGGGAGGAG
GCCATTAAGAAATATGCCAAGATAGCCCTGCGCCCAGATTGCAAGTACAGGGTG
ACTAAGACCGTGAATATTAAACATGCCTGCTACATCTCGGGGAACGGGGCAGAG
GTGGACATCGATACTCTGGACAAGTCAGCCTTCAGGTGTTGCATGATGGGAATG
AGAGTAGGAGTAATGAATATGAATTCCATGATCTTTATAAACATAAAGTTCAAT
GGAGAGAAGTTTAATGGGGTACTGTTTATGGCCAACAGCCACATGACCCTGCAT
GGTTGCAGTTTTTTTGGCTTTAACAATATGTGTGCAGAGGTCTGGGGTGCTGCTA
AGATTAGGGGATGTAAGTTTTACGGCTGCTGGATGGGCGTGGTTGGAAGACCCA
AGAGCGAGATGTCTGTAAAGCAGTGTGTGTTTGAAAAATGCTACCTGGGAGTCT
GTACCGAGGGCAATGCTAGAGTAAGACACTGCTCTTCCCTAGAAACGGGCTGCT
TTTGCCTGGTGAAGGGCACAGCCTCGATTAAGCATAATGTGGTAAAGGGCTGCA
CGGATGAGCGCATGTACAACATGCTGACCTGCGACTCGGGGGTCTGCCTATATCC
TGAAGAACATCCATGTGACCTCCCACCCCAGAAAAAAGTGGCCAGTGTTTGAGA
ATAACCTGCTGATTAAGTGCCATATGCACCTGGGTGCCAGAAGGGGCACCTTCC
AGCCGTACCAGTGCAACTTTAGCCAGACCAAGCTGCTGTTGGAGAACGATGCCT
TCTCCAGGGTGAACCTGAACGGCATCTTTGACATGGATGTCTCGGTGTACAAGAT
CCTGAGATACGATGAGACCAAGTCCAGGGTGCGCGCTTGCGAGTGCGGTGGCAG
ACACACCAGGATGCAGCCAGTGGCCCTGGATGTGACCGAGGAGCTGCGACCAG
ACCACCTGGTGATGGCCTGTACCGGGACCGAGTTCAGCTCCAGTGGGGAGGACA
CAGATTAGAGGTAGGTTTAAGTAGTGGGCGTGGCTAAGGTAAGTATAAAGGCGG
GTGTCTTACAAGGGTCTTTTTGCTTTTCTGCAGACATCATGAACGGGACCGGCGG
GGCCTTCGAAGGGGGGCTTTTTAGCCCTTATTTGACAACCCGCCTGCCGGGATGG
GCCGGAGTTCGTCAGAATGTGATGGGATCAACGGTGGACGGGCGCCCAGTGCTT
CCAGCAAATTCCTCGACCATGACCTACGCGACCGTGGGGACGAGCTCGTCGCTT
GACAGCACCGCCGCAGCCGCGGCAGCCGCAGCCGCCATGACAGCGACGAGACT
GGCCTCGAGCTACATGCCCAGCAGCGGTAGCAGCCCCTCCATCCCCAGTTCCATC
ATCGCCGAGGAGAAACTGCTGGCCCTGCTGGCTGAGCTGGAAGCCCTGAGCCGC
CAGCTGACCGCCCTGACCCAGGAGGTGTCCGAGCTCCGCGAACAGCAGCAGCAG
CAAAATAAATGATTTAATAAACACAAATTTTGATTCAAACAGCAAAGCATCTTT
ATTATTTATTTTTTCGCGCCGGTAGGCCCTGGTCCACCTCTCCCGATCATTAAG
AGTGCGGTGGATTTTTTCCAGGACCCGGTAGAGGTGGGATTGGATGTTGAGGTA
CATGGGCATGAGCCCGTCCCGGGGGTGGAGGTAGCACCACTGCATGGCCTCGTG
TTCTGGGGTTGTGTTGTAGATGATCCAGTCATAGCAGGGGCGCTGGGCGTGGTG
CTGGATGATGTCCTTAAGGAGGAGACTGATGGCCACGGGGAGCCCCTTGGTGTA
GGTGTTGGCAAAGCGGTTGAGCTGGGAGGGATGCATGCGGGGGGAGATGATGT
GTAGTTTGGCCTGGATCTTAAGGTTGGCGATGTTACCGCCCAGATCCCGCCGGGG
GTTCATGTTGTGCAGGACCACCAGGACAATGTAGCCCGTGCACTTGGGGAACTT
GTCATGCAACTTGGAAGGGAATGCGTGGAAGAATTTGGAGACGCCCTTGTGCCC
GCCCAGGTTTTCCATGCACTCATCCATGATGATGGCAATGGGCCCGTGGGCTGCG
GCTTTGGCAAAGACGTTTCTGGGGTCAGAGACATCGTAATTATGCTCTTGGGTGA
GATCATCATAAGACATTTTAATGAATTTGGGGCGGAGGGTGCCAGATTGTGGGA
CGATGGTTCCCTCGGGCCCCGGGGCGAAGTTCCCCTCGCAGATCTGCATCTCCCA
GGCTTTCATCTCGGAGGGGGGGATCATGTCCACCTGCGGGGCGATGAAAAAAAT
GGTTTCCGGGGCGGGGTGATGAGCTGCGAGGAGAGCAGGTTTCTTAACAGCTG
GGACTTGCCGCACCCGGTTGGGCCGTAGATGACCCCGATGACGGGTTGCAGGTG
GTAGTTCAAGGAGATGCAACTGCCGTCGTCCCGGAGGAGGGGGCTACCTGGTT
AAGCATGTCTCTGACTTGGAGGTTTTCCCGAACAAGCTCGCTGAGGAGGCGGTC
CCCGCCCAGCGAGAGCAGTTCTTGCAGGGAAGCAAAGTTTTTTAGGGGCTTAAG
CCCGTCGGCCATGGGCATCTTGGCGAGGGTCTGCGAGAGGAGCTCCAGGCGGTC
CCAGAGCTCGGTGACGTGCTCTACGGCATCTGGATCAGCAGACTTCCTCGTTTC
GGGGGTTGGGACGACTGCGACTGTAGGGCACAAGACGATGGGCGTCCAGCGCG
GCCAGCGTCATGTCCTTCCAGGGTCTCAGGGTCCGCGTGAGGGTGGTCTCCGTTA
CGGTGAATGGGTGGCCCCGGGCTGGGCGCTTGCAAGTGTGCGCTTCAGACTCA
TCCTGCTGGTGCTGAAACGGGCACGGTCTTCGCCCTGCGCGTCGGCAAGATAGC
AGTTAACCATGAGCTGGTAGTTCAGGGCCTTGGCGGCATGGCCCTTGGCGCGGA
GCTTGCCCTTGGAAAAGCGCCCGCAGGCGGGACAGAGGAGGGATTGCAGGGCG
TACAGTTTGGGCGCGAGAAAGACCGACTCGGGGGCAAGGCGTCCGCTCCGCAG
TGGGCGCAGACGGTCTCGCACTCGACAAGCCAGGTGAGCTCGGGCTGCTTGGGG
TCAAAAACCAGTTTTCCCCCGTTCTTTTTGATGCGCTTCTTACCTCGCGTCTCCAT
AAGTCTGTGTCCGCGCTCGGTGACAAACAGGCTGTCGGTGTCCCGTAGACGGA
CTTGATTGGCCTGTCCTGCAGGGGCGTCCCGCGGTCCTCCTGTAAAGAAACTCG
GACCACTCTGAGACGAAGGCGCGCGTCCACGCCAAGACAAAGGAGGCCACGTG
CGAGGGGTAGCGGTCGTTTTCCACCAGGGGTCCACCTTTTCCACCGTGTGCAGA
CACATGTCCCCCTCCTCCGCATCCAAGAAGGTGATTGGCTTGTAGGTGTAGGCCA
CGTGACCGGGGGTCCCCGACGGGGGGTATAAAAGGGGCGGTCTGTGCTCGT
CCTCACTCTCTTCCGCGTCGCTGTCCACGAGCGCCAGCTGTTGGGGTAGGTATTC
CCTCTCAAGAGCGGGCATAACCTCGGCACTCAGGTTGTCAGTTTCTAGAAACGA
GGAGGATTTGATGTTGGCCTGCCCTGCCGCAATGCTTTTTAGGAGACTTTCATCC
ATTTGGTCAGAAAAGACTATTTTTTTATTGTCAAGCTTGGTGGCAAAGGAGCCAT
AGAGGGCGTTGGAGAGAAGCTTGGCGATGGATCTCATGGTCTGATTTTTGTCAC
GGTCGGCGCGCTCCTTGGCCGCAATGTTGAGCTGGACATATTCGCGCGCAACGC
ACTTCCATTCGGGAAAAACAGTGGTGCGCTCGTCGGGCACAATCCTGACGCGCC

TABLE 7-continued

Nucleic Acid Sequences of Vectors

SEQ ID NO Sequence

```
AGCCTCGGTTATGCAGGGTGACCAGGTCCACGCTGGTGGCCACCTCGCCGCGCA
GGGGCTCGTTAGTCCAGCAGAGGCGCCCGCCCTTGCGCGAGCAAAAAGGTGGTA
ACACATCAAGCAAATGCTCGTCAGGGGGGTCCGCATCGATGGTAAAGATGCCCG
GACAGAGTTCCTTGTCAAAATAATCAATTTTTAAGGATGCATCATCCAAGGCCAT
TTGCCAGTTGCGGGCGGCCAGGGCTCGCTCGCAGGGGTTCAGGGGCGGACCCCA
GGGCATGGGATGCGTAAGCGCGGAGGCGTACATGCCGCAGATGTCATACACATA
GATGGGCTCCGAGAGGATGCCGATGTAGGTGGGATAACAGCGCCCCCCGCGGAT
GCTGGCGCGCACGTAGTCATACAACTCATGCGAGGGTGCCAAGAAGGCGGGGCC
AAGATTGGTGCGCTGGGGCTGCTCGGCGCGAAAGACGATCTGGCGAAAGATGGC
ATGCGAGTTGGAGGAAATAGTGGGCCGTTGGAAGATGTTAAAGTGGGCGTGGG
GCAGGCGGACCGAGTCGCGGATAAAGTGCGCGTAGGAGTCTTGCAGCTTGGCGA
CCAGCTCGGCAGTGACAAGGACGTCCATGGCGCAGTAGTCCAGTGTTTCGCGGA
TAATGTCATAACCCGCCTCTCCTTTTTTCTTCCACAGCTCGCGGTTAAGGGCGTA
CTCCTCGTCATCCTTCCAGTACTCCCGGAGCGGGAATCCTCGATCGTCCGCACGG
TAAGAGCCCAGCATGTAGAAATGGTTAACGGCCTTGTAGGGACAGCAGCCCTTC
TCCACGGGGAGGGCGTAAGCTTGAGCGGCCTTGCGGAGCGAGGTGTGCGTCAGG
GCAAAGGTGTCCCTGACCATGACTTTCAAAAACTGGTACTTAAAGTCCGAGTCG
TCGCAGCCGCCGTGCTCCCAGAGCTCAAAATCGGTGCGCTTCTTTGAGAGGGGG
TTAGGCAGAGCGAAAGTGACGTCATTGAAGAGAATCTTGCCTGCTCGTGGCATA
AAAATTGCGGGTGATGCGGAAAGGGCCCGGAACGCAGGCTCGGTTGTTGATAACC
TGGGCGGCTAGGACAATCTCGTCAAAGCCGTTGATGTTGTGCCCGACAATGTAT
AGTTCCATGAATCGCGGGCGGCCTTTGATGTGCGGCAGCTTTTTAAGCTCCTCGT
AGGTGAGGTCCTCGGGGCATTGCAGGCCGTGCTGCTCCAGTGCCCACTCCTGAA
GATGTGGGTTGGCTTGCATGAAGGAAACCCAGAGCTCGCGGGCCATAAGGGTCT
GGAGCTCGTCGCGAAAGAGGCGGAACTGCTGGCCCACGGCCATCTTTTCGGGGG
TGATGCAGTAGAAGGTAAGGGGGTCCCGCTCCCAGCGATCCCAGCGTAAGCGCA
CGGCAAGATCGCGAGCAAGGGCGACCAGCTTGGGGTCCCCGGAGAATTTCATGA
CCAGCATGAAGGGGACAAGCTGCTTGCCGAAGGACCCCATCCAGGTGTAGGTTT
CTACATCGTAGGTAACAAAGAGCCGCTCCGTGCGAGGATGAGAGCCGATTGGGA
AGAACTGGATTTCCTGCCACCAGTTGGACGAGTGGCTGTTAATGTGATGAAAGT
AGAAATCTCTCCGGCGAACCGAGCACTCGTGCTGATGCTTGTAAAAGCGTCCGC
AGTACTCGCAGCGCTGCACGGGCTGTACCTCATCCACAAGATACACAGCGCGTC
CCTTGAGGAGGAACTTCAGGAGTGGCGGCCCTGGCTGGTGGTTTTCATGTTCGCC
TGCGTAGGACTTACCCTGGGGCTCCTCGAGGACGGAGAGGCTGACAAGCCCGCG
CGGGAGCCAGGTCCAAATCTCGGCGCGGCGGGGGCGGAGAGCGAAGACGAGGG
CGCGCAGTTGGGAGCTGTCCATGGTGTTGCGGAGATCCAGGTCCGGGGGCAGGG
TTTTAAGGTTGACCTCGTAGAGGCGGGAGAGGGCGTGCTTAAGATGCAGATGGT
ACTTGATCTCCACGGGTGAGTTGGTGGCCGTGTCCACGCATTGCATGAGCCCGTA
GCTGCGCGGGCCACGACCGTGCCGCGGTGCGCTTTTAGAAGCGGTGTCGCGGA
CGCGCTCCTGGCGGCAGCGGCGGTTCCGGCCCCGTGGGCAGGGCGGCAGAGGC
ACGTCGGCGTGGCGCTCGGCAGGTCCCGGTGCTGCGCCCTGAGAGCGCTGGCG
TGCGCGACGACGCGGCGGTTGACATCCTGGATCTGCCGCCTCTGCGTGAAGACC
ACGGGCCCCGTGACTTTGAACCTGAAAGACAGTTCAACAGAATCAATCTCGGCG
TCATTGACGGCGGCCTGCCGCAGGATCTCTTGCACGTCGCCCGAGTTGTCCTGGT
AGGCGATCTCGGACATGAACTGCTCGATCTCCTCCTCCTGGAGATCGCCGCGGCC
CGCGCGCTCGACGGTGGCGGCAAGGTCATTTGAGATGCGACCCATAAGCTGCGA
AAAGGCACCCAGGCCGCTCTCGTTCCAAACGCGGCTGTAAACCACGTCCCCGTC
AACGTCGCGCGCGCATGACCACCTGCGCAAGGTTCAGCTCCACGTGCCGCGT
AAAGACGGCGTAGTTGCGCAGGCGCTGAAAAAGGTAGTTAAGGGTGGTGGCGA
TGTGCTCGGTGACAAAGAAGTACATGATCAGCGGCGCAGGGGCATTTCGCTGA
TGTCGCCAATGGCCTCCAGCCTTTCCATGGCCTCGTAAAAGTCCACGGCAAAGTT
AAAAAACTGGGCGTTGCGGGCCGATACCGTGAGCTCGTCTTCCAGGAGCCGGAT
GAGCTCGGCAATGGTGGCGCGCACCTCGCGCTCAAAATCCCCGGGAGCCTCCTC
TTGTTCCTCTTCCATGACGACCTCTTCTTCTATTTCCTCTGGGGGCGGTGGTGGTG
GCGGGGCCCGACGACGACGGCGACGCACCGGGAGACGGTCGACGAAGCGCTCG
ATCATTTCCCCGCGGCGGCGACGCATGGTTTCGGTGACGGCGCGACCCTGTTCGC
GAGGACGCAGCGTGAAGACGCCGCCGGTCATCTCCCGGTAATAGGGCGGGTCCC
CGTTGGGTAGCGAAAGGGCGCTAACGATGCATCTTATCAATTGCGGCGTAGGGG
ACGTAAGCGCGTCAAGATCGACCGGATCGGAGAATCTTTGGAGGAAAGCGTCTA
GCCAATCGCAGTCGCAAGGTAAGCTTAAACACGTAGCAGCCCTGTGGACGCTGT
TAGAATTGCGATTGCTGATGATGTAATTGAAGTAGGCGTTTTTGAGGCGGCGGA
TGGTGGCGAGGAGGACCAGGTCCTTGGGTCCCGCTTGCTGGATGCGAAGCCGCT
CGGCCATGCCCCAGGCCTGACCCTGACACCGGCTCAGGTTCTTGTAGTAGTCATG
CATGAGCCTCTCAATGTCATCATTTGCGGCGAGGCGGAGTCTTCCATGCGGGTA
ACCCCAACGCCCCTGAGCGGCTGCACGAGCGCCAGGTCGGCGACGACGCGCTCG
GCAAGGATGGCCTGTTGCACGCGGGTGAGGGTGTCTTGGAAGTCGTCCATGTCA
ACAAAGCGGTGGTAGGCCCCGGTGTTAATGGTGTAGGTGCAGTTGGCCATAAGC
GACCAGTTAACGGTCTGCAGGCCGGGCTGCACAACCTCGGAGTACCTAAGCCGC
GAGAAGGCGCGCGAGTCAAAGACGTAGTCGTTGCAGGTGCGCACAAGGTACTG
GTATCCAACTAGGAAGTGCGGCGGCGGCTGGCGGTACAGCGGCCAGCGCTGGGT
GGCCGGCGCGCCCGGGGCCAGGTCCTCGAGCATGAGGCGGTGGTAGCCGTAGA
GGTAGCGGGACATCCAGGTAATGCCGGCGGCGGTGGTGGAGGCGCGCGGGAAC
TCGCGGACGCGGTTCCAGATGTTGCGCAGCGGTAGGAAATAGTCCATGGTCGGC
ACGGTCTGGCCGGTAAGACGCGCGCAGTCATTGACGCTCTAGAGGCAAAAACGA
AAGCGGTTGAGCAGGCTCTTCCTCCGTAGCCTGGCGGAACGCAAACGGGTTAGG
CCGCGCGTGTACCCCGGTTCGAGTCCCCTCGAATCAGGCTAAAGCCGCGACTAA
```

TABLE 7-continued

Nucleic Acid Sequences of Vectors

SEQ ID NO Sequence

```
CGTGGTATTGGCACTCCCGTCTCGACCCAAGCCCGATAGCCGCCAGGATACGGT
GAAGAGCCTTTTTTGCCGGCCGAGAGGGGTCGCTAGATTTAAAAGCGGTCGAAA
ACCCCGCCGGGTAGTGGCTCGCGCCCGTAGTCTGGAGAAGCATTGCCAGGGTTA
CGTCGCGGCAGAACCCGGTTCGCAGACGGCCGCGGCGAGCGAGCCCCCTTTTTT
CTTTTGCCAGATGCATCCCGTCCTGCGCCAAATGCGTCCCACCCCCCGGCGACC
ACCGCAACCGCGGCCGTAGCAGGCGCCGGCGCTGTACAACAGCAGACAGAGAT
GGACTTGGAAGAGGGCGAAGGGCTGGCAAGACTGGGGGCACCGTCCCCGGAGC
GACACCCCCGCGTGCAGCTGCAAAAGGACGTGCGCCCGGCGTACGTGCCTGCGC
AGAACCTGTTCAGGGACCGCAGTGGGGAGGAGCCCGAGGAGATGCGCGACTGC
CGGTTTCGGGCGGGCAGGGAGCTGCGCGAGGGCCTGGACCGCCAGCGCGTGCTG
CGCGACGATGATTTCGAGCCGAACGAGCAGACGGGGATCAGCCCCGCGCGCGC
GCACGTGGCGGCGGCCAACCTGGTGACGGCCTACGAGCAGACGGTGAAACAGG
AGCGCAACTTCCAAAAGAGTTTCAACAACCACGTGCGCACCCTGATTGCGCGCG
AGGAGGTGGCCCTGGGCCTGATGCACCTATGGGACCTGGCGGAGGCCATCGTGC
AAAACCCGGACAGCAAGCCTCTGACGGCGCAGCTGTTCCTGGTGGTGCAGCACA
GCAGGGACAACGAGGCGTTTAGGGAGGCGCTGCTAAACATTGCCGAGCCCGAG
GGTCGCTGGCTGCTGGAGCTGATTAACATCTTGCAGAGCATCGTAGTGCAGGAG
CGCAGCCTGAGCCTGGCCGAGAAGGTGGCGGCGATCAACTACTCAGTGCTGAGC
CTGGGCAAGTTTTACGCGCGCAAGATTTACAAGACGCCGTACGTGCCCATAGAC
AAAGAGGTGAAGATAGACAGCTTTTACATGCGCATGGCGCTCAAGGTGCTGACG
CTGAGCGACGACCTGGGCGTGTACCGCAACGACCGCATCCACAAGGCCGTGAGC
ACAAGCCGGCGGCGCGAGCTGAGCGACCGCGAGCTGATGCTGAGCCTGCGCCG
GGCGCTGGTAGGGGGCGCCGCCAGCGGCGAAGAGTCCCACTTTGACATGGGGGC
GGACCTGCATTGGCAGCCGAGCCGGCGCGCCTTGGAGGCCGCCTACGGTCCAGA
GGACTTGGATGAGGATGAGGAAGAGGAGGAGGATGCACCCGCTGCGGGTACT
GACGCCTCCGTGATGTGTTTTTAGATGTCCCAGCAGCAAGCCCCGGACCCCGCCA
TAAGGGCGGCGCTGCAAAGCCAGCCGTCCGGTCTAGCATCGGACGACTGGGAGG
CCGCGATGCAACGCATTATGGCCCTGACGACCCGCAACCCCGAGTCCTTTAGAC
AACAGCCGCAGGCCAACAGACTCTCGGCCATTCTGGAGGCGGTGGTCCCCTCTC
GGACCAACCCCACGCACGAGAAGGTGCTGGCGATCGTGAACGCGCTGGCGGAG
AACAAGGCCATCCGTCCCGACGAGGCCGGGCTGGTGTACAACGCCCTGCTGGAG
CGCGTGGGCCGCTACAACAGCACGAACGTGCAGTCCAACCTGGACCGGCTGGTG
ACGGACGTGCGCGAGGCCGTGGCGCAGCGCGAGCGGTTCAAGAACGAGGGCCT
GGGCTCGCTGGTGGCGCTTAACGCCTTTTTGGCAACGCAGCCGGCGAACGTGCC
GCGCGGGCAGGACGATTACACCCAATTTTTATCAGCGCGCTGCGGCTGATGGTGAC
CGAGGTGCCCCAGAGCGAGGTGTACCAGTCGGGCCCGGACTACTTTTTCCAGAC
AAGCCGGCAGGGCCTGCAGACGGTGAACCTAAGCCAGGCTTTCAAGAACCTACG
CGGGCTGTGGGGCGTGCAGGCGCCCGTGGGCGACCGGTCAACGGTGAGCAGCTT
GTTGACGCCCAACTCGCGGCTGCTGCTGCTGATCGCACCCTTCACCGACAGC
GGCAGCGTAAACCGCAACTCGTACCTGGGCCACCTGCTAACGCTGTACCGCGAG
GCCATAGGCCAGGCGCAGGTGGACGAGCAAACCTTCCAGGAGATCACAAGCGT
AAGCCGTGCACTGGGGCAGAACGACACCGACAGTTTGAGGGCCACCCTAAACTT
CCTGCTGACCAATAGACAGCAGAAAATTCCGCCGCAGTACGCACTGTCGGCCGA
GGAAGAAAGGATTCTGAGATATGTGCAGCAGAGCGTAGGGCTGTTCCTGATGCA
GGAGGGGGCCACCCCCAGCGCCGCGCTGGACATGACCGCGCGCAACATGGAAC
CTAGCATGTACGCCGCCAACCGGCCGTTTATTAATAAGTTGATGGACTACCTGCA
CCGCGCGGCCGTCCATGAACTCGGACTACTTTACCAATGCCATCTTGAACCCGCAT
TGGCTCCCGCCGCCAGGGTTCTACACGGGCGAGTACGACATGCCCGACCCCAAC
GACGGGTTTCTGTGGGACGACGTGGACAGCGCGGTATTTTTGCCCGCCTTTCAAA
AGAGACAGGAAGCAATGCGCACGCCTAGCGAGGGCGCTGTGGGAAGGAGCCCC
TTTCCTAGCTTAGGAAGTTTGCATAGCCTACCTAACTCGGTAAACAGCGGCAGG
GTGAGCCGGCCGCATTTGCTGGGCGAGGACGAGTACCTGAACGACTCGCTGCTG
CGGCCGCCGCGGGCCAAGAACGCCATGGCCAATAACGGGATAGAAAGTCTGGT
GGACAAACTAAACCGCTGGAAGACCTACGCTCAGGATCATAGGGACGCGCCCGC
ACCGCGGCGACAGCGCCACGACCGGCAGCGGGGCCTGGTGTGGGACGACGAGG
ACTCGGCCGACGATAGCAGCGTGTTGGACTTGGGCGGGAGCGGTGGTGGGGCCA
ACCCGTTCGCGCATCTGCAGCCCAGACTGGGGCAACGGATGTTTTGAATGCATA
AAATAAAACTCACCAAGGCCATAGCGTGCGTTCTCTTCCTTGTTAGAGATGAGG
CGCGCGGTGGTGTCCTCTCCTCCTCCCTCGTACGAGAGCGTGATGGCGCAGGCA
ACCCTGGAGGTTCCGTTTGTGCCTCCGCGGTATATGGCTCCTACGGAGGGCAGA
AACAGCATTCGTTACTCGGAGCTGGCTCCGCAGTACGACACCACTCGCGTGTACT
TGGTGGACAACAAGTCGGCGGACATCGCTTCCCTGAACTACCAAAACGACCACA
GCAACTTCCTGACCACGGTGGTGCAGAACAACGATTTCACCACCGCGAGGCCA
GCACGCAGACGATAAATTTTGACGAGCGGTCCCGGTGGGCGGTGATCTGAAGA
CCATTCTGCACACCAACATGCCCAATGTGAACGAGTACATGTTCACCAGCAAGT
TTAAGGCGCGGGTGATGGTGGCTAGGAAGCACCCAGAAGGGGTAGACAACACA
GATTTGAGTCAGGATAAGCTTGAATATCAGTGGTTTGAGTTTACCCTGCCCGAGG
GCAATTTTTCCGAGACCATGACCATAGACCTGATGAACAACGCCATCTTGGAAA
ACTACTTGCAAGTGGGGCGTCAAAATGCCGTGCTGGAGAGCGATATTGGAGTCA
AGTTTGACAGCAGAAATTTCAAGCTGGGCTGGACCCGGTAACTAAGCTGGTGA
TGCCGGGGTCTACACCTACGAGGCCTTCCACCCGGACGTGGTGCTGCTGCCGGG
GCTGCGGGGTGGACTTCACCGAGAGCCGCCTGAGCAACCTCCTGGGCATTCGCA
AGAAGCAACCTTTCCAAGAGGGTTTCAGGATCATGTATGAGGATCTAGAAGGCG
GCAACATCCCCGCACTTCTAAATGTAACCAAGTACTTGGAAAGCAAGAAGACGC
TACAGAAGGCAGTGGAAAATGCTGCTAAAGTTAATGCTCCTGCAAGAGGAGATA
GCAGTGTCCCAAGAGCTGTAGAAAAGGCTGCTGAGAAGGAGCTAGAGATTGTTC
```

TABLE 7-continued

Nucleic Acid Sequences of Vectors

SEQ ID NO Sequence

CCATTGAAAAGGATGACAGCAACAGAAGTTATAATATTATACCTGGAACCACGG
ACACCCTGTACCGCAGTTGGTACCTGTCCTATACCTACGGGGACCCCAAAAAGG
GGGTACAGTCGTGGACGCTGCTCACCACCCCGGACGTTACCTGCGGCGCGGAGC
AAGTTTACTGGTCGCTGCCGGACCTCATGCAAGACCCCGTCACCTTTCGCTCCAC
CCAGCAAGTCAGCAACTACCCCGTGGTTGGCGCCGAGCTCATGCCCTTCCGCGC
CAAAAGCTTTTACAACGATCTCGCCGTCTACTCCCAGCTCATCCGCAGCTACACC
TCCCTCACCCACGTCTTCAACCGCTTCCCCGACAACCAGATCCTGTGCCGCCCGC
CCGCGCCCACCATCACCACCGTTAGTGAAAACGTGCCTGCTCTCACAGATCACG
GGACGCTACCGCTGCGCAGCAGTATCCGCGGAGTCCAGCGAGTGACCGTTACTG
ACGCCCGTCGCCGCACCTGTCCCTACGTCTACAAGGCCCTGGGCATAGTCGCGCC
GCGCGTGCTCTCCAGTCGCACCTTCTAGAAAATGTCCATTCTCATCTCGCCCAGC
AATAACACCGGCTGGGGTCTTACTAGGCCCAGCACCATGTACGGAGGAGCCAAG
AAGCGCTCCCAACAGCACCCCGTTCGCGTCCGCGGCCACTTTCGCGCTCCCTGGG
GCGCTTACAAGCGCGGGCGGACCTCTGCCCCCGCCGCCGTGCGCACCACCGTCG
ACGACGTCATTGACTCCGTAGTCGCTGACGCGCGCAACTACACCCCCGCCCCCTC
CACCGTGGACGCGGTCATTGACAGCGTGGTGGCTGACGCGCGCGACTATGCCAG
ACGCAAGAGCCGGCGGCGACGGATTGCCAGGCGCCACCGGAGCACGCCCGCCA
TGCGCGCCGCCCGGGCTCTGCTGCGCCGCGCCAGACGCACTGGCCGCCGGGCCA
TGATGCAAGCCGCGCGTCGCGCCGCCGCCGCACCCACCCCCACAGGCAGGACTC
GCAGACGAGCGGCCGTTGCCGCCGCCGCGGCCATCTCTAGCATGACCAGACCCA
GGCGCGGAAACGTGTACTGGGTGCGCGACTCCATCACGGGCGTGCGCGTGCCCG
TGCGCACCCGTCCTCCTCGTCCCTGATCTAATGCTTGTGTCCTCCCCCGCAAGCG
ACGATGTCAAAGCGCAAAATCAAGGAGGAGATGCTCCAGGTCGTCGCCCCGGA
GATTTACGGACCCCCGGCGGACCAGAAACCCCGCAAAATCAAACGGGTTAAAA
AAAAGGATGAGGTGGGCGAGGGGGCAGTAGAGTTTGTGCGCGAGTTTGCTCCGC
GGCGGCGCGTAAATTGGAAGGGGCGCAGGGTGCAGCGCGTGTTGCGGCCCGGC
ACGGCGGTGGTGTTTACGCCCGGCGAGCGGTCCTCGGTCAGGAGCAAGCGTAGC
TATGACGAGGTGTACGGCGACAACGACATCCTGGACCAGGCGGCGGAGCGGGC
GGGCGAGTTCGCCTACGGGAAGCGGTCGCGCGAAGAGGAGCTGATCTCGCTGCC
GCTGGACGAGAGCAACCCCACGCCGAGCCTGAAGCCCGTGACCCTGCAGCAGGT
GCTGCCCCAGGCGGTGCTGCTGCCGAGCCGCGGGGTCAAGCGCGAGGGCGAGA
ACATGTACCCGACCATGCAGATCATGGTGCCCAAGCGTCGGCGCGTGGAGGACG
TGCTGGACACCGTGAAAATGGATGTGGAGCCCGAGGTTAAGGTGCGCCCCATTA
AGCAGGTGGCGCCGGGCCTGGGCGTGCAGACCGTGGACATTCAGATCCCCACCG
ACATGGATGTCGACAAAAAACCCTCGACCAGCATCGAGGTGCAGACCGACCCCT
GGCTCCCAGCCTCCACCGCCTTTACATCCACGGCCACCGAGCCTTCCAGGAGGC
GAAGATGGGGCCCTGCCAACCGGCTGATGCCCAACTACGTGTTGCATCCTTCCAT
CATCCCGACGCGGGCTACCGCGGCACCCGGTATTACGCCGCGCAGGCGCCC
CGCAGGCAAGCGCCGCCGCCGCACCACCACCCGCCGCCGTCTGGCCCCCGCCCG
CGTGCGCCGCGTAACTACGCGCCAGGGCCGCTCGTTTGTTCTGCCCACCGTGCGC
TACCACCCCAGCATCCTTTAATCCGTGTGCTGTAATACTGTTGCAGAGAGATGGC
TCTCACTTGCCGCCTGCGCATTCCCGTCCCGAATTACCGAGGAAGATCCCGCCGC
AGGAGAGGCATGGCAGGCAGCGGCCTAAACCGCCGCCGGCGGCGGGCCATGCG
CAGGCGCCTGAGTGGCGGGTTCCTGCCTGCGCTTATCCCCATAATCGCCGCGGCC
ATTGGCACGATCCCGGGCATAGCTTCCGTTGCGCTGCAAGCGTCGCAGCGCCGTT
AATGTGCAAATAAAGCCTCTTTAGACTCTGACACACCTGGTCCTGTATATTTTTA
GAATGGAAGACATCAATTTTGCGTCCCTGGCTCCGCGGCACGGCACGCGGCCGT
TCATGGGCACCTGGAACGAGATCGGCACCAGCCAGCTGAACGGGGGCGCTTCA
ATTGGAGCAGTGTCTGGAGCGGGCTTAAAAATTTTGGCTCAACGCTCCGGACCT
ATGGGAACAAGGCCTGGAATAGTAGCACAGGGCAAATGTTAAGGGAAAAGCTC
GCAGACCAGAACTTCCAGCAAAAGGTGGTGGACGGCCTGGCCTCAGGCATTAAC
GGGGTAGTGGACATTGCAAACCAGGCCGTGCAGCGCGAGATAAACAGCCGCCT
GAACCCGCGGCCGCCCACGGTGGTGGAGATGGAAGATGCAACTCCTCCGCCCAG
GGGCGAGAAGCGGCCGCGGCCTGACGCGGAGGAGACGACCCTGCAGGTAGACG
AGCCGCCCTCGTACGAGGAGGCCCTTAAGGCCGGCATGCCCACCACACGCATCA
TTGCGCCAATGGCCACGGGTGTCATGAAACCCGCCACCCTTGACCTGCCTTCACC
ACCCGTGCCCGCTCCACCAAAGGCAGCTCCGGTCGTGCAGGCCCCCCCGGTGGC
AACCGCCGTGCGCCGCGTCCCCGCCCGCCGCCAGGCCCAGAACTGGCAGAGCAC
GCTGCACAGTATCGTGGGCCTGGGAGTGAAAAGTCTGAAGCGCCGCCGATGCTA
TTAAGAGAGGAAAGAGGACACTAAAGGGAGAGCTTAACTTGTATGTGCCTTACC
GCCAGAGAACGCGCGAAGATGGCCACCCCCTCGATGATGCCGCAGTGGGCGTAC
ATGCACATCGCCGGGCAGGACGCCTCGGAGTACCTGAGCCCGGGTCTGGTGCAG
TTTGCCCGCGCCACCGACACGTACTTCAGCCTGGGCAACAAGTTTAGAAACCCC
ACGGTGGCTCCCACCCACGATGTGACCACGGACCGGTCCCAGCGTCTGACGCTG
CGCTTTGTGCCCGTGGATCGCGAGGACACCACGTACTCGTACAAGGCGCGCTTC
ACTCTGGCCGTGGGCGACAACCGGGTGCTAGACATGGCCAGCACGTACTTTGAC
ATCCGCGGCGTTTTGGACCGCGGTCCCAGCTTTAAACCCTACTCGGGCACGGCTT
ACAACAGTTTGGCCCCCAAGGGCGCCCCAAACTCCAGTCAGTGGATTACAAAAC
AAACTAATGCTGGAAACGAAACTACAAAAACTCACACATACGGTGTCGCTGCCA
TGGGAGGCGCTGACATAACAATTAAGGGTCTGCAAATTGGTGTTGACAAAACTG
AAAACAAAAATGAGCCTATCTATGCAAACGAAATCTATCAGCCAGAACCTCAAG
TAGGAGAAGAAAACCTGCAAGATGTTGAAATTACTATGGAGGCAGAGCCCTTA
AAAAGGAAACCAAAATGAAGCCTTGTTATGGCTCATTTGCTAGACCCACAAATG
AAAAAGGAGGGCAGGCTGTATTTAAAACTGGAAATGATGGCCAGCCAACTACTG
AGCATGACATAACAATGGCTTTCTTTGATACTCCTGGCGACACTAATGCTGAAGA
CACAGAACTTGAAGCAGACATTGTTATGTACACCGAAAATGTTAATCTTGAAAC

TABLE 7-continued

Nucleic Acid Sequences of Vectors

SEQ ID NO Sequence

TCCAGATACTCATGTGGTGTACAAGCCAGGACCTTTAGAAGACAGTTCAGAAAT
TAATTTAACACAGCAGTCCATGCCAAACAGGCCAAACTACATTGGCTTCAGGGA
CAACTTTGTAGGCCTTATGTACTACAACAGCACTGGCAACATGGGTGTGCTAGCT
GGTCAGGCCTCTCAGTTGAATGCTGTGGTTGACTTACAAGACAGAAACACGGAG
CTGTCTTACCAGCTTTTGCTAGATTCTCTGGGTGACAGAACCAGATACTTTAGTA
TGTGGAACTCTGCGGTGGACAGTTACGATCCAGATGTCAGGATTATTGAGAATC
ACGGTGTGGAAGATGAACTTCCAAACTATTGCTTTCCATTGGACGGAGCTGGTA
CTAATGCTACATATCAGGGTGTTAAAGTTAAAAATGGACAGGATGGTGACAACA
ACGCAGAATGGGAGAAAGACAATGCAGTTGCGGATCGAAACCAAATTTGCAAG
GGTAACATCGTCGCCATGGAAATTAACCTTCAGGCCAACCTGTGGAAAAGTTTT
CTGTACTCGAACGTGGCCTTGTACCTGCCCGACTCCTTTAAGTACACGCCGGCCA
ACGTCACACTGCCCACCAACACCAACACCTACGAGTACATGAACGGGCGCGTGG
TGGCCCCCTCGCTGGTGGACGCTTACGTTAACATTGGCGCCCGCTGGTCACTGGA
CCCCATGGACAACGTTAACCCCTTTAACCACCACCGCAACCGGGCCTGCGCTA
TCGCTCCATGCTGCTGGGCAACGGGCGCTACGTGCCCTTTCACATCCAAGTGCCC
CAAAAGTTCTTTGCCATTAAAAACCTGCTCCTGCTCCCGGGCTCCTACACCTACG
AGTGGAACTTCCGCAAGGACGTCAACATGATCCTGCAGAGTTCCCTGGGCAACG
ACCTGCGCGTCGACGGCGCCTCCGTCCGCTTTGACAGTGTGAACCTCTACGCCAC
CTTCTTCCCCATGGCGCACAACACCGCCTCCACCCTGGAAGCCATGCTGCGCAAC
GACACCAACGACCAGTCCTTCAACGACTACCTCTCGGCCGCCAACATGCTTTACC
CCATCCCGGCCAAGGCCACCAACGTGCCCATTTCCATCCCCTCGCGCAACTGGGC
CGCCTTTCGCGGCTGGAGTTTTACCCGCCTAAAAACCAAGGAAACTCCCTCACTC
GGCTCGGGTTTCGACCCCTACTTTGTCTACTCAGGCTCCATCCCCTACCTTGACG
GGACCTTCTACCTCAACCACACCTTCAAGAAGGTCTCCATTATGTTCGACTCCTC
GGTTAGCTGGCCCGGCAATGACCGGCTGCTTACGCCGAACGAGTTCGAGATTAA
GCGCAGCGTCGACGGGGAGGGCTATAACGTGGCCCAATGCAACATGACCAAGG
ACTGGTTCCTTATCCAGATGCTTTCCCACTACAACATTGGCTACCAGGGCTTCCA
CGTGCCTGAGGGCTACAAGGACCGCATGTACTCCTTCTTCCGCAACTTCCAGCCC
ATGAGTAGGCAGGTGGTCGATGAGATTAACTACAAGGATTACAAGGCCGTTGCC
CTGCCCTTCCAGCACAACAACTCGGGCTTCACCGGCTACCTCGCACCTACCATGC
GCCAGGGGCAGCCCTACCCCGCCAACTTCCCCTACCCGCTTATTGGAGAGACCG
CCGTGCCCTCCGTCACCCAAAAAAAGTTCCTCTGCGACAGGGTCATGTGGCGCA
TCCCATTCTCCAGCAACTTCATGTCTATGGGCGCCCTTACCGACCTGGGTCAAAA
CATGCTTTACGCCAACTCGGCGCACGCCTCGACATGACCTTTGAGGTGGACCCC
ATGGATGAGCCCACCCTCCTCTATCTTCTCTTTGAAGTTTTCGACGTGGTCAGAG
TGCACCAGCCGCACCGCGGCGTCATCGAGGCCGTCTACCTGCGCACGCCCTTCTC
CGCCGGCAACGCCACCACCTAAGCATGAGCGGCTCCAGCGAACAAGAGCTCGCG
GCCATTGTGCGCGACCTGGGCTGCGGGCCCTACTTTTTGGGCACCCACGACAAG
CGCTTCCCGGGCTTCCTCGCCGGCAACAAGCTGGCATGCGCCATCGTCAACACG
GCCGGCCGCGAGACCGGGGGCGTGCACTGGCTTGCCTTTGGCTGGAACCCGCGC
TCGCGCACCTGCTACATGTTTGACCCCTTTGGGTTTTCGGACCGCCGGCTTAAGC
AGATTTACAGCTTCGAGTACGAGGCCATGTTGCGTCGCAGCGCCCTGGCCTTATC
GCCCGACCGCTGTCTCAGCCTCGAGCAGTCCACCCAGACCGTGCAGGGGCCCGA
CTCCGCCGCCTGCGGACTCTTCTGTTGCATGTTCTTGCATGCCTTCGTGCACTGGC
CCGATCGACCCATGGACGGGAACCCCACCATGAACTTGCTAACGGGGGTGCCCA
ATGGCATGCTACAATCGCCACAGGTGCTGCCCACCCTCCGGCGCAACCAGGAGG
AGCTCTACCGCTTCCTTGCGCACCACTCCCCCTACTTTCGCTCCCACCGCGCCGC
CATTGAACACGCCACCGCTTTTGATAAAATGAAACAACTGCGTGTATGACTCAA
ATAAACAGCACTTTTATTTTACATGCACTGGAGTATATGCAAGTTATTTAAAAGT
CAAAGGGGTTCTCGCGCTCGTCGTTGTGCGCCGCGCTGGGAAGGGCCACGTTGC
GGTACTGGTACTTGGGCTGCCACTTAAACTCGGGGATCACCAGTTTGGGAACAG
CAATCTCGGGGAAGGTCTCGCTCCACATGCGCCGGCTCATCTGCAGGGCGCCCA
GCATGTCCGGGGCTGAAATTTTAAAATCGCAGTTGGGACCGGTGCTCTGCGCGC
GCGAGTTGCGGTACACGGGGTTGCAGCACTGAAACACCATCAAACTGGGGTACT
TTACGCTGGCCAGCACGCTCTTATCGCTAATCTGATCCTTGTCCAGGTCCTCGGC
GTTGCTCAGGCCGAACGGGGTCATCTTACACAGCTGGCGGCCCAGGAAGGGCAC
GCTGTGGGCTTGTGGTTACACTCGCAGTGCACGGGCATTAGCATCATCCCTGCG
CCGCGCTGCATATTCGGGTACAGGGCCTTAATAAAGGCCATAATCTGCTTAAAA
GCTTGCTGGGCCTTGGCTCCCTCGCTAAAAAACAGGCCGCAGCTTTTCCCGCTAA
ACTGGTTATTCCCGCACCCGGCATCCTGCACGCAGCAGCGCGCGTCATGGCTGGT
CAGTTGCACCACGCTTCTCCCCCAGCGGTTCTGGGTCACTTTGGCCTTGCTGGGT
TGCTCCTTCAACGCGCGCTGACCGTTCTCGCTGGTCACATCCATCTCCACCACAT
GGTCCTTGTGGATCATTACCGTCCCGTGCAGACACTTGAGCTGGCCTTCCACCTC
GGCACAGCCGTGGTCCCACAGGGCACTGCCGGTGCACTCCCAGTTTTTGTGCGC
GATCCCGCTGTGGCTAAAGATGTAACCTTGCAACAGGCGACCCATTACGGTGCT
AAAGCTCTTCTGGGTGGTAAAGGTCAGTTGCATCCCGCGGGCCTCCTCGTTTATC
CAGGTCTGGCACATTTTTTGGAAGATCTCGGTCTGCTCGGGCATAAGCTTGTAAG
CATCGCGCAGGCCGCTGTCAACGCGGTAGCGTTCCATCAGCACGTTCATGGTATC
CATGCCCTTCTCCCAGGACGAAACCAAAGGCAGACTCAGGGGGTTGCACACGTT
CAGAATACCGGGGGTCGCGGGCTGGACAATGCGTTTTCCGTCCTTGCCTTCCTTC
AACAGAACCGGCGGCTGGCTAATCCCACTCCCACGATCACGGCATCTTCCTGG
GGCATCTCTTCGTCGGGGTTTACCTTGGTCACATGTTTGGTCTTTCTGGGCTGCTT
CTTTTTTGGAGGGCTGTCCAGTGGAACACGTCCTCCTCGGAAGACCCGGAGCCC
ACCCGCTGATACTTTCGGCGCTTGGTGGGCAGAGGAGGTAGCGGCGGCGAGGGG
CTCCTTTCCTGCTCCGGCGGATAGCGCGCCGACCCGTGGCCCCGGGGCGGAGTG
GCCTCTCGGTCCATAAACCGGCGCACGTCCTGACTGCCGCCGGCCATTGTTTCCT

TABLE 7-continued

Nucleic Acid Sequences of Vectors

SEQ ID NO Sequence

AGGGGAAGATGGAGGAGCAGCCGCGTAAGCAGGAGCAGGAGGAGGAGAACTT
AACCACCCACGAGCAACCCAAAATCAAGCAGGACCTGGGCTTGGAAGAGCCGG
CTCGTCTAGAACCCCCACAGGATGAACAGAAGGAAACCAACGCTGGGCTGGAG
CATGGCTACCTGGGAGGACAGGAGGATGTGCTGCTAAAACACTTGCAGCGCCAG
TCCTTTATCCTCCGGGACGCTCTGGCCGACCGAAGCAAAACCCCCCTCAGCGTCC
AGGAGCTGTGTCGGGCCTATGAGCTCAACCTCTTCTCGCCGCGCGTGCCCCCCAA
ACGCCAGCCCAACGGCACCTGCGAGCCCAACCCGCGTCTTAACTTTTACCCCGTC
TTTGCAGTCCCCGAGGCCCTTGCCACTTATCACATCTTTTTTAAGAACCAAAAGA
TCCCCGTTTCCTGCCGTGCCAACCGCACCCGCGCCGACGCGCTCCTCGCTCTGGG
GCCCGGCGCGCGCATACCTGATATTGCTTCCCTGGAAGAGGTGCCCAAGATCTTC
GAAGGGCTTGGTCGGGACGAGACGCGCGCGGCGAACGCTCTGAAAGAAACAGC
AGAGGAACAGGGTTACACTAGCGCCCTGGTAGAGTTGGAAGGCGATAACGCCA
GGCTGGCCGTGCTTAAGCGCAGCGTCGAGCTCACCCATTTTGCCTACCCCGCCGT
TAACCTCCCGCCCAAGGTCATGCGTCGCATCATGGATCAGCTCATCATGCCCCAC
ATTGAGGCCCTTGATGAAAGCCAAAAGCAGCGCCCTGAGGACGCCCAGCCCGTG
GTTAGCGACGAAATGCTTGCGCGCTGGCTCGGAAACCGCGACCCCCAGTCCCTG
GAGCAGCGGCGTAAGCTCATGCTGGCCGTGGTCCTGGTCACCCTCGAGTTGGAA
TGTATGCGCCGCTTTTTTAGCGACCCCGAGACCCTGCGCAAGGTCGAGGAGACC
CTGCACTACACTTTTAGGCACGGCTTTGTCAGGCAGGCCTGCAAGATCTCCAACG
TGGAGCTAACCAACCTGGTCTCCTGCCTGGGGATCCTACACGAGAACCGCCTGG
GGCAGACTGTGCTTCACTCGACCCTCAAGGGCGAGGCACGGCGGGACTACATCC
GCGACTGCGTCTTTCTTTTTCTCTGCCACACCTGGCAGTCGGCCATGGGCGTGTG
GCAGCAGTGTCTCGAGGACGAGAACCTGAAGGAGCTGGACAAGCTTCTTGCTAA
AAACCTTAAAACGTTGTGGACGGGCTTTGACGAGCGCACCGTCGCCTTGGACCT
GGCCGAAATTGTTTTTCCCGAACGCCTAAGGCAGACGCTAAAAGGCGGGCTGCC
CGACTTTATGAGCCAGAGCATGTTGCAAAACTACCGCACTTTCATTCTCGAGCGA
TCGGGGATCCTGCCCGCCACCTGCAACGCCTTCCCCTCCGACTTTGTCCCGCTGA
GCTACCGCGAGTGTCCCCCGCCGCTGTGGAGCCACTGCTACCTCTTGCAGCTGGC
CAACTACATTGCCTACCACTCGGACGTGATCGAGGACGTAAGCGGCGAGGGGCT
GCTTGAGTGCCACTGCCGCTGCAACCTGTGCTCCCCGCACCGCTCCCTGGTCTGC
AACCCCCAGCTCCTGAGCGAGACCCAGGTCATCGGTACCTTCGAGCTGCAAGGT
CCGGAGAAGTCCACCGCTCCGCTGAAACTTACGCCGGGGTTGTGGACTTCCGCG
TACCTGCGCAAATTTGTACCCCAGGACTACCACGCCCACGAAATAAAGTTCTTTG
AGGACCAATTGCGCCCGCAGCACGCGGATCTTACGGCCTGCGTCATCACCCAGG
GCACGATCCTGCCCCAATTGCACGCCATCCAAAAATCCCGCCAAGAGTTTCTTCT
GAAAAAGGGTAAAGGGGTCTACCTGGACCCCCAGACGGGCGAAGTGCTTAACC
CGGGTCTCCCCCAGCATGCCAAGAAAGAAGCAGGAGCCACTAGTGGAGGAGAT
GGAAGAAGAATGGGACAGCCAGGCAGAGGAGGACGAATGGGAGGAGGAAGAA
TTGGAAGAGGTGGAACAGGAGCAGGCAACAGAGCAGCCCGTCGCCGCACCATC
CGCGCCGGCAGCCCCTCCGGTCAAGCCTCCTCGTAGATGGGATCGAGTAAAGGG
TGACGGTAAGCACCAGCGGCAGGGCTACCGATCATGGAGGGCCCACAAAGCCG
CGATTATTGCCTGCTTGCAAGACTGCGGGGGGAACATCGCTTTTGCCCGCCGCTA
CCTGCTTTTCCACCGCGGGGTAAACATCCCCGCAACGTGTTGCATTACTACCGT
CACCTTCACAGCTAACAAAAAGCAAGTAAAAGAAGTCGCCGGAGGAGGAGGCC
TGAGGATTGCGGCGGACGAGCCCTTGACCACCAGGGAGCTAAGGAACCGAATCT
TCCCCACTCTTTATGCCATTTTTCAGCAGAGTCGAGGTCAGCAGCAAGAGCTTAA
AGTAAAAAATCGGTCTCTGCGCTCGCTCACCCGCAGTTGCTTGTACCACAAAAA
CGAAGATCAGCTGCAGCGCACTCTTGAAGACGCCGAGGCTTTGTTCCACAAGTA
CTGCGCGCTTACTCTTAAAGACTAAGGCGCGCCCACCCGGAAAAAAGGCGGGAA
TTACCTCATCGCCAGCACCATGAGCAAGGAGATTCCCACACCTTACATGTGGAG
CTATCAGCCCCAGATGGGCCTAGCCGCGGGCGCCTCCCAGGACTACTCCACCCG
CATGAACTGGCTTAGTGCCGGGCCCTGATGATCTCACAAGTCAACGGGATCCG
TAACCATCGAAACCAGATATTGTTGGAGCAGGCGGCGGTCACCTCCACGCCCAG
GGCAAAGCTTAACCCGCGTAATTGGCCCTCCACCCTGGTGTATCAGAAAATCCC
CGGGCCAACTACCGTACTACTTCCGCGTGACGCACTGGCCGAAGTCCGCATGAC
TAACTCAGGTGTCCAGCTGGCGGGCGGCGCTTCCCGGTGTCCGCCCAGACCCGA
CTTAGGTATAAAAACACTGCTGATCCGAGGCAAAGGCATACAACTTAACAACGA
GTTGGTGAGCTCTTCCATTGGTCTGCGACCCGACGGAGTGTTTCAACTAGCCGGA
GCCGGGAAATCGTCCTTCACTCCCAACCAGGCCTACCTGACCTTGCAGAGCAGC
TCTTCGCAGCCTCGCTCCGGAGGCATTGGAACTCTCCAGTTCGTGGAGGAGTTTG
TGCCCTCGGTTTACTTTAACCCCTTTTCAGGCTCCCAGGCCTCTACCCCGACGA
GTTCATACCGAACTTCGACGCAGTTAGAGAAGCGGTCGACGGCTACGACTGAAT
GTCCTATGGTGACTCGGCTGAGCTTGCTCGGTTAAGGCATCTGGACCACTGCCGC
CGCCTGCGCTGCTTTGCCCGGGAGAGCTGCGGCCTTGTTTACTTTAAGCTGCCCG
AGGAGCACCCTAACGGCCCTGCACACGGAGTGCGGATCACCGTAGAGGGCACC
ACCAAGTCTTACCTGGTCAGGTTTTTTACCCAGCAACCCTTCCTGGTCGAGCGGG
ACCGGGGCGCCACCACCTACACCGTGTACTGCATTTGTCAACCCCGAAGTTGC
ATGAGAATTTTTGCTGTACTCTTTGTGGTGAGTTTAATAAAAGCTGAAATAAGAC
TCTACTCTGGAATCCAGTGTCGTCATAATCGCACCAAGACCATTAACTTTACCAC
CCAGGAACAGGTGAACTTTACCTGCAAACCCCACAAGAAGTACCTCATCTGGTT
CCTCAAGAACACTACTTTTGCAGTAGTTAACACCTGTGACAACGACGGTGTTCTT
CTTCCCAACAATCTTACCAGTGGACTAGCCTTCTCTGTTAAAAGGGCAAAGCTAA
TTCTTCATCGCCCTATTGTAGAAGGAACTTACCATTGTCAGAGCGGACCTTGTCA
TCACATTTTCCATTTGGTGAACGTCACCAGCAGCAGCAACAGCTCAGAAACTAA
CCTCTCTTCTCGTACTAACAGACCTCAATTCGGAGGTGAGCTAAGGCTTCCCCCT
TGTAAGGAGGGGGTTAGCCCATACAAGGTGGTCGGGTATTTAATTTTAGGGGCG

TABLE 7-continued

Nucleic Acid Sequences of Vectors

SEQ ID NO Sequence

```
GTCCTGGGTGGGTGCATAGCGGTGCTAGCCCAACTGCCTTGCTGGGTGGAAATC
AATCTTTATCTGCTGGGTTAGATATTGCGGGGAGGAACCATGAAGGGGCTTTTGC
TAATTATCCTTTCCCTGGTGGGGGGTGTACTGTCATGCCACGAACAGCCACGATG
TAACATTACCACAGGCAATGAGAGGAGTGTTATATGTACAGTAGTTATTAAATG
CGAGCATCAATGCCCTCTCAACATTACATTTAAAAACCGTACCATGGGGAATGC
ATGGGTAGGCTACTGGGAACCAGGAGATGAGCAGAACTACACGGTCACTGTCCA
TGGTAGCGATGGAAATCACACTTTCGGTTTCAAATTTATTTTTGAAGTCATGTGT
GATATCACACTGCATGTGGCTAGACTTCATGGCTTGTGGCCCCCTACCAAGGAG
AACATGGTTGGGTTTTCTTTGGCTTTTGTAATTATGGCCTGCTTTATGTCAGGTCT
GCTGGTAGGGGCTCTAATGTGGTTTTTAAAGTGCAAGCCCAGGTATGGAAATGA
GCAGAAGGAAAAATTGCTATAAATTTTTTTTTTTTTTTTACAGTACCATGAATAC
TTTAACCAGTGTCGTGCTGCTCTCTCTTCTTGTAGCTTTTAGTGAGGCAGGAATTA
TTAACTTAAATGTATCATGGGGAATCAATCTAACTTTAGTGGGACCATTAGACCT
GCCAGTTACATGGTATGATGGAAAGGGAATGCAGTTTTGTGATGGAAATACAAT
TAAAAACCCACAAATCAAGCATAGCTGTAATCAACAAAATCTAACTTTACTTAA
TGCTGACAAGTCTCATGAAAGGACTTACTTAGGTTACAGACATGACAGTAAGGG
AAAAGTAGACTATAAGGTTACAGTCATACCACCTCCTTCAACCACTCGCAAGCC
TTTGTCACAGCCTCACTATGTTACTGTGACTATGAACCATAACATGACTTTAGTG
GGTCCCTTAAACCTGCCAGTTACATGGTATGATGGAGAAGGAAATAAATTGTGC
AATGGAGAAAAAGTTGAGCATGCAGAATTTAATCATACATGTAACATCCAGAAC
CTGACACTGCTCTTTGTTAACTTAACGCATAATGGAGCATACATTGGTTATAACA
AAGACGGTTCTAATAGAGAATTATATGAGGTGTCAGTCAAAACCTTGTTTCAAA
ACGGGGCTAAACAAAGTAAGGTTGAACAAAGTAATATTGGACAAGGTAATACT
GCTCAAAGTGCAAAAAGAAAATCAACAAATAACCTTCAGCCAACACAATTGTAT
GTTAGACCTTTTACTAATGTTAGTTTAACTGGACCTCCAAATGGCAAGGTTATTT
GGTATGATGGCGAACTTAATGATCCATGTGAACAAAAGTACAAACTTAAAACTT
TTTGCAATCAGCAAAATCTAACTTTAATTAATGTAACCAGCACTTATGATGGCAT
CTATTATGGTACTGATGAAAAAGATAAGGCAAATCGTTACAGAATAAAAGTAAA
TACTACAAATCACAAAACTGTTAAAATTAAGCCACATACCAAAGAACCTCCTGC
TGAACAAAAAAAACAGTTTCAATTACAAGTTGCAGAAACTGATCAAAACGAATC
AAAAATTCCCTCAGCTACTGTGGCAATCGTGGTGGGAGTGATTGCGGGCTTTGTA
ACTCTAATCATTGTTTTTATTTGCTACATCTGCTGCCGCAAGCGTCCAAGGGCAT
ACAATTATATGGTAGACCCACTACTCAGCTTCTCCTACTAAAACTCAGTCATTCT
TATTTCAGAACCATGAAGGCTTTCACAGCTTGCGTTCTGATTAGCATAGTCACAC
TTAGTCTTTCTCAAATCATTAATGTAAATGTTACCAGAGGAGGTAGTATTACATT
AAATGGAACTTATAAAAACACTACATGGACAAGATATCACTTAGACTCATGAA
AAATTTATGCAAGTGGAATATGACAGCTTACAAGTGTTATGATAATGGAAGCAT
TACTATTACTGCCACTGGTAAAATTACTTCTGGCAAATACAAGGCAGAAAGTTA
CAAAAATGAAATTAAGAAATCAGTATTTAAAACTAATAAAACTACATTTGAAGA
TTCTGGAAATTATGAACATCAAAAAATAACTTTCTATCAGCTAACAATTATTCAA
CTACCTACTACTAAGGTACCAACCACCACAGCCAGTACATACACTACACAGCTA
AACACAACAGTGCAGAATAGTACTGTGTTGGTTAGGTACTTGCTGAGGGAGGAA
AGTACTACTCAACAGACAGATGCTACCTTAAGTGCCTTTAGCAGCACTGCAAATT
TAACTTCGCTTGCTTGGACTAATGAAACCGGAGTATTATTAATGCATGGCCAGCC
TTACTCAGGTTTGCATATTCAAATTACTTTTCTGGTTATCTGTGGGATCTTTATTC
TCGTGGTTCTTTTGTACTTTGTTTGCTGCAAAGCCAGAAAAAAATCTAGGAGACC
CATCTACAGGCCAGTAATCGGGAATCCTCAGCCTTTCCAAGTGGAAGGGGGTCT
AAGGAATCTTCTTTTTTCTTTTTCAGTATGGTGATCAGCCATGATTCCTAGGTTCT
TCCTATTTAACATCCTCTTCTGTCTTTTTAACGTGTGCGCTGCCTTTGCGGCCGTT
TCGCACACCTCACCCGACTGTCTTGGGCCATTCCCCACCTACCTTCTCTTTGCCCT
GCTCACCTGCACCTGCGTCTGCAGCATTGTCTGCCTGGTCATTACCTTCCTGCAG
CTTATCGACTGGTGCTGCGCGCTACAATTATCTTCACCACAGTCCCGAATACA
GGGACAAGAACGTAGCCAAACTCTTAAGGCTTATATGACCATGCAGACTCTGCT
AATACTGCTATCCCTTTTATCCCCCGCCCTTGCCACTTTTGATTACTCTAAATGCA
AATTTGTTGAGCTATGGAATTTCTTAAACTGCTATAATGCTACAATGGATATGCC
TTCCTATTACTTGGTAATTGTGGGAATAGTGATGGTCTGCTCCTGCACTTTCTTTG
CTATTATGATCTACCCCTGTTTTGATCTCGGCTGGAACTCTGTTGGGGCATTTACA
TACACACTACAAAACAGTTCACCAGCCTTCACACCGCCTCCCCGCAGAAATCAG
TTCCCCCTGATTCAGTACTTAGAAGAGCCCCCTCCCGGCCCCCTTCCACTGTTA
GTTACTTTCACATAACCGCCGGCGATGACTGACAACCACCTGGACCTTGAGATG
GACGGCCAGGCCTCCGAGCAACGCATCCTGCAACTGCGCGTCCGTCAGCAGCAG
GAGCGAACCGCCAAGGAGCTCCTTGATGCCATCAACATCCACCAGTGCAAGAAA
GGCATTTTTTGCCTGGTCAAACAGGCAAAAATTACCTACGAGCTTATGTCCGGCG
GCAAGCAGCATCGCCTTGCCTATGAGCTGCCCCAGCAGAAGCAAAAGTTCACCT
GCATGTGGGCGTCAACCCCATAGTCATCACCCAGCAGACGGGCGAAACCAGCG
GCTGTATCCATTGCTCCTGCGAAAGCCCCGAGTGTATCTACTCCCTCCTTAAGAC
CCTTTGCGGACTTCGCGACCTCCTACCCATAAACTAATTGATTAAAGTTTAGAAA
CCAATCACACCCCATTCCCCATTTTCCCACATAAACAATCATTAGAAATAATTAC
TTAATAAAATTACTTACTTGAAATCTAAAAGTATGTCTCTGGTGTAGTTGTTTA
GCAATACCTCGGTCCCCTCCTCCCAGCTCTGGTACTCCAGTCCCCGGCGGGCGGC
GAACTTCCTCCACACCTTGAAAGGGATGTCAAATTCCTGGTCCACAATTTTCATT
GTCTTCCCTCTCAGATGTCAAAGAGGCTCCGGGTGGAAGATGACTTCAATCCCGT
CTACCCCTATGCTACGCGCGGAATCAAAATATCCCCTTCCTTACTCCCCCCTTT
GTCTCCTCCAATGGATTCCAAAACTTCCCCCCTGGGGTTCTGTCACTCAAACTGG
CTAACCCAATCACCATCACCAATGGAAATGTCTCACTCAAGGTTGGAGGTGGGC
TAACTTTGCAAGAAGAAACTGGAAAACTAACAGTTAATACTGAACCACCTTTGC
```

TABLE 7-continued

Nucleic Acid Sequences of Vectors

| SEQ ID NO | Sequence |
|---|---|
| | AACTTACAAATAACAAATTAGGTATTGCTTTAGACGCTCCATTTGATGTTATAGA |
| | CAATAAGCTGACACTATTAGCAGGCCATGGCTTGTCTATTATAACAAAAGAAAC |
| | ATCAACACTGCCTGGCTTGGTTAATACTCTTGTAGTATTAACTGGAAAGGGTATT |
| | GGAACAGATTCACATAATGGTGGAAATATATGTGTTAGAGTTGCAGAAGGCGGT |
| | GGCTTATCATTTAATGATAATGGAGACTTGGTAGCATTTAATAAAAAAGAAGAT |
| | AAACGCACCCTATGGACAACTCCAGACACATCTCCAAATTGCAGAATTGATCAG |
| | GATAAGGACTCTAAGCTAACTTTGGTCCTTACAAAGTGTGGAAGTCAAATATTA |
| | GCCAATGTGTCATTAATTGTCGTAGCTGGAAGGTACAAAATTATCAATAACAAT |
| | ACTCAACCAGCTCTCAAAGGATTTACCATTAAATTGTTGTTTGATAAAAATGGAG |
| | TCCTTATGGAATCTTCAAATCTTAGTAAATCATATTGGAACTTTCGAAATGAAAA |
| | TTCAATTATGTCAACAGCTTATGAAAAAGCTATTGGTTTTATGCCTAATTTGGTA |
| | GCCTATCCAAAACCTACCACTGGCTCTAAAAAATATGCAAGAGATATAGTTTAT |
| | GGAAACATCTACCTTGGCGGAAAGCCACATCAACCAGCAACCATTAAAACTACC |
| | TTTAACCAGGAAACTGGATGTGAATACTCTATTACATTTGATTTTAGTTGGGCCA |
| | AAACTTATGTAAATGTTGAATTTGAAACTACCTCTTTTACCTTTTCCTATATTGCC |
| | CAAGAATAAAAGACAAATAAACGTGTTTTTCATTTAAAAATTTCATGTATCTTTA |
| | TTAATTTTTACACCAGCGCGGGTACACATTCTCCCACCACCAGCCCATTTTACAG |
| | TGTAAACAATTCTCTCAGTACGGGTGGCCTTAAATAGGGGAAAGTTCTCATTAGT |
| | GCGGGAACTGGACTTGGGGTCTATAATCCACACAGTTTCCTGGCGAGCCAAACG |
| | GGGGTCGGTGATTGAGATGAAGCCGTCCTTTGACAAATCATCCAAGCGGGCCTC |
| | ACAGTCCAAGGTCACAGTCTGGTGGAATGAGAAGAACGCACAGACTCATACTCG |
| | GAAAACAGGATGGGTCTGTGCCTCTCCATCAGCGCCCTTAACAGTCTTTGCCGCC |
| | GGGGCTCGGTGCGGCTGCTACAAATGGGATCGGATCGCAAGTCTCTTTGACTA |
| | TAATCCCCACAGCCCTCAGCATCAGTCTTCTGGTGCGTCGGGCACAGCACCGCAT |
| | TCTAATTTCGCTCATGTTTTCACAGTAAGTGCAGCACATAATCATTATGTTATTCA |
| | GCAGCCCATAATTTAGGGTGCTCCAGCCAAAGCTTATGTTGGGAATGATGGAAC |
| | CCACGTGACCATCGTACCAAATGCGGCAGTATATCAGGTGCCTGCCCCTTATAA |
| | ACACACTGCCCATATACATAATCTCTTTGGGCATATTTCTGTTCACAATCTGCCG |
| | GTACCAGGGGAAGCGCTGGTTAAACATGCACCCGTAAATGACTCTCCTAAACCA |
| | CACGGCCAGCAGGGTGCCTCCCGCCCGGCACTGCAGGGAGCCCGGGGATGAAC |
| | AGTGGCAATGCAGGATCCAGCGCTCGTACCCGCTTACCATCTGGGCTCTCACCA |
| | GATCCAGGGTAGCGGGACACAGGCACACTGACATACATCTTTTTAAAATTTTTAC |
| | TTCCTTTGTGGTCAGGATCATATCCCAGGGGACTGGAAACTCTTGCAGCAG |
| SEQ ID NO: 1451 | CTATCTATATAATATACCCCACAAAGTAAACAAAAGTTAATATGCAAATGAGCT |
| | TTTGAATTTTAACGGTTGTGGGCGGAGCCAACGCTAATTGGACGAGAAGCGGT |
| | GATGCAAATAACGTCACGACGCACGGCTAACGGCCGGCGCGGAGGCGTGGCCT |
| | AGGCCGGAAGCAAGTCGCGGGGCTGATGACGTATAAAAAAAGCGGACTTTAGAC |
| | CCGGAAACGGCCGATTTTCCCGCGGCCACGCCCGGATATGAGGTAATTCTGGGC |
| | GGATGCAAGTAAAATTAGGTCATTTTGGCGCCAAAACTGAATGAGGAAGTGAAA |
| | AGTGAAAAATACCTGTCCCGCCCAGGGCGGAATATTTACCGAGGGCCGAGAGAC |
| | TTTGACCGATTACGTGGGGTTTCGATTGCGGTGTTTTTTTCGCGAATTTCCGCGTC |
| | CGTGTGAAAGTCCGGTGTTTATGTCACAGATCAGCTGATCCACAGGGTATTTAAA |
| | CCAGTTGAGCCCGTCAAGAGGCCACTCTTGAGTGCCAGCGAGTAGAGATTTCTC |
| | TGAGCTCCGCTCCCAGAGTCTAAAAAAAATGAGACACCTGCGCCTTCTGTCTTCA |
| | ACTGTGCCTATTAACATGGCCGCATTATTGCTGGAGGACTATGTGAGTACAGTAT |
| | TGGAGGACGAACTACATCCATCTCCATTTGAGCTGGGACCTACACTTCAGGACCT |
| | TTATGATTTGGAGGTAGATGCCCATGATGACGACCCAAACGAAGAGGCTGTGAA |
| | TTTAATATTTCCAGAATCTCTGATTCTTCAGGCTAACATAGCCAGCGAAGCTGTA |
| | CCTACACCACTTCATACACCGACTCTGTCACCCATACCTGAATTGGAAGAGGAG |
| | GACGAGCTAGACCTCCGATGTTATGAGGAAGGTTTTCCTCCCAGCGATTCAGAG |
| | GACGAACAGGGTGAGCAGAGCATGGCTCTAATCTCAGAATATGCTTGTGTGGTT |
| | GTGGAAGAGCATTTTGTGTTGGACAATCCTGAGGTGCCCGGGCAAGGCTGTAGA |
| | TCCTGCCAGTACCACCGGGATAAGACCGGAGACACGAACGCCTCCTGCGCTCTG |
| | TGTTACATGAAAAAGAACTTCAGCTTTATTTACAGTAAGTGGAGTGAATGTGAG |
| | AGAGGCGAGTGCTTAACACATAACTGGGTGATGCTTAAACAGCTGTGCTAAGTG |
| | TGGTTTATTTTTGTTTCTAGGTCCGGTGTCAGAGGATGAGTCATCACCCTCAGAA |
| | GAAGACCACCCGTGTCCCCCTGAGCTGTCAGGCGAAACGCCCCTGCAAGTGCAC |
| | AGACCCACCCCAGTCAGACCCAGTGGCGAGAGGCGAGCAGCTGTTGAAAAAATT |
| | GAGGACTTGTTACATGACATGGGTGGGATGAACCTTTGGACCTGAGCTTGAAA |
| | CGCCCCAGGAACTAGGCTCAGCTGTGCTTAGTCATGTGTAAATAAAGTTGTACA |
| | ATAAAAGTATATGTGACGCATGCAAGGTGTGGTTCATGATTCATGGGCGGGGCT |
| | TAGTCCTATATAAGTGGCAACACCTGGGCACTGGGGCACAGCCTTTAGGGAGT |
| | TCCTGATGGATGTGTGGACTATCCTTGCAGACTTTAGCAAGACACGCCGACTTGT |
| | AGAGGATAGTTCAGACGGGTGCTCCGGTTCTGGAGACACTGGTTTGGAACTCC |
| | TCTATCTCGTCGGTGTACACAGTTAAGAAGGATTATAACGAGGAATTTGAAAA |
| | TCTTTTTGCTGATTGCTCTGGCCTGCTAGATTCTCTGAATCTCGGCCACCAGTCCC |
| | TTTTCCAGGAAAGGGTACTCCACAGCCTTGATTTTTCCAGCCCAGGGCGCACTAC |
| | AGCCGGGTTGCTTTTGTGGTTTTTCTGGTGACAAATGGAGCCAGAACACCCAA |
| | CTGAGCAGGGCTACATTCTGGACTTTGCAGCCATGCACCTGTGAGGGCATGG |
| | GTGAGGCAGCGGGACAGAGAATCTTGAACTACTGGCTTATACAGCCAGACAGT |
| | CCGGGTCTTCTTCGTCTACACAGACAAACATCCATGTTGGAGGAAGAAATGAGG |
| | CAGGCCATGGACGAGAACCCGAGGAGCGGCCTGGACCCTCCGTCGGAAGAGGA |
| | GCTGGATTGAATCAGGTATCCAGCTTGTACCCAGAGCTTAGCAAGGTGCTGACA |
| | TCCATGCCAGGGGAGTGAAGGGGAGAGGAGCGATGGGGGCAATACCGGGAT |
| | GATGACCGAGCTGACGGCCAGCCTGATGAATCGCAAGCGCCCAGAGCGCATTAC |

TABLE 7-continued

Nucleic Acid Sequences of Vectors

SEQ ID NO Sequence

```
CTGGCACGAGCTACAGATGGAGTGCAGGGATGAGTTGGGCCTGATGCAGGATAA
ATATGGCCTGGAGCAGATAAAAACACATTGGTTGAACCCAGATGAGGATTGGGA
GGAGGCCATTAAGAAATATGCCAAGATAGCCCTGCGCCCAGATTGCAAGTACAT
AGTGACCAAGACCGTGAATATTAGACATGCCTGCTACATTTCGGGGAACGGGGC
AGAGGTGGTCATCGATACCCTGGACAAGGCCGCCTTCAGGTGTTGCATGATGGG
AATGAGAGCAGGAGTGATGAATATGAATTCCATGATCTTCATGAACATGAAGTT
CAATGGAGAGAAGTTTAATGGGGTGCTGTTCATGGCCAACAGCCACATGACCCT
GCATGGCTGCAGTTTCTTTGGCTTTAACAATATGTGCGCCGAGGTCTGGGGCGCT
TCCAAGATCAGGGGATGTAAGTTTTATGGCTGCTGGATGGGCGTGGTCGGAAGA
CCCAAGAGCGAGATGTCTGTAAAGCAGTGTGTGTTTGAGAAATGCTACCTGGGA
GTCTCTACCGAGGGCAATGCTAGAGTGAGACACTGCTCTTCCTGGATACGGGC
TGCTTCTGCCTGGTGAAGGGTACGGCCTCTCTAAAGCATAATATGGTGAAGGGC
TGCACAGATGAGCGCATGTACAACATGCTGACCTGCGACTCGGGGGTCTGCCAT
ATCCTGAAGAACATCCATGTGACCTCCCACCCCAGAAAGAAGTGGCCAGTGTTT
GAGAATAACCTGCTGATCAAGTGCCATATGCACCTGGGTGCCAGAAGGGGCACC
TTCCAGCCGTACCAGTGCAACTTTAGCCAGACCAAGCTGCTGTTGGAGAACGAT
GCCTTCTCCAGGGTGAACCTGAACGGCATCTTTGACATGGATGTCTCGGTGTACA
AGATCCTGAGATACGATGAGACCAAGTCCAGGGTGCGCGCTTGCGAGTGCGGGG
GCAGACACACCAGGATGCAGCCAGTGCCCTGGATGTGACCGAGGAGCTGAGA
CCAGACCACCTGGTGATGGCCTGTACCGGGACCGAGTTCAGCTCCAGTGGGGAG
GACACAGATTAGAGGTAGGTTTGAGTAGTGGGCGTGGCTAATGTGAGTATAAAG
GCGGGTGTCTTACGAGGGTCTTTTTGCTTTTCTGCAGACATCATGAACGGGACCG
GCGGGGCCTTCGAAGGGGGGCTTTTTAGCCCTTATTTGACAACCCGCCTGCCGGG
ATGGGCCGGAGTTCGTCAGAATGTGATGGGATCGACGGTGGACGGGCGCCCAGT
GCTTCCAGCAAATTCCTCGACCATGACCTACGCGACCGTGGGGAACTCGTCGCTC
GACAGCACCGCCGCAGCCGCGGCAGCCGCAGCCGCCATGACAGCGACGAGACT
GGCCTCGAGCTACATGCCCAGCAGCAGCAGTAGCCCCTCTGTGCCCAGTTCCATC
ATCGCCGAGGAGAAACTGCTGGCCCTGCTGGCCGAGCTGGAAGCCCTGAGCCGT
CAGCTGGCCGCCCTGACCCAGCAGGTGTCCGAGCTCCGCGAACAGCAGCAGCAG
CAAAATAAATGATTCAATAAACACAGATTCTAATTCAAACAGCAAAGTATCTTT
ATTATTTATTTTTTCGCGCGCGATAGGCCCTGGTCCACCTCTCCCGATCATTGAG
AGTGCGGTGGATTTTTTCCAGGACCCGGTAGAGGTGGGATTGGATGTTAAGGTA
CATGGGCATGAGCCCGTCCCGGGGGTGGAGGTAGCACCACTGCATGGCCTCGTG
CTCTGGGGTCGTGTTGTAGATGATCCAGTCATAGCAGGGGCGCTGGGCGTGGTG
CTGGATGATGTCCTTGAGGAGGAGACTAATGGCCACGGGGAGCCCCTTGGTGTA
GGTGTTGGCGAAGCGGTTGAGCTGGGAGGGATGCATGCGGGGGGAGATGATGT
GCAGTTTGGCCTGGATCTTGAGGTTGGCGATGTTGCCACCCAGATCCCGCCGGG
GGTTCATGTTGTGCAGGACCACCAGAACGGTGTAGCCCGTGCACTTGGGGAACT
TGTCATGCAACTTGGAAGGGAATGCGTGGAAGAATTTGGAGACGCCCTTGTGCC
CGCCCAGGTTTTCCATGCACTCATCCATGATGATGGCGATGGGCCCGTGGGCTGC
GGCTTTGGCAAAGACGTTTCTGGGGTCAGAGACATCATAATTATGCTCCTGGGTG
AGATCATCATAAGACATTTTAATGAATTTGGGGCGGAGGGTGCCAGATTGGGGG
ACGATGGTTCCCTCGGGCCCCGGGGCGAAGTTCCCCTCGCAGATCTGCATCTCCC
AGGCTTTCATCTCGGAGGGGGGATCATGTCCACCTGCGGGGCGATGAAAAAAA
CGGTTTCCGGGGCGGGGTGATTAGCTGCGAGGAGAGCAGGTTTCTCAACAGCT
GGGACTTGCCGCACCCGGTCGGGCCGTAGATGACCCCGATGACTGGTTGCAGGT
GGTAGTTCAAGGAGATGCAGCTGCCGTCGTCCCGGAGAAGGGGGGCCACCTCGT
TGAGCATGTCCCTGACTTGGAGGTTTTCCCGGACGAGCTCGCCAAGGAGGCGGT
CCCCGCCCAGCGAGAGCAGCTCTTGCAGGGAAGCAAAGTTTTTCAGTGGCTTGA
GCCCGTCGGCCATGGGCATCTTGGCGAGGGTCTGCGAGAGGAGCTCGAGGCGGT
CCCAAAGCTCGGTGACGTGCTCTACGGCATCTCGATCCAGCAGACTTCCTCGTTT
CGGGGGTTGGGACGACTGCGACTGTAGGGCACGAGACGATGGGCGTCCAGCGCT
GCCAACGTCATGTCCTTCCAGGGTCTCAGGGTCCGCGTGAGCGTGGTCTCCGTCA
CGGTGAAGGGGTGGGCCCCGGGCTGGGCGCTTGCAAGGGTGCGCTTGAGACTCA
TCCTGCTGGTGCTGAAACGGGCACGGTCTTCGCCCTGCGCGTCGGCGAGATAGC
AGTTGACCATAAGCTCGTAGTTAAGGGCCTCGGCGGCGTGGCCCTTGGCGCGGA
GCTTGCCCTTGGAAGAGTGACCGCAGGCGGGACAGAGGATGGATTGCAGGGCGT
AGAGCTTGGGTGCAAGAAAGACGGACTCGGGGGCGAAGGCGTCGCTCCGCAG
TGGGCGCAGACGGTCTCGCACTCGACGAGCCAGGTGAGCTCGGGGTGTTCGGGG
TCAAAAACCAGTTTTCCCCCGTTCTTTTTGATGCGCTTCTTACCTCGCGTCTCCAT
GAGTCTGTGTCCGCGCTCGGTGACAAACAGGCTGTCTGTGTCCCCGTAGACGGA
CTTGATGGGCCTGTCCTGCAGGGGCGTCCCGCGGTCCTCCTCGTAGAGAAACTCG
GACCACTCTGAGACGAAGGCGCGTCCACGCCAAGACAAAGGAGGCCACGTG
CGAGGGGTAGCGGTCGTTGTCCACCAGGGGGTCCACCTTTTCCACCGTGTGCAG
ACACATGTCCCCCTCCTCCGCATTCAAGAAGGTGATTGGCTTGTAGGTAGGCC
ACGTGACCGGGGGTCCCCGACGGGGGGTATAAAAGGGGCGGGTCTGTGCTC
GTCCTCACTCTCTTCCGCGTCGCTGTCCACGAGCGCCAGCTGTTGGGGTAGGTAT
TCCCTCTCGAGAGCGGGCATGACCTCGGCACTCAGGTTGTCAGTTTCTAGAAACG
AGGAGGATTTGATGTTGGCCTGCCCTGCCGCAATGCTTTTTAGGAGACTTTCATC
CATCTGGTCAGAAAAAACTATTTTTTATTGTCAAGCTTGGTGGCAAAGGAGCCA
TAGAGGGCGTTGGAGAAGCTTGGCGATGGATCTCATGGTCTGATTTTTGTCAC
GGTCGGCGCGCTCCTTGGCCGCGATGTTGAGCTGGACATATTCGCGCGCGACAC
ACTTCCATTCGGGAAAGACGGTGGTGCGCTCGTCGGGCACGATCCTGACGCGCC
AGCCGCGGTTATGCAGGGTGACCAGGTCAACGCTGGTGGCCACCTCGCCGCGCA
GGGGCTCGTTGGTCCAGCAGAGTCTGCCGCCCTTGCGCGAGCAGAAAGGGGGCA
GTACATCAAGTAGATGCTCGTCAGGGGGGTCCGCATCGATGGTGAAGATACCGG
```

TABLE 7-continued

Nucleic Acid Sequences of Vectors

| SEQ ID NO | Sequence |
|---|---|
| | GACAGAGTTCCTTGTCAAAATAGTCTATTTTTGAGGATGCATCATCCAAGGCCAT
CTGCCACTCGCGGGCGGCCATCGCTCGCTCGTAGGGGTTGAGGGGCGGACCCCA
GGGCATGGGATGCGTGAGGGCGGAGGCGTACATGCCGCAGATGTCATAGACAT
AGATGGGCTCCGAGAGGATGCCGATGTAGGTGGGATAACAGCGCCCCCCGCGG
ATGCTGGCGCGCACATAGTCATACAACTCGTGCGAGGGGGCCAAGAAGGCGGG
GCCGAGATTGGTGCGCTGGGGCTGCTCGGCGCGGAAGACGATCTGGCGAAAGAT
GGCATGCGAGTTGGAGGAGATGGTGGGCCGTTGGAAGATGTTAAAGTGGGCGTG
CGGCAGTCGGACCGAGTCGCGGATAAAGTGCGCGTAGGAGTCTTGCAGCTTGGC
GACGAGCTCGGCGGTGACAAGGACGTCCATGGCGCAGTAGTCCAGCGTTTCGCG
GATGATGTCATAACCCGCCTCTCCTTTCTTCTCCCACAGCTCGCGGTTGAGAGCG
TACTCCTCGTCATCCTTCCAGTACTCCCGGAGCGGGAATCCTCGATCGTCCGCAC
GGTAAGAGCCCAGCATGTAGAAATGGTTCACGGCCTTGTAGGGACAGCAGCCCT
TCTCCACGGGGAGGGCGTAAGCTTGAGCGGCCTTGCGGAGCGAGGTGTGCGTCA
GGGCGAAGGTGTCCCTGACCATGACTTTCAAGAACTGGTACTTGAAGTCCGAGT
CGTCGCAGCCGCCGTGCTCCCAGAGCTCGAAATCGGTGCGCTTCTTCGAGAGGG
GGTTAGGCAGAGCGAAAGTGACGTCATTGAAGAGAATCTTGCCTGCTCGCGGCA
TGAAATTGCGGGTGATGCGGAAAGGGCCCGGAACGGAGGCTCGGTTGTTGATGA
CCTGGGCGGCGAGGACGATCTCGTCGAAGCCGTTGATGTTGTGCCCGACGATGT
AGAGTTCCATGAATCGCGGCGGCCTTTGATGTGCGGCAGCTTTTTGAGCTCATC
GTAGGTGAGGTCCTCGGGGCATTGCAGGCCGTGCTGTTCGAGCGCCCACTCCTG
GAGATGTGGGTTGGCTTGCATGAATGAAGCCCAGAGCTCGCGGGCCATGAGGGT
CTGGAGCTCGTCGCGAAAGAGGCGGAACTGCTGGCCCACGGCCATCTTTTCGGG
TGTGACGCAGTAGAAGGTGAGGGGGTCCCGCTCCCAGCGATCCCAGCGTAAGCG
CGCGGCGAGATCGCGAGCGAGGGCGACCAGCTCGGGGTCCCCCGAGAATTTCAT
GACCAGCATGAAGGGGACGAGCTGCTTGCCGAAGGACCCCATCCAGGTGTAGGT
TTCTACATCGTAGGTGACAAAGAGCCGCTCCGTGCGAGGATGAGAGCCGATTGG
GAAGAATTGGATTTCCTGCCACCAGTTGGACGAGTGGCTGTTGATGTGATGAAA
GTAGAAATCCCGCCGGCGAACCGAGCACTCGTGCTGATGCTTGTAAAAGCGTCC
GCAGTACTCGCAGCGCTGCACGGGCTGTACCTCATCCACGAGATACACAGCGCG
TCCCTTGAGGAGGAACTTCAGGAATGGCGGCCCTGGCTGGTGGTTTTCATGTTCG
CCTGCGTGGGACTCACCCTGGGGCTCCTCGAGGACGGAGAGGCTGACGAGCCCG
CGCGGCAGCCAGGTCCAGATCTCGGCGCGGCGGGGGCGGAGAGCGAAGACGAG
GGCGCGCAGTTGGGAGCTGTCCATGGTGTCGCGGAGATCCAGGTCCGGGGGCAG
GGTTCTGAGGTTGACCTCGTAGAGGCGGGTGAGGGCGTCGTTGAGATGCAGATG
GTACTTGATCTCCACGGGTGAGTTGGTGGTCGTGTCCACGCATTGCATGAGCCCG
TAGCTGCGCGGGGCCACGACCGTGCCGCGGTGCGCTTTTAGAAGCGGTGTCGCG
GACGCGCTCCCGGCGGCAGCGGCACGTTGGCGTGGCGCTCGGGCAGGTCCCGGT
GCTGCGCCCTGAGAGCGCTGGCGTGCGCGACGACGCGGCGGTTGACATCCTGGA
TCTGCCGCCTTTGCGTGAAGACCACTGGCCCCGTGACTTTGAACCTGAAAGACA
GTTCAACAGAATCAATCTCGGCGTCATTGACGGCGGCCTGACGCAGGATTTCTTG
CACGTCGCCCGAGTTGTCCTGGTAGGCGATCTCGGACATGAACTGCTCGATCTCC
TCCTCCTGGAGATCGCCGGCCCGCGCGCTCGACGGTGGCGGCGAGGTCATTC
GAGATGCGACCCATGAGCTGCGAGAAGGCGCCCAGGCCGCTCTCGTTCCAGACG
CGGCTGTAGACCACGTCCCCGTCGGCGTCGCGCGCGCATGACCACCTGCGCG
AGGTTGAGCTCCACGTGCCGCGCGAAGACGGCATAGTTGCGCAGGCGTTGGAAG
AGGTAGTTGAGGGTGGTGGCGATGTGCTCGGTGACGAAGAAGTACATAATCCAG
CGGCGCAGGGGCATTTCGCTGATGTCGCCAATGGCCTCCAGCCTTTCCATGGCCT
CGTAGAAATCCACGGCGAAGTTGAAAAACTGGGCGTTGCGGGCCGAGACCGTG
AGCTCGTCTTCCAGGAGCCTGATGAGTTCGGCGATGGTGGCGCGCACCTCGCGC
TCGAAATCCCCGGGGGCCTCCTCCTCTTCCTCTTCTTCCATGACGACCTCTTCTTC
TATTTCTTCCTCTGGGGGCGGTGGTGGTGGCGGGGCCCGACGACGACGGCGACG
CACCGGGAGACGGTCGACGAAGCGCTCGATCATCTCCCCGCGGCGGCGACGCAT
GGTTTCGGTGACGGCGCGACCCCGTTCGCGAGGACGCAGCGTGAAGACGCCGCC
GGTCATCTCCCGGTAATGGGGTGGGTCCCCGTTGGGCAGCGATAGGGCGCTGAC
AATGCATCTTATCAATTGCGGTGTAGGGCACGTGAGCGCGTCGAGATCGACCGG
ATCGGAGAATCTTTCGAGGAAAGCGTCTAGCCAATCGCAGTCGCAAGGTAAGCT
CAAACACGTAGCAGCCCTGTGGACGCTGTTAGAATTGCGGTTGCTGATGATGTA
ATTGAAGTAGGCGTTTTTGAGGCGGCGGATGGTGGCGAGGAGGACCAGGTCCTT
GGGTCCCGCTTGCTGGATGCGGAGCCGCTCGGCCATGCCCCAGGCCTGGCCCTG
ACACCGGCTCAGGTTCTTGTAGTAGTCATGCATGAGCCTCTCGATGTCATCACTG
GCGGAGGCGGAGTCTTCCATGCGGGTGACCCCGACGCCCCTGAACGGCTGCACG
AGCGCCAGGTCGGCGACGACGCGCTCGGCGAGGATGGCCTGTTGCACGCGGGTG
AGGGTGTCCTGGAAGTCGTCCATGTCGACGAAGCGGTGGTAGGCCCCTGTGTTG
ATGGTGTAAGTGCAGTTGGCCATAAGCGACCAGTTGACGGTCTGCAGGCCGGGT
TGCACGACCTCGGAGTACCTGAGCCGCGAGAAGGCGCGCGAGTCGAAGACATA
GTCGTTGCAGGTGCGCACGAGGTACTGGTATCCGACTAGAAAGTGCGGCGGCGG
CTGGCGGTAGAGCGGCCAGCGCTGGGTGGCCGGCGCGCCCGGGGCCAGGTCCTC
AAGCATGAGTCGGTGGTAGCCTAGAGGTAGCGGGACATCCAGGTGATGCCGGC
GGCGGTGGTGGAGGCGCGCGGGAACTCGCGGACGCGGTTCCAGATGTTGCGCAG
GGGCAGGAAATAGTCCATGGTCGGCACGGTCTGGCCGGTGAGACGCGCGCAGTC
ATTGATGCTCTAGAGGGCAAAAACGAAAGCGGTTGAGCGGGCTCTTCCTCCGTAG
CCTGGCGGAACGCAAACGGGTTAGGCCGCGTGTGTACCCCGGTTCGAGTCCCCT
CGAATCAGGCTGGAGCCGCGACTAACGTGGTATTGGCACTCCCGTCTCGACCCA
AGCCCGATAGCCGCCAGGATACGGCGGAGAGCCCTTTTTGTCGGCCGAGGGGAG
TCGCTAGACTTGAAAGCGGCCGAAAACCCTGCCGGGTAGTGGCTCGCGCCCGTA
GTCTGGAGAAGCATCGCCAGGGTTGAGTCGCGGCAGAACCCGGTTCAAGGACGG |

TABLE 7-continued

Nucleic Acid Sequences of Vectors

SEQ ID NO Sequence

CCGCGGCGAGCGGGACTTGGTCACCCCGCCGATTTAAAGACCCAACAGCCGACT
TCTCCAGTTACAGGAAAGAGCCCCTTTTTTCTTTTTGCCAGATGCATCCCGTCCT
GCGCCAAATGCGTCCCACCCCCCGGCGACCACCGCGACCGCGGCCGTAGCAGG
CGCCGGCGCTAGCCAGCCACAGCCACAGACAGAGATGGACTTGGAAGAGGGCG
AAGGGCTGGCGAGACTGGGGGCGCCGTCCCCGGAGCGACATCCCCGCGTGCAGC
TGCAGAAGGACGTGCGCCCGGCGTACGTGCCTGCGCAGAACCTGTTCAGGGACC
GCAGCGGGGAGGAGCCCGAGGAGATGCGCGACTGCCGGTTTCGGGCGGGCAGG
GAGCTGCGCGAGGGCCTGGACCGCCAGCGCGTGCTGCGCGACGAGGATTTCGAG
CCGAACGAGCAGACGGGGATCAGCCCCGCGCGCGCACGTGGCGGCGGCCAA
CCTGGTGACGGCCTACGAGCAGACGGTGAAGCAGGAGCGCAACTTCCAAAAGA
GTTTCAACAACCACGTGCGCACCCTGATCGCGCGCGAGGAGGTGGCCCTGGGCC
TGATGCACCTGTGGGACCTGGCGGAGGCCATCGTGCAGAACCCGGACAGCAAGC
CTCTGACGGCACAGCTGTTCCTGGTGGTGCAGCACAGCAGGGACAACGAGGCGT
TCAGGGAGGCACTGCTGAACATCGCCGAGCCCGAGGGTCGCTGGCTGCTGGAGC
TGATTAACATCTTGCAGAGCATCGTAGTGCAGGAGCGCAGCCTGAGCCTGGCCG
AGAAGGTGGCGGCGATCAACTACTCGGTGCTGAGCCTGGGCAAGTTTTACGCGC
GCAAGATTTACAAGACGCCGTATGTGCCCATAGACAAGGAGGTGAAGATAGAC
AGCTTTTACATGCGCATGGCGCTCAAGGTGCTGACGCTGAGCGACGACCTGGGC
GTGGTACCGCAACGACCGCATCCACAAGGCCGTGAGCACAAGCCGGCGGCGCGA
GCTGAGCGACCGCGAGCTGATGCTGAGTCTGCGCCGGGCGCTGGTAGGAGGCGC
CACCGGCGGTGAGGAGTCCTACTTTGACATGGGGCGGACCTGCATTGGCAGCC
GAGCCGACGCGCCTTGGAGGCCGCCTACGGTCCAGAGGACTTGGATGAGGAAG
AGGAAGAGGAGGAGGATGCACCCGTTGCGGGGTACTGACGCCTCCGTGATGTGT
TTTTAGATGCAGCAAGCCCCGGACCCCGCCATAAGGGCGGCGCTGCAAAGTCAG
CCGTCCGGTCTAGCATCGGACGACTGGGAGGCCGCGATGCAACGCATCATGGCC
CTGACGACCCGCAACCCCGAGTCCTTTAGACAACAGCCGCAGGCCAACAGACTC
TCGGCCATTCTGGAGGCGGTGGTTCCTTCTCGGACCAACCCCACGCACGAGAAG
GTGCTGGCGATCGTGAACGCGCTGGCGGAGAACAAGGCCATCCGTCCCGACGAG
GCCGGGCTAGTGTACAACGCCCTGCTGGAGCGCGTGGGCCGCTACAACAGCACA
AACGTGCAGTCCAACTTGGACCGGCTGGTGACGGACGTGCGCGAGGCCGTGGCG
CAGCGCGAGCGGTTCAAGAACGAGGGCCTGGGTTCGCTGGTGGCGCTGAACGCC
TTCCTGGCGACGCAGCCGGCGAACGTGCCGCGCGGGCAGGATGATTATACCAAC
TTTATAAGCGCGCTGCGGCTGATGGTGACCGAGGTGCCCCAGAGCGAGGTGTAC
CAGTCGGGCCCGGACTACTTTTTCCAGACGAGCAGACAGGGCCTGCAGACGGTG
AACCTGAGTCAGGCTTTCAAGAACCTGCGCGGGCTGTGGGGCGTGCAGGCGCCC
GTGGGCGACCGGTCGACGGTGAGCAGCTTGCTGACGCCCAACTCGCGGCTGCTG
CTGCTGCTGATCGCGCCCTTCACCGACAGTGGCAGCGTGAACCGCAACTCGTAC
CTGGGTCACCTGCTGACGCTGTACCGCGAGGCCATAGGCCAGGCGCAGGTGGAT
GAGCAGACCTTCCAGGAGATCACTAGCGTAAGCCGCGCGCTGGGTCAGAACGAC
ACCGACAGTCTGAGGGCCACCCTGAACTTCTTGCTGACCAATAGACAGCAGAAG
ATCCCGGCGCAGTACGCGCTGTCGGCCGAGGAGGAGCGCATCCTGAGATATGTG
CAGCAGAGCGTAGGGCTGTTCCTGATGCAGGAGGGGGCCACCCCCAGCGCCGCG
CTGGACATGACCGCGCGCAACATGGAACCTAGCATGTACGCCGCCAACCGGCCG
TTTATTAATAAGCTGATGGACTACCTGCACCGCGCGGCGTCATGAACTCGGACT
ACTTTACCAATGCCATCTTGAACCCGCACTGGCTCCCGCCGCCGGGGTTCTACAC
GGGCGAGTACGACATGCCTGACCCCAACGACGGGTTTTTGTGGGACGACGTGGA
CAGCGCGGTGTTCTCACCGACCTTGCAAAAGCGCCAGGAGGCGGTGCGCACGCC
CGCGAGCGAGGGCGCGGTGGGTCGGAGCCCCTTTCCTAGCTTAGGGAGTTTGCA
TAGCTTGCCGGGCTCGGTGAACAGCGGCAGGGTGAGCCGGCCGCGCTTGCTGGG
CGAGGACGAGTACCTGAACGACTCGCTGCTGCAGCCGCCGCGGGTCAAGAACGC
CATGGTCAATAACGGGATAGAGAGTCTGGTGGACAAACTGAACCGCTGGAAAA
CCTACGCTCAGGACCATAGGGAACCTGCGCCCGCGCCGCGGCGACAGCGTCACG
ACCGGCAGCGGGGCCTGGTGTGGGACGACGAGGACTCGGCCGACGATAGCAGC
GTGTTGGACTTGGGCGGAAGCGGTGGGGCCAACCCGTTCGCGCATCTGCAACCC
AGACTGGGGCGACGGATGTTTTGAATGCAAAATAAAACTCACCAAGGCCATAGC
GTGCGTTCTCTTCCTTGTTAGAGATGAGGCGCGCGGTGGTGTCTTCCTCTCCTCCT
CCCTCGTACGAGAGCGTGATGGCGCAGGCGACCCTGGAGGTTCCGTTTGTGCCT
CCGCGGTATATGGCTCCTACGGAGGGCAGAAACAGCATTCGTTACTCGGAGCTG
GCTCCGCTGTACGACACCACTCGCGTGTATTTGGTGGACAACAAGTCGGCGGAC
ATCGCTTCCCTGAACTACCAAAACGACCACAGCAACTTCCTGACCACGGTGGTG
CAGAACAACGATTTCACCCCTGCCGAGGCCAGCACGCAGACGATAAATTTTGAC
GAGCGGTCGCGGTGGGCGGTGATCTGAAGACCATTCTGCACACCAACATGCCT
AATGTGAACGAGTACATGTTCACCAGCAAGTTTAAGGCGCGGGTGATGGTGCT
AGAAAAAAGGCGGAAGGGGCTGATGCAAATGATAGGAGCAAGGATATCTTAGA
GTATCAGTGGTTTGAGTTTACCCTGCCCGAGGGCAACTTTTCCGAGACCATGACC
ATAGACCTAATGAACAACGCCATCTTGGAAAACTACTTGCAAGTGGGGCGGCAA
AATGGCGTGCTGGAGAGTGATATCGGAGTCAAGTTTGACAGCAGAAATTTCAAG
CTGGGCTGGGACCCGGTGACCAAGCTGGTGATGCCAGGGGTCTACACCTACGAG
GCCTTCCACCCGGACGTGGTGCTGCTGCCGGGCTGCGGGGTGGATTTCACCGAG
AGCCGCCTGAGCAACCTCCTGGGCATTCGCAAGAAGCAACCTTTTCAAGAGGGC
TTCAGAATCATGTATGAGGACCTAGTAGGGGGCAACATCCCCGCTCTCCTGAAT
GTCAAGGAGTATCTGAAGGATAAGGAAGAAGCTGGCAAAGCAGATGCAAATAC
TATTAAGGCTCAGAATGATGCCGTCCCAAGAGGAGATAACTATGCATCAGCGGC
AGAAGCCAAAGCAGCAGGAAAAGAAATTGAGTTGAAGGCCATTTTGAAAGATG
ATTCAGACAGAAGCTACAATGTGATCGAGGGAACCACAGACACCCTGTACCGCA
GTTGGTACCTGTCCTATACCTACGGGGATCCCGAGAAGGGGGTGCAGTCGTGGA

TABLE 7-continued

Nucleic Acid Sequences of Vectors

SEQ ID NO Sequence

```
CGCTGCTCACCACCCCGGACGTCACCTGCGGCGCGGAGCAAGTCTACTGGTCGC
TGCCGGACCTCATGCAAGACCCCGTCACCTTCCGCTCTACCCAGCAAGTCAGCA
ACTACCCCGTGGTCGGCGCCGAGCTCATGCCCTTCCGCGCCAAGAGCTTTTACAA
CGACCTCGCCGTCTACTCCCAGCTCATCCGCAGCTACACCTCCCTCACCCACGTC
TTCAACCGCTTCCCCGACAACCAGATCCTTTGCCGCCCGCCCGCGCCCACCATCA
CCACCGTCAGTGAAAACGTGCCTGCTCTCACAGATCACGGGACGCTACCGCTGC
GCCAGCAGTATCCGCGGAGTCCAGCGAGTGACCGTCACTGACGCCCGTCGCCGCA
CCTGTCCCTACGTCTACAAGGCCCTGGGCATAGTCGCGCCGCGCGTGCTTTCCAG
TCGCACCTTCTAAAAAATGTCTATTCTCATCTCGCCCAGCAATAACACCGGCTGG
GGTCTTACTAGGCCCAGCACCATGTACGGAGGAGCCAAGAAACGCTCCCAGCAG
CACCCCGTCCGCGTCCGCGGTCACTTCCGCGCTCCCTGGGGCGCTTACAAGCGGG
GGCGGACCTCTGCTCCTGCCGCCGTGCGCACCACCGTCGACGACGTCATCGACTC
GGTGGTCGCCGATGCGCGCAACTACACCCCCGCCCCCTCGACCGTGGACGCGGT
CATCGACAGCGTGGTGGCAGACGCGCGTGACTATGCCAGACGCAAGAGCCGGC
GGCGACGGATCGCCAGGCGCCACCGGAGCACGCCCGCAGGCAGGACTCGCAGA
CGAGCGGCCGCTGCCGCCGCCGCGGCCATCTCTAGCATGACCAGACCCAGGCGC
GGAAACGTGTACTGGGTGCGCGACTCCGTCACGGGCGTGCGCGTGCCCGTGCGC
ACCCGTCCTCCTCGTCCCTGATCTAATGCTTGTGTCCTCCCCCGCAAGCGACGAT
GTCAAAGCGCAAAATCAAGGAGGAGATGCTCCAGGTCGTCGCCCCGGAGATTTA
CGGACCACCCCAGGCGGACCAGAAACCCCGCAAAATCAAGCGGGTTAAAAAAA
AGGATGAGGTGGACGAGGGGGGCAGTAGAGTTTGTGCGCGAGTTCGCTCCGCGGC
GGCGCGTAAATTGGAAGGGGCGCAGGGTGCAGCGCGTGTTGCGGCCCGGCACG
GCGGTGGTGTTCACGCCCGGCGAGCGGTCCTCGGTCAGGAGCAAGCGTAGCTAT
GACGAGGTGTACGGCGACGACGACATCCTGGACCAGGCGGCGGAGCGGGCGGG
CGAGTTCGCCTATGGGAAGCGGTCGCGCGAAGAGGAGCTCATCTCGCTGCCGCT
GGACGAAAGCAATCCCACGCCGAGCCTGAAGCCCGTGACCCTGCAGCAGGTGCT
GCCGAGCCGCGGGATCAAGCGCGAGGGCGAGAACATGTACCCGACCATGCAGA
TCATGGTGCCCAAGCGCCGGCGCGTGGAGGACGTGCTGGACACCGTGAAAATGG
ATGTGGAGCCCGAGGTCAAGGTGCGCCCCATCAAGCAGGTGGCGCCGGGCCTTG
GCGTGCAGACCGTGGACATTCAGATCCCCACCGACATGGATGTCGACAAAAAAC
CCTCGACCAGCATCGAGGTGCAGACCGACCCCTGGCTCCCAGCTTCCACCGCTA
CCGCCTCCACTTCTACCGCCGCCACGGCTACCGAGCCTCCCAGGAGGCGAAGAT
GGGGCCCTGCCAACCGGCTGATGCCCAACTACGTGTTGCATCCTTCCATCATCCC
GACGCCGGGCTACCGCGGCACCCGGTATTACGCCAGCCGCTCGCTCGTTCTGCCC
ACCGTGCGCTACCACCCCAGCATCCTTTAATCCGTGTGCTGTGATACTGTTGCAG
AGAGATGGCTCTCACTTGCCGCCTGCGCATCCCCGTCCCGAATTACCGAGGAAG
ATCCCGCCGCAGGAGAGGCATGGCAGGCAGTGGCCTGAACCGCCGCCGGCGGC
GGGCCATGCGCAGGCGCCTGAGTGGCGGCTTTCTGCCCGCGCTCATCCCCATAAT
CGCCGCGGCCATCGGCACGATCCCGGGCATAGCTTCCGTTGCGCTGCAGGCGTC
GCAGCGCCGTTGATGTGCGAATAAAGCCTCTTTAGACTCTGACACACCTGGTCCT
GTATATTTTTAGAATGGAAGACATCAATTTTGCGTCCCTGGCTCCGCGGCACGGC
ACGCGGCCGTTCATGGGCACCTGGAACGAGATCGGCACCAGCAGCTGAACGGG
GGCGCCTTCAATTGGAGCAGTGTCTGGAGCGGGCTTAAAAATTTCGGCTCGACG
CTCCGGACCTATGGGAACAAGGCCTGGAATAGTAGCACTGGGCAGTTGTTAAGG
GAAAAGCTCAAAGACCAGAACTTCCAGCAAAAGGTGGTGGACGGGCTGGCCTC
GGGCATTAACGGGGTGGTGGACATCGCGAACCAGGCCGTGCAGCGCGAGATAA
ACAGCCGCCTGGACCCGCGGCCGCCCACGGTGGTGGAGATGGAAGATGCAACTC
TTCCGCCGCCCAAGGGCGAGAAGCGACCGCGCCCGACGCGGAGGAGACAATC
CTGCAAGTGGACGAGCCGCCCTCGTACGAGGAGGCCGTCAAGGCCGGCATGCCC
ACCACGCGCATCATCGCGCCGCTGGCCACGGGTGTAATGAAACCCGCTACCCTT
GACCTGCCTCCACCACCCACGCCCGCTCCACCAAAAGCAGCTCCGGTTGTGCAG
CCCCCTCCGGTGGCGACCGCCGTGCGCCGCGTCCCCGCCCGCCGCCAGGCCCAG
AACTGGCAGAGCACGCTGCACAGTATCGTGGGCCTGGGAGTGAAAAGTCTGAAG
CGCCGCCGATGCTATTGAGAGAGAGGAAAGAGGACACTAAAGGGAGAGCGTTAA
CTTGTATGTGCCTTACCGCCAGAGAACGCGCGAAGATGGCCACCCCCTCGATGA
TGCCGCAGTGGGCGTACATGCACATCGCCGGGCAGGACGCCTCGGAGTACCTGA
GCCCGGGTCTGGTGCAGTTTGCCCGCGCCACCGACACGTACTTCAGCCTGGGCA
ACAAGTTTAGGAACCCCACGGTGGCTCCCACCCACGATGTGACCACGGACCGGT
CCCAGCGTCTGACGCTGCGCTTCGTGCCCGTGGATCGCGAGGACACCACGTACT
CGTACAAGGCGCGCTTCACTCTGGCCGTGGGCGACAACCGGGTGCTAGACATGG
CCAGCACTTACTTTGACATCCGCGGCGTCCTGGACCGCGGTCCCAGCTTCAAACC
CTACTCGGGCACGGCTTACAACAGCCTGGCCCCAAGGGCGCCCCTAACTCCAG
TCAGTGGGCGCAGAAAAGACTGGTGAAGACAATCAAACTGAAACACGCACAT
TTGGTGTGGCCGCTATGGGTGGAATACTTATTGATAAAAATGGTCTTCAGATTGG
AACAGATGAAACTAAACCCGATAACAAGGAAATTTATGCAGACAAAACATTCCA
GCCAGAACCTCAAAAAGGTGAAGAAACTGGCAAGATGGAGATGTTTTCTATGG
AGGCAGGACTATTAAAAAGGAAACAAAATGAAGCCATGCTATGGCTCATTTGC
CAGACCCACTAATGAAAAGGGAGGTCAGGCAAAATTTAAAACTAATGCCGAAG
GTCAGCCCACAGAGGAGTTAGACATTGACCTGAACTTCTTTGATATTAATGGAG
GGGCAGGTGATAATGAATTTAACCCAGACATGGTCATGTATGCTGAGAATATGA
ATCTGGAGACGCCAGATACACATGTGGTACAAACCTGGAACTTCAGATGCA
GTTCTGAAGCTAACTTAGCGCAGCAGTCCATGCCCAACAGACCAAACTACATTG
GCTTCAGAGACAATTTTGTGGGGCTCATGTACTACAACAGCACTGGCAACATGG
GTGTGCTGGCTGGTCAGGCATCTCAGTTGAATGCTGTGGTCGACTTGCAAGACA
GAAATACTGAGCTGTCTTACCAGCTCTTGCTAGATTCTCTGGGTGACAGAACAAG
ATACTTTAGCATGTGGAACTCTGCGGTGGACAGCTATGATCCCGATGTCAGGATC
```

TABLE 7-continued

Nucleic Acid Sequences of Vectors

SEQ ID NO Sequence

ATTGAGAATCACGGTGTGGAAGATGAACTTCCAAACTATTGCTTCCCATTGGATG
GCACTGGCACCAATTCTACATACCAAGGGGTTAAAGAAACAGCTGCTCAGAATG
GATGGGAAAAAGATCCAAATGTTGCTGCTCAGAACCAAATTTGCAAGGGCAACA
TCTATGCCATGGAGATTAACCTCCAGGCCAACCTGTGGAAGAGTTTTCTGTACTC
GAACGTGGCCCTGTACCTGCCCGACTCCTACAAGTACACGCCGGCCAACGTCAC
GCTGCCCGCCAACACCAACACCTACGAGTACATGAACGGCCGCGTGGTAGCCCC
CTCGCTGGTGGACGCCTACATCAACATAGGCGCCCGCTGGTCGCTGGACCCCAT
GGACAATGTCAACCCCTTCAACCACCACCGTAACGCGGGCCTGCGCTACCGCTC
CATGCTTTTGGGCAATGGCCGCTACGTGCCCTTCCACATCCAAGTGCCCCAAAAG
TTCTTTGCCATCAAGAACCTGCTCCTGCTCCCCGGCTCCTACACCTACGAGTGGA
ACTTCCGCAAGGATGTCAACATGATCCTGCAGAGTTCCCTCGGAAACGACCTGC
GCGTCGACGGCGCCTCCGTCCGCTTCGACAGCGTCAACCTCTACGCCACCTTCTT
CCCCATGGCGCACAACACCGCCTCCACCCTGGAAGCCATGCTGCGCAACGACAC
CAACGACCAGTCCTTCAACGACTACCTCTCGGCCGCCAACATGCTCTACCCCATC
CCGGCCAAGGCCACCAACGTGCCCATTTCCATCCCCTCGCGCAACTGGGCCGCCT
TCCGCGGCTGGAGTTTCACCCGGCTCAAGACCAAGGAAACTCCCTCCCTTGGCTC
GGGTTTTGACCCCTACTTTGTCTACTCGGGCTCCATCCCCTACCTCGACGGGACC
TTCTACCTCAACCACACCTTCAAGAAGGTTTCCATCATGTTCGACTCCTCGGTCA
GCTGGCCCGGCAACGACCGGCTGCTTACGCCGAACGAGTTCGAGATCAAGCGCA
GCGTCGACGGGGAGGGCTACAACGTGCCCAATGCAACATGACCAAGGACTGG
TTCCTCGTCCAGATGCTCTCCCACTACAACATCGGCTACCAGGGCTTCCATGTGC
CCGAGGGCTACAAGGACCGCATGTACTCCTTCTTCCGCAACTTCCAGCCCATGAG
CAGGCAGGTGGTCGATGAGATCAACTACAAGGACTACAAGGCAGTCACCCTGCC
CTTCCAGCACAACAACTCTGGCTTTACCGGCTACCTGGCACCCACCATGCGTCAG
GGGCAGCCCTACCCCGCCAACTTCCCCTACCCGCTCATCGGCTCCACCGCAGTGC
CATCCGTCACCCAGAAAAAGTTCCTCTGCGACAGGGTCATGTGGCGCATCCCCTT
CTCCAGCAACTTCATGTCCATGGGCGCCCTCACCGACCTGGGTCAGAACATGCTC
TACGCCAACTCGGCCCACGCGCTCGACATGACCTTCGAGGTGGACCCCATGGAT
GAGCCCACCCTCCTCTATCTTCTCTTCGAAGTTTTCGACGTGGTCAGAGTGCACC
AGCCGCACCGCGGCGTCATCGAGGCCGTCTACCTGCGCACGCCCTTCTCCGCCG
GCAACGCCACCACCTAAGCATGAGCGGCTCCAGCGAACGAGAGCTCGCGGCCAT
CGTACGCGACCTGGGCTGCGGGCCCTACTTTTTGGGCACCCACGACAAGCGCTTC
CCGGGCTTCCTCGCCGGCGACAAGCTGGCCTGCGCCATCGTCAACACGGCCGGC
CGCGAGACCGGGGCGTGCACTGGCTCGCCTTTGGCTGGAACCCGCTCGCGC
ACCTGCTACATGTTCGACCCCTTCGGGTTCTCGGACCGCCGGCTCAAGCAGATTT
ACAGCTTCGAGTACGAGGCCATGCTGCGCCGAAGCGCCCTGGCCTCCTCGCCCG
ATCGCTGTCTTAGCCTCGAACAGTCCACCCAGACCGTGCAGGGGCCCGACTCCG
CCGCCTGCGGACTCTTCTGTTGCATGTTCTTGCATGCCTTCGTGCACTGGCCCGA
CCGACCCATGGACGGGAACCCCACCATGAACTTGCTGACGGGGGTGCCCAACGG
CATGCTACAATCGCCACAGGTGCTGCCCACCCTCAGGCGCAACCAGGAGGAGCT
CTACCGCTTCCTCGCGCGCCACTCCCCCTACTTTCGCTCCCACCGCGCCGCCATC
GAACACGCCACCGCTTTTGATAAAATGAAACAACTGCGTGTATGACTCAAATAA
ACAGCACTTTTATTTTACACATGCGCTGGAGTATATGCAAGTTATTTAAAAGTCG
AAGGGGTTCTCGCGCTCGTCGTTGTGCGCCGCGCTGGGGAGGGCCACGTTGCGG
TACTGGAACTTGGGCTGCCACTTGAACTCGGGGATCACCAGTTTGGGCACTGGA
GTCTCGGGGAAGGTCTCGCTCCACATGCGCCGGCTCATTTGCAGGGCGCCCAGC
ATGTCAGGGCCGGAGATCTTGAAATCGCAGTTGGGACCGGTGCTCTGCGCGCGC
GAGTTGCGGTACACGGGGTTGCAGCACTGGAACACCATCAGACTGGGGTACTTC
ACACTGGCAAGCACGCTCTTGTCGCTAATCTGATCCTTGTCCAGGTCCTCGGCGT
TGCTCAGGCCGAACGGGGTCATCTTGCACAGCTGGCGGCCCAGGAAGGGCACGC
TCTGAGGCTTGTGGTTACACTCGCAGTGCACGGGCATCAGCATCATCCCCGCGCC
GCGCTGCATATTCGGGTAGAGGGCCTTGACGAAGGCCGCGATCTGCTTGAAAGC
TTGCTGGGCCTTGGCCCCCTCGCTAAAAAACAGGCCGCAGCTCTTCCCGCTGAAC
TGGTTATTCCCGCACCCGGCATCATGCACGCAGCAGCGCGCGTCATGGCTGGTC
AGTTGCACCACGCTCCGTCCCAGCGGTTCTGGGTTACCTTAGCCTTGCTGGGCT
GCTCCTTCAGCGCGCGCTGTCCGTTCTCGCTGGTCACATCCATCTCCACCACGTG
GTCCTTGTGAATCATCACCGTTCCATGCAGACACTTGAGCTGACCTTCCACCTCG
GTGCAGCCGTGATCCCACAGGACGCAGCCGGTGCACTCCCAATTCTTGTGCGCG
ATCCCGCTGTGGCTGAAAATGTAACCTTGCAACAGGCGACCCATAATGGTGCTA
AATGCTTTCTGGGTGGTGAATGTCAGTTGCATCCCGCGGGCTCCTCGTTCATCC
AGGTCTGGCACATCTTCTGGAAGATCTCGGTCTGCTCCGGCATGAGCTTGTAAGC
ATCGCGCAAGCCGCTGTCGACGCGGTAGCGTTCCATCAGCACGTTCATGGTATCC
ATGCCCTTCTCCCATGACGAGACCAGAGGCAGACTCAGGGGGTTGCGCACGTTC
AGGACACCAGGGGTCGCGGGCTCGACGATGCGTTTTCCGTCCTTGCCTTCCTTCA
ACAGAACCGGAGGCTGGCTGAATCCCACTCCCACGATCACGCGTCTTCCTGGG
GCATCTCTTCGTCGGGGTCTACCTTGGTTACATGCTTGGTCTTTCTGGCTTGCTTC
TTTTTTGGAGGGCTGTCCACGGGGACCACGTCCTCCTCGGAAGACCCGGAGCCC
ACCCGCTGATACTTTCGGCGCTTGGTGGGCAGAGGAGGTGGCGGCGGCGAGGGG
CTCCTCTCCTGCTCCGGCGGATAGCGCGCCGACCCGTGGCCCCGGGGCGGAGTG
GCCTCTCGCTCCATGAACCGGCGCACGTCCTGACTGCCGCCGGCCATTGTTTCCT
AGGGGAAGATGGAGGAGCAGCCGCGTAAGCAGGAGCAGGAGGAGGACTTAACC
ACCCACGAGCAACCCAAAATCGAGCAGGACCTGGGCTTGAAGAGCCGGCTCGT
CTAAAACCCCCACAGGATGAACAGGAGCACGAGCAAGACGCAGGCCAGGAGGA
GACCGACGCTGGGCTCGAGCATGGCTACCTGGGAGGAGAGGAGGATGTGCTGCT
AAAACACCTGCAGCGCCAGTCCCTCATCCTCCGGGACGCCCTGGCCGACCGGAG
CGAAACCCCCCTCAGCGTCGAGGAGCTGTGTCGGGCCTACGAGCTCAACCTCTT

TABLE 7-continued

Nucleic Acid Sequences of Vectors

SEQ ID NO Sequence

CTCGCCGCGCGTGCCCCCCAAACGCCAGCCCAACGGCACCTGCGAGCCCAACCC
GCGTCTCAACTTCTATCCCGTCTTTGCGGTCCCCGAGGCCCTTGCCACCTATCAC
ATCTTTTTCAAGAACCAAAAGATCCCCATCTCCTGTCGCGCCAATCGCACTCGCG
CCAACGCGCTCCTCGCTCTGGGGCCCGGCGCGCGCATACCTGATATCGCTTCCCT
GGAAGAGGTGCCCAAGATCTTCGAAGGGCTCGGTCGGGACGAGACGCGCGCGG
CAAACGCTCTGAAAAAAACAGCAGAGGAAGAGGGTTACACTAGCGCCCTGGTA
GAGTTGGAAGGCGACAACGCCAGGCTGGCCGTGCTTAAGCGCAGCGTCGAGCTC
ACCCATTTCGCCTACCCCGCCGTCAACCTCCCGCCCAAGGTCATGCGTCGCATCA
TGGATCAGCTCATCATGCCCCACATCGAGGCCCTTGATGAAAGTCAGGAACAGC
GCCCCGAGAACGCCCAGCCCGTGGTCAGCGACGAGATGCTCGCGCGCTGGCTCG
GGACCCGCGACCCCCAGGCCCTGGAGCAGCGGCGCAAGCTCATGCTGGCCGTGG
TCCTGGTCACCCTTGAGCTCGAATGCATGCGCCGCTTTTTTACCGACCCCGAGAC
CCTGCGCAAGGTCGAGGAGACCCTGCACTACACTTTCAGACACGGTTTCGTCAG
GCAGGCCTGCAAGATCTCCAACGTGGAGCTGACCAACCTGGTCTCCTGCCTGGG
GATCCTACACGAGAACCGCTTGGGACAGACCGTGCTCCACTCTACCCTGAAGGG
CGAGGCGCGGCGGGACTACATCCGCGACTGCGTCTTTCTCTTTCTGCCACACA
TGGCAAGCGGCCATGGGCGTGTGGCAGCAGTGTCTCGAGGACGAGAACCTGAA
GGAGCTGGACAAGCTTCTTGCTAGAAACCTTAAAAAGCTGTGGACGGGCTTTGA
CGAGCGCACCGTCGCCTCGGACCTGGCCGAGATCGTCTTCCCCGAGCGCCTGAG
GCAGACGCTGAAAGGAGGGCTGCCCGACTTCATGAGCCAGAGCATGTTGCAAAA
CTACCGCACTTTCATTCTCGAGCGATCTGGGATGCTGCCCGCCACCTGCAACGCC
TTCCCCTCCGACTTTGTCCCGCTGAGCTACCGCGAGTGTCCCCCGCCGCTGTGGA
GCCACTGCTACCTCTTGCAGCTGGCCAACTACATTGCCCACCACTCGGATGTGAT
CGAGGACGTGAGCGGCGAGGGGCTGCTCGAGTGCCACTGTCGCTGCAACCTATG
CTCCCCGCACCGCTCCCTGGTCTGCAACCCCCAGCTACTGAGCGAGACCCAGGTC
ATCGGTACCTTTGAGCTGCAAGGTCCGCAGGAGTCCACCGCTCCGCTGAAACTC
ACGCCGGGGTTGTGGACTTCCGCGTACCTGCGCAAATTTGTACCCGAGGACTACT
ACGCCCATGAGATAAAGTTCTTCGAGGACCAATCGCGTCCGCAGCACGCGGATC
TCACGGCCTGCGTCATCACCCAGGGCGCGATCCTCGCCCAATTGCACGCCATCCA
AAAATCCCGCCAAGAGTTTCTTCTGAAAAAGGGTAGAGGGGTCTACCTGGACCC
CCAGACGGGCGAGGTGCTCAACCCGGGTCTCCCCAGCATGCCGAGGAAGAAGC
AGGAGCCGCTAGTGGAGGAGATGGAAGAAGAATGGGACAGCCAGGCAGAGGA
GGACGAATGGGAGGAGGAGACAGAGGAGGAAGACTTGGAAGAGGTGGAAGAG
GAGCAGGCAACAGAGCAGCCCGTCGCCGCACCATCCGCGCCGGCAGCCCCTCCG
GTCACGGATACAACCTCCGCAGCTCCGGCCAAGCCTCCTCGTAGATGGGATCGA
GTGAAGGGTGACGGTAAGCACGAGCGACAGGGCTACCGATCATGGAGGGCCCA
CAAAGCCGCGATCATCGCCTGCTTGCAAGACTGCGGGGGGAACATCGCTTTCGC
CCGCCGCTACCTGCTCTTCCACCGCGGGGTGAACATCCCCCGCAACGTGTTGCAT
TACTACCGTCACCTTCACAGCTAAGAAAAAATCAGAAGTAAGAGGAGTCGCCGG
AGGAGGCTGAGGATCGCGGCGAACGAGCCCTTGACCACCAGGGAGCTAAGGA
ACCGGATCTTCCCCACTCTTTATGCCATTTTTCAGCAAAGTCGAGGTCAGCAGCA
AGAGCTCAAAGTAAAAAACCGGTCTCTGCGTCGCTCACCCGCAGTTGCTTGTA
CCACAAAAACGAAGATCAGCTGCAGCGCACTCTCGAAGACGCCGAGGCTCTGTT
CCACAAGTACTGCGCGCTCACTCTTAAAGACTAAGGCGGGAATTACCTCATCGC
CACCATGAGCAAGGAGATTCCCACCCCTTACATGTGGAGCTATCAGCCCCAGAT
GGGCCTGGCCGCAGGCGCCTCCCAGGACTACTCCACCCGCATGAACTGGCTCAG
TGCCGGCCCCTCGATGATCTCACAGGTCAACGGGGTCCGTAACCATCGAAACCA
GATATTGTTGGAGCAGGCGGCGGTCACCTCCACGCCCAGGGCAAAGCTCAACCC
GCGTAATTGGCCCTCCACCCTGGTGTATCAGGAAATCCCCGGGCCAACTACCGT
ACTACTTCCGCGTGACGCACTGGCCGAAGTCCGCATGACTAACTCAGGTGTCCA
GCTGGCCGGCGGCGCTTCCCGGTGCCCGCTCCGCCCACAATCGGGTATAAAAAC
CCTGGTGATCCGAGGCAGAGGCACACAGCTCAACGACGAGTTGGTGAGCTCTTC
AATCGGTCTGCGACCGGACGGAGTGTTCCAACTAGCCGGAGCCGGGAGATCCTC
CTTCACTCCCCACCAGGCCTACCTGACCTTGCAGAGCAGCTCTTCGGAGCCTCGC
TCCGGAGGCATCGGAACCCTCCAGTTCGTGGAGGAGTTTGTGCCCTCGGTCTACT
TCAACCCCTTCTCGGGATCGCCAGGCCTCTACCCGGACGAGTTCATACCGAACTT
CGATGCAGTGAGAGAAGCGGTGGACGGCTACGACTGAATGTCCCATGGTGACTC
GGCTGAGCTTGCTCGGTTGAGGCATCTGGACCACTGCCGCCGCCTGCGCTGCTTC
GCCCGGGAGAGCTGCGGACTCATCTACTTTGAATTTCCCAAGGAGCACCCCAAC
GGCCCGGCACACGGAGTGCGGATCACCGTAGAGGGCACCACCGAGTCTCACCTG
GTCAGGTTCTTCACCCAGCAACCCTTCCTGGTCGAGCGGGACCGGGGCGCCACC
ACCTACACCGTCTACTGCATCGTCCTACCCCGAAGTTGCATGAGAATTTTTGTT
GTACTCTGTGTGCTGAGTTTAATAAAAGCTAAACTCCTACAATACTCTGGAATCC
CGTGTCGTCGCACTCGCAACGAGATCTTCAACCTCACCAACCAGACTGAGGTAA
AACTTAACTGCAGACCGGGGGCAAATACATCCTCTGGCTCTTTGAAAACACTT
CCTTCGCAGTCTCCAACGCCTGCGCCAACGACGGTATTGAAATACCCAACAACC
TTACCAGTGGACTAACTTACACTACCAGAAAGACTAAGCTAGTACTCTACAATC
CTTTTGTAGAGGGAACCTACCACTGCCAGAGCGGACCTTGCTTCCACACTTTCAC
TTTGGTGAACGTTACCGACAGCAGCACAGCCGCTCCAGAAACATCTAACCTTTTT
GATACTAACACTCCTAAAACCGGAGGTGAGCTCTGGGTTCCCTCTTTAACAGAG
GGGGTAAACATATTGAAGCGGTTGGGTATTTGATTTTAGGGGTGGTCCTGGGT
GGGTGCATAGCGGTGCTGTATTACCTTCCTTGCTGGAACGAAATCAAAATCTTTA
TCTGCTGGGTCATACATTGTTGGGAGGAACCATGAAGGGGCTCTTGCTGATTATC
CTTTTCCTGGTTGGGGGTGTACTGTCATGCCACGAACAGCCACGATGTAACATCA
CCACAGGCAATGAGAGGAGTGTGATATGCACAGTAGTCATCAAATGCGAGCATA
CATGTCCTCTCAACATCACATTCAAGAATAAGACCATGGGAAATTCATGGGTGG

TABLE 7-continued

Nucleic Acid Sequences of Vectors

SEQ ID NO Sequence

GCGATTGGGAACCAGGAGATGAGCAGAACTACACGGTCACTGTCCATGGTAGCG
ATGGGAATCACACTTTCGGTTTCAAATTCATTTTTGAAGTCATGTGTGATATCAC
ACTGCATGTGGCTAGACTTCATGGCTTGTGGCCCCCTACCAAGGAGAACATAGTT
GGGTTTTCTTTGGCTTTTGTGATCATGGCCTGCTTTATGTCAGGTCTGCTGGTAGG
GGCTTTAGTATGGTTCCTGAAGCGCAAGCCTAGGTATGGAAATGAGGAGAAGGA
AAAATTGCTATAAATCTTTTTCTCTTCGCAGAACCATGAATACTTTGACCGGTGT
CGTGCTGCTCTCTCTTCTTGTAGCTTTTAGTCAGGCAGGATTTCATACTATCAATG
CTACATGGTGGGCTAATATAACTTTAGTGGGACCCTCAGATACGCCAGTCACAT
GGTATGATAAACAGGGAATGCAGTTCTGTGATGGAAATACAGTTAAGAATCCTC
AAATAAGACATGAGTGTAATGAGCAAAACCTTACACTAATTCATGTGAACAAAA
CCCATGAAAGGACATACATGGGTTATAATAGACAGAGTACTCATAAGGAAGACT
ATAAAGTCATAGTTATACCGCCTCCTCCTGCTACTGTAAAGCCACAGTCAGGTCC
AGAGTATGTATATGTTAATATGGGAGAGAACAAAACCTTAGTTGGACCTCCAGG
AATACCAGTTACTTGGTATGACGGAGAAGGAAATAAATTCTGCGATGGAGAAAA
AGTTGAACATGCAGAATTTAATCATACATGTGACGAGCAAAATCTTACACTGTT
GTTTATAAATCTTACACATGATGGGGCTTATCTTGGCTATAATCGCCAGGGAACT
AAAAGAACTTGGTATGAGGTTGTAGTGACAGATGGTTTTCCAAAATCAGGGGAG
ATGAAAATCGAAGATCAGAGTAGACAAAATGAGCATAAACAGGGTGGGCAGAA
ACAGGAGGGGCAAAAGAGACAAGTCAAAAGAAAGCTAATGACAAACAGAAG
GCGACACACAGGAGGCCATCAAAACTAAAGCCGCACACACCTGAAGCAAAACT
GATTACAGTTTCTAGTGGGTCTAACTTAACATTACTTGGGCCAGATGGAAAGGTC
ACTTGGTATGATGATGATTTAAAAAGACCATGCGAGCCTGGGTATAAGTTAGGG
TGTAAGTGTGACAATCAAAACCTAACGCTAATCAATGTAACTAAACTTTATGAG
GGAGTTTACTATGGTACTAATGACAGAGGCAACAGCAAAAGATATAGAGTAAA
AGTAAACACTACTAATTCTCAAAGTGTGAAAATTCAGCCATACAACAGGTCTAC
TACTCCTAATCAGAAACACAGATTTGAATTGCAAATTGATTCTAATCAAGACAAT
GACAAAATTCCATCAACCACTGTGGCAATCGTGGTGGGAGTGATTGCGGGCTTC
ATAACTATAATCATTGTCATTCTGTGCTACATCTGCTGCCGCAAGCGTCCCAGGG
CATACAATCATATGGTAGACCCACTACTTAGCTTCTCTTACTGAGACTCAGTCAC
TTTCATTTCAGAACCATGAAGGCTTTCACAGCTTGCGTTCTGATTAGCATAGTCA
CATTAGTATCAGCTGATTACAAACAAGTTCAAGTTAGCAGAGGAGGAAACATTA
CATTAGATGGACCATTCGATAATACTACATGGACAAGATATCATAATGATGGAC
ATAAAAATGGTTGGATGAAAATTTGCACATGGACTGGAGCAACATATAAATGTC
ACAATAATGAAGCATTACTATTTTTGCTTTCAACATTACATCCGGAGTTTACAA
AGCAGAAGGGTATAAAAAGAGGTTAGAACATTTTCATCTAGAAATCAAAAAC
ATACAATTGAAGATTCTGGAGATTATGAACAACAAAAAATATATCTATATAATC
TAACAATAATTGAACCGCCAACTACTAAAGCACCCACCACCATAGTTAGAACAACTA
CTAGGGAAACAACACATCCAACCACCACAACTCACACTACACATCTAGACACTA
CAGTGCAGAATACTACTTTATTGATTGGGTTTTTAATAAGAGGAAATGAAAGTA
CTACTGATCAGACAGAGGCTACCTCAAGTGCCTTCAGCAGCACTGCAAATTTAA
CTTCGCTTGCTTCGGTAAATGAAACGATCGTGCCAATGATGTATGGCCAACCTTA
CTCAGGTTTGGATATTCAAATTACTTTTCTGGTTGTCTGTGGGATCTTTATTCTTG
TGGTTCTTCTGTACTTTGTCTGCTGCAAAGCCAGAGAAAAATCTAGGAGGCCCAT
CTACAGGCCAGTAATTGGGGATCCTCAGCCTCTCCAAGTGGAAGGGGTCTAAG
GAATCTTCTCTTCTCTTTTTCAGTATGGTGATTCAGCCATGATTCCTAGGTTCTTC
CTATTTAACATCCTCTTCTGTCTATTCAACGTGTGCGCTGCCTTCGCGGCCGTCTC
GCACGCCTCGCCCGACTGTCTTGGGCCCTTCCCCACCTACCTTCTTTTTGCCCTGC
TCACCTGCACCTGCGTCTGCAGCATTGTCTGCCTGGTCGTTACCTTCCTGCAGCTC
ATCGACTGGTGCTGCGCGCGCTACAATTATCTCCACCACAGTCCCGAATACAGG
GACGAGAACGTAGCCAGAATCTTAAGGCTCATTTGACCATGCAGACTCTGCTCA
TACTGCTATCCCTCCTCTCCCCTGCCCTCGCTGATGATGATTACTCTAAGTGCAA
ATTTGTGGAGCTATGGAATTTCTTAGACTGCTATGATGTTAAAATGGATATGCCA
TCCTATTACTTGGTGATTGTGGGGATAGTCATGGTCTGCTCCTGCACTTTCTTTGC
CATCATGATCTACCCCTGTTTTAATCTCGGCTGGAACTCTGTTGAGGCATTCACA
TACACACTAGAAAGCAGTTCACTAGCTTCCACGCCGCCACCCACACCGCCTCCCC
GCAGAAATCAGTTTCCCATGATTCAGTACTTAGAAGAGCCCCCTCCCCGGCCCCC
TTCCACTGTTAGCTACTTTCACATAACCGGCGGCGATGACTGACAACCACCTGGA
CCTCGAGATGGACGGCCAGGCTCCGAGCAGCGCCATCCTGCAACTGCGCGTCCG
TCAGCAGCAGGAGCGGGCCGCCAAGGAGCTCCTCGATGCCATCAACATCCACCA
GTGCAAGAAGGGCATCTTCTGCCTGGTCAAACAGGCAAAGATCACCTACGAGCT
CGTGTCCGGCGGCAAGCAGCATCGCCTCGCCTATGAGCTGCCCCAGCAGAAGCA
GAAGTTCACCTGCATGGTGGGCGTCAACCCCATAGTCATCACCCAGCAGTCGGG
CGAGACCAGCGGCTGCATCCACTGCTCCTGCGAAAGCCCCGAGTGCATCTACTC
CCTCCTTAAAACCCTTTGCGGACTCCGCAACCTTCTTCCCACAAACTAACTGATT
TAAGCCCAAAAACCAATCAAACCCCCTTTTCCCATCTACCCAAATAAACATTTAT
TGGAAATAATTATTCAATAAAGATCACTTACTTAAAATCTGAAAGTATGTCTTTG
GTGTAGTTGTTTAGCAGCACCTCAGTCCCCTCCTCCCAGCTCTGGTACTCCAGTC
CCCGGCGGGCGGCAAACTTTCTCCACACCTTGAAAGGGATGTCAAATTCCTGGT
CCACAATTTTCATTGTCTTCCCTCTTAGATGACAAAGAGACTCCGGGTGGAAGAT
GACTTCAACCCCGTCTACCCCTATGGCTACGCGCGGAATCAAAATATTCCCTTCC
TCACTCCCCCCCTTTGTCTCCTCCAATGGATTTCAAAACTTCCCCCCTGGGGTCCTG
TCACTTAAACTGGCTGACCCAATCACCATTAACAATCAAAATGTATCACTCAAG
GTTGAGGGGGGCTAACTTTGCAAGAAGAAACTGGAAAATTAACAGTTAATACT
GAACCACCTTTGCATCTTACAAATAACAAATTAGGGATAGCTTTAGACGCTCCAT
TTGATGTTATAGACAATAAGCTTACACTATTAGCAGGCCATGGCTTGTCTATTAT
AACAAAAGAAACATCAACACTGCCTGGCTTGGTTAATACTCTTGTAGTATTAACT

TABLE 7-continued

Nucleic Acid Sequences of Vectors

| SEQ ID NO | Sequence |
|---|---|
| | GGAAAGGGTATTGGAACAGATTTATCAAATAATGGTGGAAATATATGTGTTAGA<br>GTTGGAGAAGGCGGCGGCTTATCATTTAATGACAATGGAGACTTGGTAGCATTT<br>AATAAAAAAGAAGACAAACGCACCCTATGGACAACTCCAGACACATCTCCAAAT<br>TGCAGAATTGATCAGGATAAGGACTCTAAGCTAACTTTGGTCCTTACAAAGTGT<br>GGAAGTCAAATATTAGCCAATGTGTCATTAATTGTTGTAGCTGGAAGGTACAAA<br>ATTATCAATAACAATACTAATCCAGCTCTTAAAGGATTTACCATTAAATTGTTGT<br>TTGATAAAAATGGAGTCCTTATGGAATCTTCAAATCTTGGTAAATCATATTGGAA<br>CTTTCGAAATCAAAATTCAATTATGTCAACAGCTTATGAAAAAGCTATTGGTTTT<br>ATGCCTAATTTGGTAGCCTATCCAAAACCTACCACTGGCTCTAAAAAATATGCAA<br>GAGATATAGTTTATGGAAACATCTACCTTGGCGGAAAGCCACATCAACCAGTAA<br>CCATTAAAACTACCTTTAACCAGGAAACTGGATGTGAATACTCTATTACATTTGA<br>TTTTAGTTGGGCCAAAACTTATGTAAATGTTGAATTTGAAACTACCTCTTTTACCT<br>TTTCCTATATTGCCCAAGAATAAAGGATAAATAAACGTGTTTTTCATTTAAAAAT<br>TTCATGTATCTTTATTGATTTTTACACCAGCGCGGGTACACATTCTCCCACCACCA<br>GCCCATTTTACAGTGTAAACAATTCTCTCAGCACGGGTGGCCTTAAATAGGGGA<br>AAGTTCTCATTAGTGCGGGAACTGGACTTGGGGTTTATAATCCACACAGTTTCCT<br>GGCGAGCCAAACGGGGGTCGGTGATTGAGATGAAGCCGTCCTTTGAAAAATCAT<br>CCAAGTGGGCCTCGCAGTCCAAGGTCACAGTCTGGTGGAATGAGAAGAACGCAC<br>AGACTCATACTCGGAAAACAAAATGGGTCTGTGCCTCTCCATCAGCGCCCTTAA<br>CAGTCTCTGCCGCCGGGGCTCGGTGCGGCTGCTACAGATGGGATCGGGATCGCA<br>AGTCTCTCTCACTATAATCCCCACAGCCTTTAGCATTAGTCTTCTGGTGCGTCGG<br>GCACAGCACCGCATCCTAATCTCGCTCATGTTTTCACAGTAAGTGCAGCACATAA<br>TGACCATGTTATTCAGCAGCCCATAATTTAGGGTGCTCCAGCCAAAGCTTATGTT<br>GGAAATGATGGAACCCACGTGACCATCGTACCAAATGCGGCAGTATATCAGGTG<br>CCTGCCCCTTATAAACACACTGCCCATATACATAATCTCTTTGGACATGTTTCTAT<br>TTACAATCTGCCGGTACCAGGGGAAGCGCTGGTTAAACATGCACCCGTAAATGA<br>CTCTCCTAAACCACACGGCCAGCAGGGTGCCTCCCGCCCGGCACTGCAGGGAGC<br>CCGGGGATAAACAGTGGCAATGCAGGATCCAGCGCTCGTACCCGCTTACCATCT<br>GGGCTCTTACCAGATCCAGGGTAGCGGGACACAGGCACACTGACATACATCTTT<br>TTAAAATTTTTATTTCCTTTCGGGTCAGGATCATATCCCAGGGGACTGGAAACTC<br>TTGGAGCAGGGTAAAA |
| SEQ ID<br>NO: 1452 | GCGCCAGTCCTCCGATAGACTGAGTCGCCCGGGTACCCGTGTATCCAATAAATC<br>CTCTTGCTGTTGCATCCGACTCGTGGTCTCGCTGTTCCTTGGGAGGGTCTCCTCAG<br>AGTGATTGACTACCCGTCTCGGGGGTCTTTCATTTGGGGGCTCGTCCGGGATCTG<br>GAGACCCCTGCCCAGGGACCACCGACCCACCACCGGGAGGTAAGCTGGCCAGC<br>AATTGTTCTGTGTCTGTCCATTGTCCTGTGTCTTTGATTGATTTTATGCGCCTGTG<br>TCTGTACTAGTTGGCCGACTAGATTGGTATCTGGCGGATCTGGTGGAACTGAC<br>GAGTTCGAGACACCCGGCCGCAACCCTGGGAGACGTCCCAGGGACTTCGGGGGC<br>CATTTTTGTGGCCCGGCCAGAGTCCAACCATCCCGATCGTTTTGGACTCTTTGGT<br>GCACCCCCCTTAGAGGAGGGGTATGTGGTTCTGGTAGGAGACAGAGGGCTAAAA<br>CGGTTTCCGCCCCCGTCTGAGTTTTTGCTTTCGGTTTGGAACCGAAGCCGCGCCG<br>CGCGTCTTGTCTGCTGCAGCATCGTTCTGTGTTGTCTCTGTTTGACTGTTTTTCTG<br>TATTTGTCTGAAAACATGGGCCAGGCTGTTACCACCCCCTTAAGTTTGACTTTAG<br>ACCACTGGAAGGATGTCGAACGGACAGCCCACAACCTGTCGGTAGAGGTTAGAA<br>AAAGGCGCTGGGTTACATTCTGCTCTGCAGAATGGCCAACCTTCAACGTCGGAT<br>GGCCACGAGACGGCACTTTTAACCCAGACATTATTACACAGGTTAAGATCAAGG<br>TCTTCTCACCTGGCCCACATGGACATCCGGATCAGGTCCCCTACATCGTGACCTG<br>GGAAGCTATAGCAGTAGACCCCCCTCCCTGGGTCAGACCCTTCGTGCACCCTAA<br>ACCTCCCCTCTCTCTTCCCCCTTCAGCCCCCTCTCTCCCACCTGAACCCCCACTCT<br>CGACCCCGCCCCAGTCCTCCCTCTATCCGGCTCTCACTTCTCCTTTAAACACCAA<br>ACCTAGGCCTCAAGTCCTTCCTGATAGCGGAGGACCACTCATTGATCTACTCACG<br>GAGGACCCTCCGCCTTACCGGGACCCAGGGCACCCTCTCCTGACGGGAACGGC<br>GATAGCGGAGAAGTGGCCCCTACAGAAGGAGCCCCTGACCCTTCCCCAATGGTA<br>TCCCGCCTGCGGGGAAGAAAAGAACCCCCCGTGGCGGATTCTACTACCTCTCAG<br>GCGTTCCCCCTTCGCCTGGGAGGGAATGGACAGTATCAATACTGGCCATTTTCCT<br>CCTCTGACCTCTATAACTGGAAAAATAACAACCCCTCTTTCTCCGAGGACCCAGC<br>TAAATTGACAGCTTTGATCGAGTCCGTTCTCCTTACTCATCAGCCCACTTGGGAT<br>GACTGCCAACAGCTATTAGGGACCCTGCTGACGGGAGAAGAAAAACAGCGAGT<br>GCTCCTAGAGGCCCGAAAGGCGGTTCGAGGGGAGGACGGACGCCCAACTCAGC<br>TGCCCAATGACATTAATGATGCTTTTCCCTTGGAACGTCCCGACTGGGACTACAA<br>CACCCAACGAGGTAGGAACCACCTAGTCCACTATCGCCAGTTGCTCCTAGCGGG<br>TCTCCAAAACGCGGGCAGAAGCCCCACCAATTTGGCCAAGGTAAAGGGATAAC<br>CCAGGGACCTAATGAGTCTCCCTCAGCCTTTTTAGAGAGACTCAAGGAGGCCTA<br>TCGCAGATACACTCCTTATGACCCTGAGGACCCAGGGCAAGAAACCAATGTGGC<br>CATGTCATTCATCTGGCAGTCCGCCCCGGATATCGGGCGAAAGTTAGAGCGGTT<br>AGAAGATTTGAAGAGTAAGACCTTAGGAGACTTAGTGAGGGAAGCTGAAAAGA<br>TCTTTAATAAACGAGAAACCCCGGAAGAAAGAGAGGAACGTATTAGGAGAGAA<br>ACAGAGGAAAGGAAGAACGCCGTAGGGCAGAGGATGTGCAGAGAGAGAAGG<br>AGAGGGACCGCAGAAGACATAGAGAAATGAGTAAGTTGCTGGCTACTGTCGTTA<br>GCGGGCAGAGACAGGATAGACAGGGAGGAGAGCGAAGGAGGCCCCAACTCGAC<br>CACGACCAGTGTGCCTACTGCAAAGAAAAGGGACATTGGGCTAGAGATTGCCCC<br>AAGAAGCCAAGAGGACCCCGGGGACCACGACCCCAGGCCTCCTCCTGACCTTA<br>GACGATTAGGGAGGTCAGGGTCAGGAGCCCCCCCCTGAACCCAGGATAACCCTC<br>AGAGTCGGGGGGCAACCCGTCACCTTCCTAGTGGATACTGGGGCCCAACACTCC<br>GTGCTGACCCAAAATCCTGGACCCCTAAGTGACAAGTCTGCCTGGGTCCAAGGG |

TABLE 7-continued

Nucleic Acid Sequences of Vectors

| SEQ ID NO | Sequence |
|---|---|
| | GCTACTGGAGGGAAGCGGTATCGCTGGACCACGGATCGCCGAGTGCACCTAGCC
ACCGGTAAGGTCACCCATTCTTTCCTCCATGTACCAGATTGCCCCTATCCTCTGCT
AGGAAGAGATTTGCTGACTAAACTAAAAGCCCAAATTCACTTTGAGGGATCAGG
AGCTCAGGTTGTGGGACCAATGGGACAGCCCCTGCAAGTGCTGACCCTAAACAT
AGAAGATGAGTATCGGCTACATGAGACCTCAAAAGGGCCAGATGTGCCTCTAGG
GTCCACATGGCTCTCTGATTTTCCCCAGGCCTGGGCAGAAACCGGGGGCATGGG
GCTGGCCGTTCGCCAAGCTCCTCTGATCATACCTCTGAAGGCAACCTCTACCCCC
GTGTCCATAAAACAATACCCCATGTCACAAGAAGCCAGACTGGGGATCAAGCCC
CACATACAGAGACTGCTGGATCAGGGAATTCTGGTACCCTGCCAGTCCCCCTGG
AACACGCCCCTGCTACCCGTTAAGAAACCGGGGACTAATGATTATAGGCCTGTC
CAGGATCTGAGAGAAGTCAACAAGCGGGTGGAAGACATCCACCCCACCGTGCCC
AACCCTTACAACCTCTTGAGCGGGCTCCCACCGTCCCACCAGTGGTACACTGTGC
TTGACTTAAAAGATGCTTTTTTCTGCCTGAGACTCCACCCCACCAGTCAGTCTCT
CTTCGCCTTTGAGTGGAGAGATCCAGAGATGGGAATCTCAGGACAATTAACCTG
GACCAGACTCCCGCAGGGTTTCAAAAACAGTCCCACCCTGTTTGATGAAGCCCT
GCACAGGGACCTCGCAGACTTCCGGATCCAGCACCCAGACCTGATTCTGCTCCA
GTATGTAGATGACTTACTGCTGGCCGCCACTTCTGAGCTTGACTGTCAACAAGGT
ACGCGGGCCCTGTTACAAACCCTAGGGGACCTCGGATATCGGGCCTCGGCCAAG
AAAGCCCAAATTTGCCAGAAACAGGTCAAGTATCTGGGGTATCTTCTAAAAGAG
GGTCAGAGATGGCTGACTGAGGCCAGAAAAGAGACTGTGATGGGGCAGCCTAC
TCCGAAGACCCCTCGACAACTAAGGGAGTTCCTAGGGACGGCAGGCTTCTGTCG
CCTCTGGATCCCTGGGTTTGCAGAAATGGCAGCCCCCTTGTACCCTCTCACCAAA
ACGGGGACTCTGTTTGAGTGGGGCCCAGACCAGCAAAAGGCCTACCAAGAGATC
AAGCAGGCTCTCTTAACTGCCCCTGCCCTGGGATTGCAGACTTGACTAAGCCCT
TCGAACTTTTTGTTGACGAGAAGCAGGGCTACGCCAAAGGTGTCCTAACGCAAA
AACTGGGGCCTTGGCGTCGGCCGGTGGCCTACCTGTCCAAAAAGCTAGACCCAG
TGGCAGCTGGGTGGCCCCCTTGCCTACGGATGGTAGCAGCCATCGCCGTTCTGAC
CAAAGACGCTGGCAAGCTCACCATGGGACAGCCACTAGTCATTCTGGCCCCCCA
TGCAGTAGAGGCACTAGTTAAGCAACCCCCTGATCGCTGGCTCTCCAACGCCCG
AATGACCCACTACCAGGCTCTGCTTCTGGACACGGACCGAGTCCAGTTCGGACC
AATAGTGGCCCTAAACCCAGCTACGCTGCTCCCTCTACCTGAGGAGGGGCTGCA
ACATGACTGCCTTGACATCTTGGCTGAAGCCCACGGAACTAGACCAGATCTTAC
GGACCAGCCTCTCCCAGACGCTGACCACACCTGGTACACAGATGGGAGCAGCTT
CCTGCAAGAGGGGCAGCGCAAGGCCGGAGCAGCAGTAACCACCGAAGACCGAGG
TAGTCTGGGCCAAAGCACTGCCAGCCGGGACATCGGCCCAAAGAGCTGAGTTGA
TAGCGCTCACCCAAGCCTTAAAAATGGCAGAAGGTAAGAAGCTGAATGTTTACA
CCGATAGCCGTTATGCTTTTGCCACTGCCCATATTCACGGAGAAATATATAGAAG
GCGCGGGTTGCTCACATCAGAAGGAAAAGAAATCAAAAATAAGGACGAGATCT
TGGCCCTACTGAAGGCTCTCTTCCTGCCCAAAAGACTTAGCATAATTCATTGCCC
GGGACATCAGAAGGGAAACCGCGCGGAGGCAAGGGGCAACAGGATGGCCGACC
AAGCGGCCCGAGAAGTAGCCACTAGAGAAACTCCAGAGACTTCCACACTTCTGA
TAGAAAATTCAGCCCCCTATACTCATGAACATTTTCACTATACGGTGACTGACAT
AAAAGATCTGACTAAACTAGGGGCCACTTATGACGATGCAAAGAAGTGTTGGGT
TTATCAGGGAAAGCCTGTAATGCCTGATCAATTCACCTTTGAACTATTAGATTTT
CTTCATCAATTGACCCACCTCAGTTTCTCAAAAACAAAGGCTCTTCTAGAAAGGA
ACTACTGTCCTTATTACATGCTGAACCGGGATCGAACGCTCAAAGACATCACTG
AGACTTGCCAAGCCTGTGCACAGGTCAATGCCAGCAAGTCTGCCGTCAAACAAG
GGACTAGAGTTCGAGGGCACCGACCCGGCACCCACTGGGAAATTGATTTCACTG
AGGTAAAACCTGGCCTGTATGGGTATAAATATCTTTTAGTTTTCATAGACACTTT
CTCTGGATGGGTAGAAGCTTTCCCAACCAAGAAAGAAACTGCCAAAGTTGTAAC
CAAGAAGCTACTAGAAGAAATCTTCCCCAGATTCGGCATGCCACAGGTATTGGG
AACCGACAATGGGCCTGCCTTCGTCTCCAAGGTAAGTCAGACAGTAGCCGATTT
ACTGGGGGTTGATTGGAAACTACATTGTGCTTACAGACCCCAGAGTTCAGGTCA
GGTAGAAAGAATGAATAGGACAATCAAGGAGACTTTAACTAAATTGACGCTTGC
AACTGGCTCTAGGGACTGGGTGCTCCTGCTTCCCCTAGCCCTGTATCGAGCCCGC
AACACGCCGGGCCCCATGGTCTCACCCCATATGAAATCTTATATGGGGCACCC
CCGCCCCTTGTAAACTTCCCTGATCCTGACATGGCAAAGGTTACTCATAACCCCT
CTCTCCAAGCCCATTTACAGGCACTCTACCTGGTCCAGCACGAAGTCTGGAGACC
GTTGGCGGCAGCTTACCAAGAACAACTGGACCGGCCGGTAGTGCCTCACCCTTT
CCGAGTCGGTGACACAGTGTGGGTCCGCAGACACCAAACTAAAAATCTAGAACC
CCGCTGGAAAGGACCTTATACCGTCCTACTGACTACCCCCACCGCTCTCAAAGTG
GACGGCATTGCAGCGTGGATCCACGCTGCCCACGTAAAGGCTGCCGACACCAGG
ATTGAGCCACCATCGGAATCGACATGGCGTGTTCAACGCTCTCAAAATCCCCTA
AAGATAAGATTGACCCGCGGGACCTCCTAATCCCCTTAATTCTCTTCCTGTCTCT
CAAAGGGGCCAGATCCGCAGCACCCGGCTCCAGCCCTCACCAGGTCTACAACAT
TACCTGGGAAGTGACCAATGGGGATCGGGAGACAGTATGGGCAATATCAGGCA
ACCACCCTCTGTGGACTTGGTGGCCAGTCCTCACCCCAGATTTGTGTATGTTAGC
TCTCAGTGGGCCGCCCCACTGGGGGCTAGAGTATCAGGCCCCCTATTCCTCGCCC
CCGGGGCCCCTTGTTGCTCAGGGAGCAGCGGGAACGTTGCAGGCTGTGCCAGA
GACTGCAACGAGCCCTTGACCTCCCTCACCCCTCGGTGCAACACTGCCTGGAAC
AGACTTAAGCTGGACCAGGTAACTCATAAATCAAGTGAGGGATTTTATGTCTGC
CCCGGGTCACATCGCCCCCGGGAAGCCAAGTCCTGTGGGGGTCCAGACTCCTTC
TACTGTGCCTCTTGGGGCTGCGAGACAACCGGTAGAGTATACTGGAAGCCCTCC
TCTTCTTGGGACTACATCACAGTAGACAACAATCTCACCTCTAACCAGGCTGTTC
AGGTATGCAAAGACAATAAGTGGTGCAATCCCTTGGCTATCCGGTTTACAAACG
CCGGGAAACAGGTCACCTCATGGACAACTGGACACTATTGGGGTCTACGTCTTT |

TABLE 7-continued

Nucleic Acid Sequences of Vectors

| SEQ ID NO | Sequence |
|---|---|
| | ATGTCTCTGGACAGGACCCAGGGCTTACTTTCGGGATCCGACTCAGTTATCAAAA<br>TCTAGGACCTCGGATCCCAATAGGACCAAACCCCGTCCTGGCAGACCAACTTTC<br>GTTCCCGCTACCTAATCCCCTACCCAAACCTGCCAAGTCTCCCCCCGCCTCTAGT<br>TCGACTCCCACATTGATTTCCCCGTCCCCCACTCCCACTCAGCCCCCGCCAGCAG<br>GAACGGGAGACAGATTACTAAATCTAGTACAGGGAGCTTACCAGGCACTCAACC<br>TTACCAACCCTGATAAAACTCAAGAGTGCTGGTTATGCCTAGTGTCTGGACCCCC<br>CTATTACGAGGGGGTTGCCGTCCTAGGTACTTATTCCAACCATACCTCTGCCCCA<br>GCTAACTGCTCCGTGGCCTCCCAACACAAGCTGACCCTGTCCGAAGTGACTGGA<br>CGGGGACTCTGCATAGGAACAGTCCCAAAAACTCACCAGGCCCTGTGCAACACT<br>ACCCTTAAGGCAGGCAAAGGGTCTTACTATCTAGTTGCCCCCACAGGAACTATG<br>TGGGCATGTAACACTGGACTCACTCCATGCCTATCTGCCACCGTGCTTAATCGCA<br>CCACTGACTATTGCGTTCTCGTGGAATTATGGCCCAGGGTCACCTACCATCCTCC<br>CAGTTACGTCTATAGCCAGTTTGAAAAATCCCATAGACATAAAAGAGAACCAGT<br>GTCCTTAACCTTGGCCTTATTATTAGGTGGGCTAACTATGGGTGGCATCGCCGCG<br>GGAGTAGGGACAGGAACTACCGCCCTGGTCGCCACCCAGCAGTTTCAGCAGCTC<br>CATGCTGCCGTACAAGATGATCTCAAAGAAGTCGAAAAGTCAATTACTAACCTA<br>GAAAAGTCTCTTACTTCGTTGTCTGAGGTTGTACTGCAGAATCGACGAGGCCTAG<br>ACCTGTTGTTCCTAAAAGAGGGAGGACTGTGTGCTGCCCTAAAAGAAGAATGTT<br>GTTTCTATGCTGACCATACAGGCCTAGTAAGAGATAGTATGGCCAAATTAAGAG<br>AGAGACTCTCTCAGAGACAAAAACTATTTGAGTCGAGCCAAGGATGGTTCGAAG<br>GATGGTTTAACAGATCCCCCTGGTTTACCACGTTGATATCCACCATCATGGGGCC<br>TCTCATTATACTCCTACTAATTCTGCTTTTTGGACCCTGCATTCTTAATCGATTAG<br>TTCAATTTGTTAAAGACAGGATCTCAGTAGTCCAGGCTTTAGTCCTGACTCAACA<br>ATACCACCAGCTAAAACCACTAGAATACGAGCCACAATAAATAAAAGATTTTAT<br>TTAGTTTCCAGAAAAAGGGGGAATGAAAGACCCCACCAAATTGCTTAGCCTGA<br>TAGCCGCAGTAACGCCATTTTGCAAGGCATGGAAAAATACCAAACCAAGAATAG<br>AGAAGTTCAGATCAAGGGCGGGTACACGAAAACAGCTAACGTTGGGCCAAACA<br>GGATATCTGCGGTGAGCAGTTTCGGCCCCGGCCCGGGGCAAGAACAGATGGTC<br>ACCGCGGTTCGGCCCCGGCCCGGGGCAAGAACAGATGGTCCCCAGATATGGCC<br>CAACCCTCAGCAGTTTCTTAAGACCCATCAGATGTTTCCAGGCTCCCCCAAGGAC<br>CTGAAATGACCCTGTGCCTTATTTGAATTAACCAATCAGCCTGCTTCTCGCTTCT<br>GTTCGCGCGCTTCTGCTTCCCGAGCTCTATAAAAGAGCTCACAACCCCTCACTCG<br>GCGCGCCAGTCCTCCGATAGACTGAGTCGCCCGGGTACCCGTGTATCCAATAAA<br>TCCTCTTGCTGTTGCA |
| SEQ ID<br>NO: 1453 | TATGCGCCTGCGTCGGTACTAGTTAGCTAACTAGCTCTGTATCTGGCGGACCCGT<br>GGTGGAACTGACGAGTTCGGAACACCCGGCCGCAACCCTGGGAGACGTCCCAGG<br>GACTTCGGGGGCCGTTTTTGTGGCCCGACCTGAGTCCAAAAATCCCGATCGTTTT<br>GGACTCTTTGGTGCACCCCCCTTAGAGGAGGGATATGTGGTTCTGGTAGGAGAC<br>GAGAACCTAAAACAGTTCCCGCCTCCGTCTGAATTTTTGCTTTCGGTTTGGGACC<br>GAAGCCGCGCCGCGCGTCTTGTCTGCTGCAGCATCGTTCTGTGTTGTCTCTGTCT<br>GACTGTGTTTCTGTATTTGTCTGAGAATATGGGCCAGACTGTTACCACTCCCTTA<br>AGTTTGACCTTAGGTCACTGGAAAGATGTCGAGCGGATCGCTCACAACCAGTCG<br>GTAGATGTCAAGAAGAGACGTTGGGTTACCTTCTGCTCTGCAGAATGGCCAACC<br>TTTAACGTCGGATGGCCGCGAGACGGCACCTTTTAACCGAGACCTCATCACCCAG<br>GTTAAGATCAAGGTCTTTTCACCTGGCCCGCATGGACACCCAGACCAGGTCCCCT<br>ACATCGTGACCTGGGAAGCCTTGGCTTTTGACCCCCCTCCCTGGGTCAAGCCCTT<br>TGTACACCCTAAGCCTCCGCCTCCTCTTCCTCCATCCGCCCCGTCTCTCCCCCTTG<br>AACCTCCTCGTTCGACCCCGCCTCGATCCTCCCTTTATCCAGCCCTCACTCCTTCT<br>CTAGGCGCCAAACCTAAACCTCAAGTTCTTTCTGACAGTGGGGGCCGCTCATC<br>GACCTACTTACAGAAGACCCCCGCCTTATAGGGACCCAAGACCACCCCCTTCC<br>GACAGGGACGGAAATGGTGGAGAAGCGACCCCTGCGGGAGAGGCACCGGACCC<br>CTCCCCAATGGCATCTCGCCTACGTGGGAGACGGGAGCCCCCTGTGGCCGACTC<br>CACTACCTCGCAGGCATTCCCCCTCCGCGCAGGAGGAAACGGACAGCTTCAATA<br>CTGGCCGTTCTCCTCTTCTGACCTTTACAACTGGAAAAATAATAACCCTTCTTTTT<br>CTGAAGATCCAGGTAAACTGACAGCTCTGATCGAGTCTGTTCTCATCACCCATCA<br>GCCCACCTGGGACGACTGTCAGCAGCTGTTGGGGACTCTGCTGACCGGAGAAGA<br>AAAACAACGGGTGCTCTTAGAGGCTAGAAAGGCGGTGCGGGGCGATGATGGGC<br>GCCCCACTCAACTGCCCAATGAAGTCGATGCCGCTTTTCCCCTCGAGCGCCCAGA<br>CTGGGATTACACCACCCAGGCAGGTAGGAACCACCTAGTCCACTATCGCCAGTT<br>GCTCCTAGCGGGTCTCCAAAACGCGGGCAGAAGCCCCACCAATTTGGCCAAGGT<br>AAAAGGAATAACACAAGGGCCCAATGAGTCTCCCTCGGCCTTCCTAGAGAGACT<br>TAAGGAAGCCTATCGCAGGTACACTCCTTATGACCCTGAGGACCCAGGGCAAGA<br>AACTAATGTGTCTATGTCTTTCATTTGGCAGTCTGCCCCAGACATTGGGAGAAAG<br>TTAGAGAGGTTAGAAGATTTAAAAAACAAGACGCTTGGAGATTTGGTTAGAGAG<br>GCAGAAAAGATCTTTAATAAACGAGAAACCCCGGAAGAAAGAGAGGAACGTAT<br>CAGGAGAGAAACAGAGGAAAAAGAAGAACGCCGTAGGACAGAGGATGAGCAG<br>AAAGAGAAAGAAAGAGATCGTAGGAGACATAGAGAGATGAGCAAGCTATTGGC<br>CACTGTCGTTAGTGGACAGAAACAGGATAGACAGGGAGGAGAACGAAGGAGGT<br>CCCAACTCGATCGCGACCAGTGTGCCTACTGCAAAGAAAAGGGGCACTGGGCTA<br>AAGATTGTCCCAAGAAACCACGAGGACCTCGGGGACCAAGACCCCAGACCTCCC<br>TCCTGACCCTAGATGACTAGGGAGGTCAGGGTCAGGAGCCCCCCCCTGAACCCA<br>GGATAACCCTCAAAGTCGGGGGCAACCCGTCACCTTCCTGGTAGATACTGGGG<br>CCCAACACTCCGTGCTGACCCAAAATCCTGGACCCCTAAGTGATAAGTCTGCCTG<br>GGTCCAAGGGGCTACTGGAGGAAAGCGGTATCGCTGGACCACGGATCGCAAAG<br>TACATCTAGCTACCGGTAAGGTCACCCACTCTTTCCTCCATGTACCAGACTGTCC |

TABLE 7-continued

Nucleic Acid Sequences of Vectors

SEQ ID NO Sequence

```
CTATCCTCTGTTAGGAAGAGATTTGCTGACTAAACTAAAAGCCCAAATCCACTTT
GAGGGATCAGGAGCTCAGGTTATGGGACCAATGGGGCAGCCCCTGCAAGTGTTG
ACCCTAAATATAGAAGATGAGCATCGGCTACATGAGACCTCAAAAGAGCCAGAT
GTTTCTCTAGGGTCCACATGGCTGTCTGATTTTCCTCAGGCCTGGGCGGAAACCG
GGGGCATGGGACTGGCAGTTCGCCAAGCTCCTCTGATCATACCTCTGAAAGCAA
CCTCTACCCCCGTGTCCATAAAACAATACCCCATGTCACAAGAAGCCAGACTGG
GGATCAAGCCCCACATACAGAGACTGTTGGACCAGGGAATACTGGTACCCTGCC
AGTCCCCCTGGAACACGCCCCTGCTACCCGTTAAGAAACCAGGGACTAATGATT
ATAGGCCTGTCCAGGATCTGAGAGAAGTCAACAAGCGGGTGGAAGACATCCACC
CCACCGTGCCCAACCCTTACAACCTCTTGAGCGGGCTCCCACCGTCCCACCAGTG
GTACACTGTGCTTGATTTAAAGGATGCCTTTTTCTGCCTGAGACTCCACCCCACC
AGTCAGCCTCTCTTCGCCTTTGAGTGGAGAGATCCAGAGATGGGAATCTCAGGA
CAATTGACCTGGACCAGACTCCCACAGGGTTTCAAAAACAGTCCACCCTGTTTG
ATGAGGCACTGCACAGAGACCTAGCAGACTTCCGGATCCAGCACCCAGACTTGA
TCCTGCTACAGTACGTGGATGACTTACTGCTGGCCGCCACTTCTGAGCTAGACTG
CCAACAAGGTACTCGGGCCCTGTTACAAACCCTAGGGAACCTCGGGTATCGGGC
CTCGGCCAAGAAAGCCCAAATTTGCCAGAAACAGGTCAAGTATCTGGGGTATCT
TCTAAAAGAGGGTCAGAGATGGCTGACTGAGGCCAGAAAAGAGACTGTGATGG
GGCAGCCTACTCCGAAGACCCTCGACAACTAAGGGAGTTCCTAGGGACGGCAG
GCTTCTGTCGCCTCTGGATCCCTGGGTTTGCAGAAATGGCAGCCCCCTTGTACCC
TCTCACCAAAACGGGGACTCTGTTTAATTGGGGCCCAGACCAACAAAAGGCCTA
TCAAGAAATCAAGCAAGCTCTTCTAACTGCCCCAGCCCTGGGGTTGCCAGATTTG
ACTAAGCCCTTTGAACTCTTTGTCGACGAGAAGCAGGGCTACGCCAAAGGTGTC
CTAACGCAAAAACTGGGACCTTGGCGTCGGCCGGTGGCCTACCTGTCCAAAAAG
CTAGACCCAGTAGCAGCTGGGTGGCCCCCTTGCCTACGGATGGTAGCAGCCATT
GCCGTACTGACAAAGGATGCAGGCAAGCTAACCATGGGACAGCCACTAGTCATT
CTGGCCCCCCATGCAGTAGAGGCACTAGTCAAACAACCCCCCGACCGCTGGCTT
TCCAACGCCCGGATGACTCACTATCAGGCCTTGCTTTTGGACACGGACCGGGTCC
AGTTCGGACCGGTGGTAGCCCTGAACCCGGCTACGCTGCTCCCACTGCCTGAGG
AAGGGCTGCAACACAACTGCCTTGATATCCTGGCCGAAGCCCACGGAACCCGAC
CCGACCTAACGACCAGCCGCTCCCAGACGCCGACCACACCTGGTACACGGATG
GAAGCAGTCTCTTACAAGAGGGACAGCGTAAGGCGGGAGCTGCGGTGACCACC
GAGACCGAGGTAATCTGGGCTAAAGCCCTGCCCAGCCGGGACATCCGCTCAGCGG
GCTGAACTGATAGCACTCACCCAGGCCCTAAAGATGGCAGAAGGTAAGAAGCTA
AATGTTTATACTGATAGCCGTTATGCTTTTGCTACTGCCCATATCCATGGAGAAA
TATACAGAAGGCGTGGGTTGCTCACATCAGAAGGCAAAGAGATCAAAAATAAA
GACGAGATCTTGGCCCTACTAAAAGCCCTCTTTCTGCCCAAAAGACTTAGCATAA
TCCATTGTCCAGGACATCAAAAGGGACACAGCGCCGAGGCTAGAGGCAACCGG
ATGGCTGACCAAGCGGCCCGAAAGGCAGCCATCACAGAGACTCCAGACACCTCT
ACCCTCCTCATAGAAAATTCATCACCCTACACCTCAGAACATTTTCATTACACAG
TGACTGATATAAAGGACCTAACCAAGTTGGGGGCCATTTATGATAAAACAAAGA
AGTATTGGGTCTACCAAGGAAAACCTGTGATGCCTGACCAGTTTACTTTTGAATT
ATTAGACTTTCTTCATCAGCTGACTCACCTCAGCTTCTCAAAAATGAAGGCTCTC
CTAGAGAAGCCACAGTCCCTACTACATGCTGAACCGGGATCGAACACTCAAA
AATATCACTGAGACCTGCAAAGCTTGTGCACAAGTCAACGCCAGCAAGTCTGCC
GTTAAACAGGGAACTAGGGTCGCGGGCATCGGCCCGGCACTCATTGGGAGATC
GATTTCACCGAGATAAAGCCCGGATTGTATGGCTATAAATATCTTCTAGTTTTTA
TAGATACCTTTTCTGGCTGGATAGAAGCCTTCCCAACCAAGAAAGAAACCGCCA
AGGTCGTAACCAAGAAGCTACTAGAGGAGATCTTCCCCAGGTTCGGCATGCCTC
AGGTATTGGGAACTGACAATGGGCCTGCCTTCGTCTCCAAGGTGAGTCAGACAG
TGGCCGATCTGTTGGGGATTGATTGGAAATTACATTGTGCATACAGACCCCAAA
GCTCAGGCCAGGTAGAAAGAATGAATAGAACCATCAAGGAGACTTTAACTAAAT
TAACGCTTGCAACTGGCTCTAGAGACTGGGTGCTCCTACTCCCCTTAGCCCTGTA
CCGAGCCCGCAACACGCCGGGCCCCCATGGCCTCACCCCATATGAGATCTTATA
TGGGGCACCCCCGCCCCTTGTAAACTTCCCTGACCCTGACATGACAAGAGTTACT
AACAGCCCCTCTCTCCAAGCTCACTTACAGGCTCTCTACTTAGTCCAGCACGAAG
TCTGGAGACCTCTGGCGGCAGCCTACCAAGAACAACTGGACCGACCGGTGGTAC
CTCACCCTTACCGAGTCGGCGACACAGTGTGGGTCCGCCGACACCAGACTAAGA
ACCTAGAACCTCGCTGGAAAGGACCTTACACAGTCCTGCTGACCACCCCCACCG
CCCTCAAAGTAGACGGCATCGCAGCTTGGATACACGCCGCCCACGTGAAGGCTG
CCGACCCCGGGGTGGACCATCCTCTAGACTGACATGGCGCGTTCAACGCTCTC
AAAACCCCTTAAAAATAAGGTTAACCCGCGAGGCCCCCTAATCCCCTTAATTCTT
CTGATGCTCAGAGGGGTCAGTACTGCTTCGCCCGGCTCCAGTCCTCATCAAGTCT
ATAATATCACCTGGGAGGTAACCAATGGAGATCGGGAGACGGTATGGGCAACTT
CTGGCAACCACCCTCTGTGGACCTGGTGGCCTGACCTTACCCCAGATTTATGTAT
GTTAGCCCACCATGGACCATCTTATTGGGGCTAGAATATCAATCCCCTTTTTCT
TCTCCCCCGGGGCCCCTTGTTGCTCAGGGGGCAGCAGCCCAGGCTGTTCCAGA
GACTGCGAAGAACCTTTAACCTCCCTCACCCCTCGGTGCAACACTGCCTGGAAC
AGACTCAAGCTAGACCAGACAACTCATAAATCAAATGAGGGATTTTATGTTTGC
CCCGGGCCCCACCGCCCCGAGAATCCAAGTCATGTGGGGGTCCAGACTCCTTC
TACTGTGCCTATTGGGGCTGTGAGACAACCGGTAGAGCTTACTGGAAGCCCTCCT
CATCATGGGATTTCATCACAGTAAACAACAATCTCACCTCTGACCAGGCTGTCCA
GGTATGCAAAGATAATAAGTGGTGCAACCCCTTAGTTATTCGGTTTACAGACGC
CGGGAGACGGGTTACTTCCTGGACCACAGGACATTACTGGGGCTTACGTTTGTAT
GTCTCCGGACAAGATCCAGGGCTTACATTTGGGATCCGACTCAGATACCAAAAT
CTAGGACCCCGCGTCCCAATAGGGCCAAACCCCGTTCTGGCAGACCAACAGCCA
```

TABLE 7-continued

Nucleic Acid Sequences of Vectors

| SEQ ID NO | Sequence |
|---|---|
| | CTCTCCAAGCCCAAACCTGTTAAGTCGCCTTCAGTCACCAAACCACCCAGTGGG<br>ACTCCTCTCTCCCCTACCCAACTTCCACCGGCGGGAACGGAAAATAGGCTGCTA<br>AACTTAGTAGACGGAGCCTACCAAGCCCTCAACCTCACCAGTCCTGACAAAACC<br>CAAGAGTGCTGGTTGTGTCTAGTAGCGGGACCCCCCTACTACGAAGGGGTTGCC<br>GTCCTGGGTACCTACTCCAACCATACCTCTGCTCCAGCCAACTGCTCCGTGGCCT<br>CCCAACACAAGTTGACCCTGTCCGAAGTGACCGGACAGGGACTCTGCATAGGAG<br>CAGTTCCCAAAACACATCAGGCCCTATGTAATACCACCCAGACAAGCAGTCGAG<br>GGTCCTATTATCTAGTTGCCCCTACAGGTACCATGTGGGCTTGTAGTACCGGGCT<br>TACTCCATGCATCTCCACCACCATACTGAACCTTACCACTGATTATTGTGTTCTTG<br>TCGAACTCTGGCCAAGAGTCACCTATCATTCCCCCAGCTATGTTTACGGCCTGTT<br>TGAGAGATCCAACCGACACAAAAGAGAACCGGTGTCGTTAACCCTGGCCCTATT<br>ATTGGGTGGACTAACCATGGGGGGAATTGCCGCTGGAATAGGAACAGGGACTAC<br>TGCTCTAATGGCCACTCAGCAATTCCAGCAGCTCCAAGCCGCAGTACAGGATGA<br>TCTCAGGGAGGTTGAAAAATCAATCTCTAACCTAGAAAAGTCTCTCACTTCCCTG<br>TCTGAAGTTGTCCTACAGAATCGAAGGGGCCTAGACTTGTTATTTCTAAAAGAA<br>GGAGGGCTGTGTGCTGCTCTAAAAGAAGAATGTTGCTTCTATGCGGACCACACA<br>GGACTAGTGAGAGACAGCATGGCCAAATTGAGAGAGAGGCTTAATCAGAGACA<br>GAAACTGTTTGAGTCAACTCAAGGATGGTTTGAGGGACTGTTTAACAGATCCCCT<br>TGGTTTACCACCTTGATATCTACCATTATGGGACCCCTCATTGTACTCCTAATGAT<br>TTTGCTCTTCGGACCCTGCATTCTTAATCGATTAGTCCAATTTGTTAAAGACAGG<br>ATATCAGTGGTCCAGGCTCTAGTTTTGACTCAACAATATCACCAGCTGAAGCCTA<br>TAGAGTACGAGCCATAGATAAAATAAAAGATTTTATTTAGTCTCCAGAAAAAGG<br>GGGGAATGAAAGACCCCACCTGTAGGTTTGGCAAGCTAGCTTAAGTAACGCCAT<br>TTTGCAAGGCATGGAAAAATACATAACTGAGAATAGAGAAGTTCAGATCAAGGT<br>CAGGAACAGATGGAACAGCTGAATATGGGCCAAACAGGATATCTGTGGTAAGC<br>AGTTCCTGCCCCGGCTCAGGGCCAAGAACAGATGGAACAGCTGAATATGGGCCA<br>AACAGGATATCTGTGGTAAGCAGTTCCTGCCCCGGCTCAGGGCCAAGAACAGAT<br>GGTCCCCAGATGCGGTCCAGCCCTCAGCAGTTTCTAGAGAACCATCAGATGTTTC<br>CAGGGTGCCCCAAGGACCTGAAATGACCCTGTGCCTTATTTGAACTAACCAATC<br>AGTTCGCTTCTCGCTTCTGTTCGCGCGCTTCTGCTCCCCGAGCTCAATAAAAGAG<br>CCCACAACCCCTCACTCGGGGCGCCAGTCCTCCGATTGACTGAGTCGCCCGGGT<br>ACCCGTGTATCCAATAAACCCTCTTGCAGTTGCAGCGCCAGTCCTCCGATTGACT<br>GAGTCGCCCGGGTACCCGTGTATCCAATAAACCCTCTTGCAGTTGCATCCGACTT<br>GTGGTCTCGCTGTTCCTTGGGAGGGTCTCCTCTGAGTGATTGACTACCCGTCAGC<br>GGGGGTCTTTCATTTGGGGGCTCGTCCGGGATCGGGAGACCCCTGCCCAGGGAC<br>CACCGACCCACCACCGGGAGGTAAGCTGGCCAGCAACTTATCTGTGTCTGTCCG<br>ATTGTCTAGTGTCTATGACTGATTT |
| SEQ ID<br>NO: 1454 | GCGCCAGTCATCCGATAGACTGAGTCGCCCGGGTACCCGTGTTCCCAATAAAGC<br>CTTTTGCTGTTTGCATCCGAAACGTGGCCTCGCTGTTCCTTGGGAGGGTCTCCTCT<br>GAGTGATTGACTACCCGGCTCGGGGGTCTTTCATTTGGGGGCTCGTCCGGGATTT<br>GGAGACCCCCGCCCAGGGACCACCGACCCACCGTCGGGAGGTAAGCTGGCCAG<br>CGATCGTTTTGTCTCCGTCCCTGTCTTTGTGCGTGTGTGTGTGCCGGCATCTAC<br>TTTTTGCGCCTGCGTCTGAATCTGTACTAGTTAGCTAACTAGATCTGTATCTGGC<br>GGTTCCGTGGAAGAACTGACGAGTTCGTATTCCCGACCGCAGCCCTGGGAGACG<br>TCTCAGAGGCATCAGGGGCCCGCTGGGTGGCCCGATCAGTAAGTCCGAGTCCTG<br>ACCGATTCGGACTATTTGGAGCCCCTCCTTTGTCGGAGGGGGACGTGGTTCTTTT<br>AGGAGACGAGAGGTCCAAGCCCTCGCCGCCTCCATCTGAATTTTTGCTTTCGGTT<br>TTTCGCCGAAACCGCGCCGCGCGTCTTGTCTGTCTCAGTGTTGTTTTGTCATTTGT<br>CTGTTCGTTATTGTTTTGGACCGTTTCTAAAAATATGGGACAGACGTAACCACC<br>CCTCTGAGTCTGACCCTAGAACACTGGGGAGACGTCCAGCGCATCGCGTCCAAC<br>CAGTCCGTGGACGTCAAGAAGAGACGCTGGGTCACCTTCTGCTCTGCCGAGTGG<br>CCAACTTTCGGTGTAGGGTGGCCGCAAGATGGTACTTTTAATTTGGACATTATTT<br>TACAGGTTAAATCTAAGGTGTTCTCTCCCGGTCCCCACGGACACCCGGATCAGGT<br>CCCATACATTGTCACCTGGGAGGCTATTGCCTATGAACCCCCTCCGTGGGTCAAA<br>CCTTTTGTCTCTCCCAAACTCTCCCTCTCTCCAACCGCTCCCATCCTCCCATCCGG<br>TCCTTCGACCCAACCTCCGCCCCGATCTGCCCTTTACCCTGCTCTTACCCCCTCTA<br>TAAAACCCAGACCTTCTAAACCTCAGGTTCTCTCCGATAATGGCGGACCTCTCAT<br>TGACCTTCTCACAGAAGACCCTCCGCCGTACGGAGAACAGGGACCGTCCTCCTC<br>TGACGGAGATGGCGACAGAGAAGAGGCCACCTCCACTCCTGAGATTCCTGCCCC<br>CTCTCCCATGGTGTCTCGCTTGCGGGCAAAAGAGACCCCCCCCGCGGCAGTTTC<br>CACCACCTCTCGGGCTTTCCGCACTCCGTTTGGGGGGTAATGGTCAGTTGCAGTA<br>CTGGCCGGTTTTCCTCCTCGGATCTATATAACTGGAAAAATAATAACCCTTCTT<br>CTCCGAAGATCCAGGTAAATTGACTGCCTTAATCGAGTCTGTCCTCACCACCCAC<br>CAGCCTACTTGGGATGACTGTCAACAGTTGCTGGGACTCTGCTGACAGGAGAA<br>GAAAAGCAGCGGGTGCTCCTGGAAGCCAGAAAGGCAGTCCGGGGCGACGATGG<br>CCGCCCCACCCAATTGCCCAATGAGATCGAGGCTGCTTTCCCCCTCGAACGTCCC<br>GACTGGGACTACACCACCCTTAGAGGTAGGAACCACCTAGTTCTCTATCGCCAG<br>CTGCTCTTGGCGGGTCTCCAAAATGCGGGCAGGAGCCCCACCCAATTTGGCTAAG<br>GTAAAAGGAATAACCCAGGGGTCCAACGAGTCGCCCTCGGCCTTTCTAGAGAGA<br>CTCAAAGAGGCCTATCGCAGATACACTCCTTATGACCCTGAGGACCCTGGGCAA<br>GAAACCAATGTATCCATGTCGTTCATCTGGCAGTCTGCTCCAGACATTGGTCGAA<br>AGTTAGAGCGGTTAGAGACTTAAAAAATAAGACCTTAGGGGACTTAGTGAGAG<br>AAGCAGAAAGGATCTTTAATAAGAGAGAGACCCCAGAAGAGAGAAGAACGT<br>ATTAAGAGAGAAACAGAGGAAAAGAGGGAGCGCCGTAGGGCAGAGGATGAGC<br>AGAAAGAGAAAGAGAGGGACCGCAGAAGACAGAGAGAAATGAGCAAACTCTT |

TABLE 7-continued

Nucleic Acid Sequences of Vectors

| SEQ ID NO | Sequence |
|---|---|
| | GGCCACCGTAGTTACAGGTCAGAGACAGGATAGACAGGGGGGAGAGCGAAGGA
GGCCCCAACTCGATAAGGACCAATGCGCCTACTGCAAAGAAAAGGGACACTGG
GCTAGGGATTGCCCAAAGAAGCCACGGGGGCCCCGAGGACCGAGGCCCCAGAC
CTCCCTCCTGACCCTAGATGACTAGGGAGGTCAGGGTCAGGAGCCCCCCCCTGA
ACCCAGGATAACCCTTACTGTCGGGGGGCAACCAGTCACCTTCCTGGTGGATAC
TGGGGCCCAACACTCCGTGCTGACCCAGAACCCTGGACCCCTAAGTGACAGGTC
TGCCTGGGTCCAAGGGGCTACTGGAGGAAAGCGGTATCACTGGACCACAGATCG
CAAGGTGCACCTGGCTACCGGTAAGGTCACTCACTCTTTCCTCCATGTGCCGGAC
TGCCCTTATCCTTTGCTAGGAAGGGACTTGTTGACTAAGTTAAAGGCCCAGATCC
ACTTCGAGGGATCGGGAGCTCAGGTTGTGGGACCAAAAGGACAGCCCCTGCAGG
TGTTGACCCTTGGCATAGAGGATGAGTATCGGCTACATGAGACCTCAACAGAGC
CGGATGTTTCTCTAGGGTCCACCTGGCTTTCTGACTTTCCCCAGGCCTGGGCAGA
AACCGGGGCATGGGACTGGCAGTTCGCCAAGCGCCTCTGATTATACCTCTAAA
GGCAACCTCCACCCCTGTGTCCATCAAACAGTACCCCATGTCACACGAAGCCAG
ACTGGGGATCAAGCCCCACATACAGAGACTGTTGGACCAGGGAATATTGGTACC
TTGCCAGTCCCCCTGGAACACACCCCTGCTGCCCGTTAAGAAACCAGGGACTAA
TGATTACAGGCCTGTCCAGGATCTGAGAGAAGTCAACAAGCGGGTGGAAGATAT
CCACCCCACCGTGCCCAATCCTTACAACCTCTTAAGTGGACTCCCTCCGTCCCAC
CAGTGGTACACTGTGCTTGATTTAAAAGATGCCTTTTTCTGCCTGAGACTCCACC
CCACCAGTCAGCCTCTCTTTGCCTTTGAGTGGAGAGATCCAGAAATGGGAATCTC
TGGACAATTGACCTGGACCAGACTCCCACAGGGTTTCAAAAACAGTCCCACCCT
GTTTGATGAGGCATTGCACAGAGACCTAGCAGACTTCCGGATCCAGCACCCAGA
CTTGATCCTGCTACAGTACGTGGATGACTTACTGCTGGCCGCTACTTCCGAACTA
GACTGCCAACAAGGTACTCGGGCCCTTCTACAAACCCTAGGGGACCTCGGATAC
CGGGCCTCGGCCAAGAAAGCCCAAATCTGCCAGAAACAGGTTAAATACCTGGGG
TACCTTCTGAGGGAGGGTCAGAGATGGCTGACTGAGGCTAGAAAAGAGACTGTG
ATGGGGCAACCCGTTCCAAAGACTCCTCGACAACTAAGGGAGTTCCTAGGGACG
GCAGGCTTCTGCCGCCTCTGGATCCCTGGGTTTGCGGAAATGGCGGCCCCCTTGT
ATCCTCTTACCAAAACGGGGACTCTGTTTAATTGGGGCCCAGACCAGCAAAAGG
CCTATCAAGAAATCAAACAGGCCCTTCTAACTGCCCCCGCCCTGGGATTGCCAG
ATTTGACTAAGCCCTTTGAACTCTTTGTCGACGAGAAGCAGGGCTACGCCAAAG
GCGTCCTAACGCAAAAACTGGGACCTTGGCGTCGGCCTGTGCCTACCTGTCCA
AAAAGCTAGACCCAGTGGCAGCCGGGTGGCCCCCTTGCCTACGGATGGTAGCAG
CCATTGCCGTTCTGACAAAAGATGCAGGCAAGCTAACTATGGGACAGCCGCTAG
TCATCCTGGCCCCCCATGCAGTAGAGGCACTGGTCAAGCAACCCCCTGACCGCT
GGCTATCCAACGCCCGCATGACCCACTACCAGGCAATGCTCCTAGACACTGACC
GAGTTCAGTTCGGACCAGTGGTGGCCCTCAATCCTGCCACCTTGCTCCCTCTACC
GGAAAAAGGAGCCCCCCATGATTGCCTCGAGATCTTGGCTGAAACGCATGGAAC
CAGACCGGATCTCACCGACCAGCCCATCCCAGACGCCGACCACACCTGGTATAC
CGATGGGAGCAGCTTTCTGCAAGAAGGACAGCGAAAGGCTGGGGCAGCAGTGA
CGACTGAAACCGAGGTAATCTGGGCGAGGGCCCTGCCAGCTGGAACGTCAGCCC
AGCGAGCCGAACTGATCGCACTCACCCAAGCCCTGAAAATGCAGAAGGTAAG
AAGCTAAATGTTTACACTGATAGCCGCTATGCCTTCGCTACGGCCCATGTTCATG
GGGAAATATATAGGAGACGGGGGTTGCTGACCTCAGAAGGCAAGGAAATCAAG
AACAAAAGCGAGATCCTAGCCTTGCTGAAAGCCCTCTTTTTGCCAAAGAGACTC
AGTATTATCCATTGCCCAGGACATCAGAAAGGAGACAGTGCCGAAGCCAGAGGC
AACCGTATGGCAGACCAGGCGGCCCGAGAGGCAGCCACAAAAACAGTTCCAGA
AGCCTCTACACTCCTTATAGAGGACTCGACCCCGTACACGCCTGCCTATCTCCAT
TACACCGAAACAGATCTAAAAAGATTGCGAGAACTGGGGGCCACCTATAATCAG
ATAAAAGGATATTGGGTCCTACAAGGCAAGCCGGTGATGCCCGATCAGTTTGTG
TTTGAATTATTAGACTCCCTTCATAGACTCACCCATCTCAGCCCTCAAAAGATGA
AGGCGCTCCTTGACAGAGAAGAAAGCCCCTACTACATGTTAAACAGGGACAGAA
CTCTTCAGTATGTGGCAGAATCCTGCACAGTCTGTGCTCAAGTAAATGCTAGTAA
AGCCAAAATCGGGGCAGGGGTACGAGTACGCGGGACATCGACCAGTACCCATT
GGGAAATTGACTTCACTGAAGTTAAACCAGGGCTGTACGGGTACAAGTACCTCC
TGGTGTTCGTAGACACCTTCTCTGGCTGGGTGGAAGCCTTCCCAACTAAACGTGA
AACTGCCAAGGTTGTGACCAAGAAGCTATTAGAAGAAATATTCCCAAGATTCGG
GATGCCACAGGTATTGGGTTCCGATAATGGGCCTGCCTTCGTCTCCCAGGTAAGT
CAGTCGGTGGCCGATTTACTGGGGATCGATTGGAAATTACATTGTGCTTATAGAC
CCCAGAGTTCAGGTCAGGTAGAAAGAATGAATAGAACCATCAAGGAGACTCTA
ACTAAATTAAACCTTGCAGCTGGCACTAGAGACTGGGTACTCCTACTCCCCTTAG
CCCTCTACCGAGCCCGGAACACTCCGGGCCCCATGGACTGACTCCGTATGAAA
TTCTGTATGGGCACCCCCGCCCTTGTCAATTTTCATGATCCTGAAATGTCAAA
GTTAACTAATAGTCCCTCTCTCCAAGCTCACTTACAGGCCCTCCAAGCAGTACAA
CGAGAGGTCTGGAAGCCGCTGGCCGCTGCTTATCAGGACCAGCTAGATCAGCCA
GTGATACCACACCCCTTCCGTGTCGGTGACGCCGTGTGGTACGCCGGCACCAG
ACTAAGAACTTGGAACCTCGCTGGAAAGGACCCTACACCGTCCTGCTGACCACC
CCCACCGCTCTCAAAGTTGACGGCATCTCTGCGTGGATACACGCCGCTCACGTAA
AGGCGGCGACAACTCCTCCGGCCGGAGCAGCATGGAAGGTCCAGCGTTCTCAAA
ACCCCTTAAAGATAAGATTAACCCGTGGGCCCCCTAATAGTTATAGGGATCTT
GGTGAGGGCAGGAGCCTCGGTACAACGTGACAGCCCTCACCAGGTCTTCAATGT
CACTTGGAGAGTTACCAACCTAATGACAGGACAAAACAGTAACGCTACCTCCCT
CCTGGGGACGATGACAGACACCTTCCCTAAACTATATTTTGACTTGTGTGATTTA
GTTGGAGACCATTGGGATGACCCAGAACCCGATATTGGAGATGGTTGCCGCTCT
CCGGGGGGAAGAAAAAGGACAAGACTGTATGACTTCTATGTTTGCCCCGGTCAT
ACTGTACCAATAGGGTGTGGAGGGCCGGGAGAGGGCTACTGTGGCAAATGGGG |

TABLE 7-continued

Nucleic Acid Sequences of Vectors

| SEQ ID NO | Sequence |
|---|---|
| | ATGTGAGACCACTGGACAGGCATACTGGAAGCCATCATCATCATGGGACCTAAT<br>TTCCCTTAAGCGAGGAAACACTCCTAAGGATCAGGGCCCCTGTTATGATTCCTCG<br>GTCTCCAGTGGCGTCCAGGGTGCCACACCGGGGGGTCGATGCAACCCCCTAGTC<br>TTAGAATTCACTGACGCGGGTAAAAAGGCCAGCTGGGATGCCCCCAAAGTTTGG<br>GGACTAAGACTCTACCGATCCACGGGGGCCGACCCGGTGACCCGGTTCTCTTTG<br>ACCCGCCAGGTCCTCAATGTAGGACCCCGCGTCCCCATTGGGCCTAATCCCGTGA<br>TCACTGAACAGCTACCCCCCTCCCAACCCGTGCAGATCATGCTCCCCAGGCCTCC<br>TCATCCTCCTCCTTCAGGCGCGGCCTCTATGGTGCCTGGGGCTCCCCCGCCTTCTC<br>AACAACCTGGGACGGGGGACAGGCTGCTAAACCTAGTAAAAGGAGCCTATCAA<br>GCACTCAACCTCACCAGTCCCGACAGAACCCAAGGGTGCTGGCTGTGTCTGGTA<br>TCGGGACCCCCTACTACGAAGGGGTTGCCGTCCTAGGTACCTACTCCAACCATA<br>CCTCTGCCCCAGCTAACTGCTCCGTGGCCTCCCAACACAAGCTGACCCTGTCCGA<br>AGTGACCGGGCAGGGACTCTGCGTAGGAGCAGTTCCCAAAACCCATCAGGCCCT<br>GTGTAATACCACCCAGAAGGCGAGCGACGGGTCCTACTATCTGGCTGCTCCCGC<br>CGGGACCATCTGGGCTTGCAACACCGGGCTCACTCCCTGCCTATCTACCACTGTA<br>CTCAACCTCACCACCGATTACTGTGTCCTGGTTGAGCTCTGGCCAAAGGTGACCT<br>ACCACTCCCCTGGTTATGTTTATGACCAGTTTGAGAGAAAAACCAATATAAAA<br>GAGAGCCGGTGTCATTAACTCTGGCCCTGCTGTTGGGAGGACTTACTATGGGCG<br>GCATAGCTGCAGGAGTAGGAACAGGGACTACAGCCCTAGTGGCCACCAAACAA<br>TTCGAGCAGCTCCAGGCAGCCATACATACAGACCTTGGGGCCTTAGAAAAATCA<br>GTCAGTGCCCTAGAAAAGTCTCTGACCTCGTTGTCTGAGGTGGTCCTACAGAACC<br>GGAGAGGATTAGATCTGCTGTTCCTAAAAGAAGGAGGATTATGTGCTGCCCTAA<br>AAGAAGAATGCTGTTTCTATGCAGACCACACTGGCGTAGTAAGGGATAGCATGG<br>CTAAGCTAAGAGAAAGGCTAAACCAGAGGCAAAAATTGTTCGAATCAGGACAA<br>GGGTGGTTTGAGGGACTGTTTAACAGGTCCCCATGGTTCACGACCCTGATATCCA<br>CCATTATGGGCCCTCTGATAGTACTTTTATTAATCCTACTCCTCGGACCCTGCATT<br>CTCAACCGCTTGGTCCAGTTTGTAAAAGACAGAATTTCGGTGGTGCAGGCCCTG<br>GTTCTGACCCAACAGTATCACCAACTCAAATCAATAGATCCAGAAGAAGTAGAA<br>TCGCGTGAATAAAAGATTTTATTCAGTTTCCAGAAAGAGGGGGGAATGAAAGAC<br>CCCACCATAAGGCTTAGCAAGCTAGCTGCAGTAACGCCATTTTGCAAGGCATGA<br>AAAGTACCAGAGCTGAGTTCTCAAAAGTCACAAGGAAGTTTAGTTAAAGAATA<br>AGGCTGAACAAAACTGGGACAGGGGCCAAACAGGATATCTGTGGTCGAGCACC<br>TGGGCCCCGGCTCAGGGCCAAGAACAGATGGTACTCAGATAAAGCGAAACTAG<br>CAACAGTTTCTGGAAAGTCCCACCTCAGTTTCAAGTTCCCCAAAAGACCGGGAA<br>AAACCCCAAGCCTTATTTAAACTAACCAATCAGCTCGCTTCTCGCTTCTGTTAAC<br>GCGCTTTTTGCTCCCCAGCCCTATAAAAGAGGGTAAAACCCCACACTCGGT |
| SEQ ID<br>NO: 1455 | TGTGGTGGAATGCCACTAGAAACCAGGGAAAACAAGGAGGAGAGTATTACAGG<br>GAAGGAGGTGAAGAACCTCATTACCCAAATACTCCTGCTCCTCATAGACGTACC<br>TGGGATGAGAGACACAAGGTTCTTAAATTGTCCTCATTCGCTACTCCCTCTGACA<br>TCCAACGCTGGGCTACTAAAGCATTGCCTTATGGCTGGAAAGTGGTCACCGAAA<br>GCGGAAATGATTATACTAGCCGCAGAAAGATCAGAACATTGACAGAGATGACTC<br>AGGATGAAATTAGAAAAAGGTGGGAAAGTGGATATTGTGACCCCTTCATTGACT<br>CAGGAAGTGACTCAGATGGACCCTTCTAAAAGCCACAGACAGTAAAAATGTGTT<br>AGCACTTTATACAATATTATATCTGCTTAAGCTATAGAAGCTTTCACATACTCAG<br>TAGCTGTTTCACAATCAACAAAACAATGATGATGTAATCATAAGGAAGTAGTTT<br>AAAATAGGTTAATAAGTTTATTAGTTATATAGAAAATAATATAGGATAAAGTAT<br>AAGGATTAAGGTATGAGGTGTGTGGCTCAACACGTAGGGTGACAAGAAAATCTA<br>CTGTAATAGGACACAACACCTCTAAAGTTGCCCGTGGGAAGGTGAAGTGAGATC<br>GAATCTTTCCTTAACGCAGACAGCTTTTTATCCACTAGGGATAATGTTTTAAGGA<br>ATACTATAGTAATAGATTGATAGTTTTAACAATGATGGAAATAGTATATAAGGA<br>TAGTTTCTAGATTGTACGGGAGCTCTCTTCACTACTCGCTGCGTCGAGAGTGTAC<br>GAGACTCTCCAGGTTTGGTAAGAAATATTTTATATTGTTATAATGTTACTATGAT<br>CCATTAACACTCTGCTTATAGATTGTAAGGGTGATTGCAATGCTTTCTGCATAAA<br>ACTTTGGTTTTCTTGTTAATCAATAAACCGACTTGATTCGAGAACCTACTCATAT<br>ATTATTGTCTCTTTTATACTTTATTAAGTAAAAGGATTTGTATATTAGCCTTGCTA<br>AGGGAGACATCTAGTGATATAAGTGTGAACTACACTTATCTTAAATGATGTAAC<br>TCCTTAGGATAATCAATATACAAAATTCCATGACAATTGGCGCCCAACGTGGGG<br>CTCGAATATAAGTCGGGTTTATTTGTAAATTATCCCTAGGGACCTCCGAGCATAG<br>CGGGAGGCATATAAAAGCCAATAGACAATGGCTTCAGGAAGTAATGTTGAAGA<br>ATATGAACTTGATGTTGAAGCTCTGGTTGTAATTTTAAGAGATAGAAATATACCA<br>AGAAATCCTTTACATGGAGAAGTTATAGGTCTTCGCCTTACTGAAGGATGGTGG<br>GGACAAATTGAGAGATTTCAGATGGTACGTCTAATATTACAAAATGATGATAAT<br>GAACCTTTACAGAGACCTAGATATGAGGTAATACAACGAGCTGTAAACCCTCAT<br>ACAATGTTTATGATATCAGGACCATTAGCTGAACTTCAATTAGCCTTTCAGGATT<br>TAGATTTACCTGAAGGTCCATTGAGGTTTGGTCCATTGGCAAATGGACATTATGT<br>TCAAGGAGATCCTTATAGTAGTTCTTACAGACCAGTAACAATGGCCGAAACAGC<br>CCAAATGACTAGAGATGAACTGGAAGATGTTCTTAATACTCAAAGTGAAATAGA<br>AATTCAAATGATAAATTTATTGGAGTTGTATGAAGTTGAAACTAGAGCTCTTAGA<br>AGACAATTAGCTGAGAGATCTAGTACAGGGCAAGGAGGAATATCCCCAGGAGC<br>TCCTCGTTCTCGACCACCAGTAAGCAGCTTCTCAGGGTTACCAAGTTTGCCCTCT<br>ATACCTGGGATTCATCCCAGGGCACCTTCACCTCCAAGGGCAACTTCTACTCCGG<br>GAAATATTCCTTGGAGTTTAGGAGATGATAACCCACCTTCATCTAGTTTTCCTGG<br>ACCCTCTCAACCTCGTGTTTCTTTCCATCCGGGAAATCCTTTTGTTGAAGAAGAA<br>GGTCATAGACCTAGATCCCAGTCTAGAGAAAGGAGAAGAGAAATTCTTCCTGCT<br>CCTGTACCGTCAGCACCTCCTATGATTCAGTATATACCAGTACCACCTCCACCAC |

TABLE 7-continued

Nucleic Acid Sequences of Vectors

SEQ ID NO Sequence

CGATTGGCACGGTTATACCTATTCAGCATATCAGATCTGTAACTGGAGAGCCTCC
TAGAAACCCAAGAGAAATACCAATTTGGCTAGGACGAAATGCTCCTGCTATAGA
TGGAGTGTTCCCTGTTACAACACCGGATCTAAGATGCAGAATAATTAATGCTATA
CTAGGAGGAAATATTGGGCTATCATTAACCCCTGGAGACTGTTTAACATGGGAC
TCAGCAGTAGCCACCTTATTTATTAGAACCCATGGAACTTTTCCAATGCATCAGC
TTGGAAATGTAATAAAAGGCATAGTTGATCAAGAAGGAGTGGCAACAGCATATA
CTTTGGGAATGATGCTTTCTGGACAAAATTATCAATTAGTTTCTGGAATAATTAG
AGGATATTTGCCTGGACAAGCTGTAGTAACTGCATTACAACAGCGTTTAGACCA
AGAAATAGATGATCAAACAAGAGCAGAGACTTTTATTCAACATCTAAATGCTGT
ATATGAAATTTTAGGCCTTAATGCCAGAGGACAAAGTATACGTGCTTCAGTGAC
TCCTCAACCCCGACCATCCAGAGGTAGAGGTCGAGGTCAAAATACTTCTAGACC
CTCTCAAGGACCAGCTAATAGCGGGCGGGGACGACAGCGCCCTGCTTCTGGTCA
AAGCAACAGAGGATCTAGTACTCAGAATCAAAATCAAGATAATTTAAATCAAGG
AGGATATAATCTTCGACCCCGTACTTACCAACCTCAAAGGTACGGAGGAGGACG
TGGACGAAGATGGAACGATAATACTAACAATCAAGAGTCCAGACCATCAGATCA
AGGTTCTCAAACTCCTAGGCCAAATCAAGCAGGCTCTGGGGTGCGTGGCAATCA
GTCACAAACTCCCAGACCAGCTGCTGGTCGCGGAGGAAGAGGTAACCACAACCG
AAACCAACGATCATCCGGTGCTGGTGACTCACGCGCTGTCAATACCGTGACACA
GAGTGCCACGTCCTCCACAGATGAATCCTCTTCAGCTGTTACAGCCGCTTCCGGC
GGAGATCAAAGGGACTAAATTGTTAGCCCACTGGGATTCAGGGGCAACAATAAC
TTGTATTCCTGAAAGTTTTTTAGAAGATGAACAACCTATTAAAAAGACTTTAATA
AAAACAATTCATGGAGAAAAACAACAAAATGTTTATTATGTAACCTTTAAAGTT
AAAGGAAGAAAAGTGGAAGCAGAAGTGATAGCTTCTCCTTATGAGTATATTTTG
CTGTCGCCAACAGATGTTCCTTGGTTAACACAGCAACCACTTCAGTTAACAATTT
TAGTTCCTCTTCAAGAATATCAAGAGAAAATCTTAAGTAAGACTGCTCTTCCAGA
AGATCAAAAACAACAATTAAAAACCTTGTTTGTCAAGTATGACAATCTATGGCA
ACATTGGGAAAATCAAGTCGGGCATAGAAAAATTAGGCCACATAATATAGCAAC
TGGTGATTATCCTCCTCGCCCTCAAAAACAATATCCTATTAATCCTAAGGCAAAG
CCTAGTATACAAATTGTAATAGATGACTTATTGAAACAAGGGGTGTTAACGCCT
CAAAATAGTACAATGAATACACCAGTGTATCCTGTTCCTAAACCAGATGGAAGG
TGGAGAATGGTATTAGATTATAGAAGTAAATAAAACTATTCCATTAACAGCT
GCCCAAAACCAACACTCTGCTGGTATTTTAGCTACTATTGTTAGACAAAAATATA
AAACTACCTTAGATTTAGCTAATGGATTTTGGGCTCATCCTATTACACCAGAATC
TTATTGGTTAACAGCATTTACCTGGCAAGGTAAACAGTATTGTTGGACACGTCTT
CCTCAAGGATTTTTAAATAGTCCAGCATTGTTTACAGCTGATGTAGTAGATTTAC
TAAAAGAAATCCCTAATGTACAAGTGTATGTTGATGATATATATTTAAGCCATGA
TGATCCTAAAGAGCATGTTCAACAATTAGAAAAAGTGTTTCAAATTTTACTACAG
GCAGGATATGTAGTATCTTTGAAAAAATCAGAAATTGGTCAAAAAACTGTAGAA
TTTTTAGGATTTAATATTACTAAAGAAGGTCGTGGCCTAACAGACACTTTTAAAA
CAAAACTGTTAAATATTACTCCTCCAAAAGACTTAAAGCAATTACAAAGCATAT
TAGGATTGTTAAATTTTGCTAGAAATTTTATACCTAATTTTGCTGAACTGGTACA
ACCATTATACAATTTAATAGCCTCAGCAAAAGGCAAATATATTGAGTGGTCTGA
AGAAAATACTAAACAATTAAATATGGTAATAGAAGCATTAAACACTGCCTCTAA
TTTAGAAGAAAGGTTACCAGAACAGAGACTGGTAATTAAAGTCAATACTTCTCC
ATCAGCAGGATATGTAAGATATTATAATGAGACTGGTAAAAAGCCTATTATGTA
CCTAAATTATGTGTTTTCCAAAGCAGAATTAAAATTTTCTATGTTAGAAAAACTA
TTAACTACAATGCACAAAGCCTTAATTAAGGCTATGGATTTGGCCATGGGACAA
GAAATATTAGTTTATAGTCCCATTGTATCTATGACTAAAATACAAAAAACTCCAC
TACCAGAAAGAAAAGCTTTACCCATTAGATGGATAACATGGATGACTTATTTAG
AAGATCCAAGAATCCAATTTCATTATGATAAAACCTTACCAGAACTTAAGCATA
TTCCAGATGTATATACATCTAGTCAGTCTCCTGTTAAACATCCTTCTCAATATGA
AGGAGTGTTTTATACTGATGGCTCGGCCATCAAAAGTCCTGATCCTACAAAAAG
CAATAATGCTGGCATGGGAATAGTACATGCCACATACAAACCTGAATATCAAGT
TTTGAATCAATGGTCAATACCACTAGGTAATCATACTGCTCAGATGGCTGAAATA
GCTGCAGTTGAATTTGCCTGTAAAAAAGCTTTAAAAATACCTGGTCCTGTATTAG
TTATAACTGATAGTTTCTATGTAGCAGAAAGTGCTAATAAAGAATTACCATACTG
GAAATCTAATGGGTTTGTTAATAATAAGAAAAAGCCTCTTAAACATATCTCCAA
ATGGAAGTCTATTGCTGAGTGTTTATCTATGAAACCAGACATTACTATTCAACAT
GAAAAAGGGCATCAGCCTACAAATACCAGTATTCATACTGAAGGCAATGCCCTA
GCAGATAAGCTTGCCACCCAAGGAAGTTATGTAGTTAATTGTAATACCAAAAAA
CCAAACCTGGATGCAGAGTTGGATCAATTATTACAGGGTCATTATATAAAAGGA
TATCCCAAACAATATACATATTTTTAGAAGATGGCAAAGTAAAAGTTTCCAGA
CCTGAAGGGGTTAAAATTATTCCCCCTCAGTCAGACAGACAAAAAATTGTGCTT
CAAGCCCACAATTTGGCTCACACCGGACGTGAAGCCACTCTTTTAAAAATTGCC
AACCTTTATTGGTGGCCAAATATGAGAAAGGATGTGGTTAAACAACTAGGACGC
TGTCAACAGTGTTTAATCACAAATGCTTCCAACAAAGCCTCTGGTCCTATTCTAA
GACCAGATAGGCCTCAAAAACCTTTTGATAAATTCTTTATTGACTATATTGGACC
TTTGCCACCTTCACAGGGATACCTATATGTATTAGTAGTTGTTGATGGAATGACA
GGATTCACTTGGTTATACCCCACTAAGGCTCCTTCTACTAGCGCAACTGTTAAAT
CTCTCAATGTACTCACTAGTATTGCAATTCCAAAGGTGATTCACTCTGATCAAGG
TGCAGCATTCACTTCTTCAACCTTTGCTGAATGGGCAAAGGAAAGAGGTATACA
TTTGGAATTCAGTACTCCTTATCACCCCCAAAGTAGTGGTAAGGTGGAAAGGAA
AAATAGTGATATAAAACGACTTTTAACTAAACTGCTAGTAGGAAGACCCACAAA
GTGGTATGACCTATTGCCTGTTGTACAACTTGCTTTAAACAACACCTATAGCCCT
GTATTAAAAATATACTCCACATCAACTCTTATTTGGTATAGATTCAAATACTCCAT
TTGCAAATCAAGATACACTTGACTTGACCAGAGAAGAAGAACTTTCTCTTTTACA

TABLE 7-continued

Nucleic Acid Sequences of Vectors

SEQ ID NO Sequence

```
GGAAATTCGTACTTCTTTATACCATCCATCCACCCCTCCAGCCTCCTCTCGTTCCT
GGTCTCCTGTTGTTGGCCAATTGGTCCAGGAGAGGGTGGCTAGGCCTGCTTCTTT
GAGACCTCGTTGGCATAAACCGTCTACTGTACTTAAGGTGTTGAATCCAAGGACT
GTTGTTATTTTGGACCATCTTGGCAACAACAGAACTGTAAGTATAGATAATTTAA
AACCTACTTCTCATCAGAATGGCACCACCAATGACACTGCAACAATGGATCATTT
GGAACAAATGAATAAAGCGCATGAGGCACTTCAGAATACAACAACTGTGACT
GAACAGCAGAAGGAACAAATTATACTGGACATTCAAAATGAAGAAGTACAACC
AACTAGGAGAGATAAATTTAGATATCTGCTTTATACTTGTTGTGCTACTAGCTCA
AGAGTATTGGCCTGGATATTTTTAGTTTGTATATTGTTAATCATTGTTTTGGTTTC
ATGCTTTGTGACTATATCCAGAATACAATGGAATAAGGATATTCAGGTATTAGG
ACCTGTAATAGACTGGAATGTTACTCAAAGAGCTGTTTATCAACCCTTACAGACT
AGAAGGATTGCACGTTCCCTTAGAATGCAGCATCCTGTTCCAAAATATGTGGAG
GTAAATATGACTAGTATTCCACAAGGTGTATACTATGAACCCCATCCGGAACCC
ATAGTGGTGAAGGAGAGGGTCCTGGGTCTTTCTCAAATTCTGATGATTAATTCAG
AAAACATTGCTAATAATGCTAATTTGACACAAGAAGTAAAGAAGTTGTTAACTG
AAATGGTTAATGAAGAAATGCAAAGTTTGTCAGATGTAATGATTGACTTTGAAA
TTCCTTTAGGAGACCCTCGTGATCAAGAACAATATATACATAGAAAATGCTATC
AAGAATTTGCAAATTGTTATTTAGTAAAATATAAAGAACCCAAACCGTGGCCTA
AGGAGGGCCTTATAGCTGATCAATGCCCATTACCAGGTTACCATGCTGGATTAA
CCTATAATAGACAGTCTATTTGGGATTACTATATTAAAGTGGAGAGTATTAGACC
TGCAAATTGGACAACAAAGAGTAAATATGGACAAGCTAGACTAGGAAGTTTTTA
TATTCCTAGCAGTCTGAGACAAATCAATGTTAGTCATGTACTATTCTGTAGTGAT
CAATTATATTCTAAATGGTATAATATAGAAAAATACCATAGAACAAAACGAGCGG
TTTCTGCTTAATAAACTAAATAACCTTACATCTGGAACCTCAGTATTGAAGAAA
GAGCTCTTCCGAAGGATTGGAGTTCTCAAGGTAAAAATGCTCTGTTTAGAGAAA
TCAATGTGTTAGATATCTGCAGTAAACCTGAATCTGTAATACTATTGAATACTTC
ATACTATTCCTTCTCTTTATGGGAAGGAGATTGTAATTTTACTAAAGATATGATT
TCTCAGTTGGTTCCAGAATGTGATGGATTTTATAACAATTCTAAGTGGATGCATA
TGCATCCATATGCTTGTAGATTCTGGAGAAGTAAGAATGAAAAAGAAGAAACTA
AATGTAGAGATGGGGAAACTAAGAGATGTCTGTATTATCCTTTATGGGACAGTC
CCGAATCTACATATGATTTTGGTTATTTAGCATACCAAAAGAATTTTCCTTCCCCT
ATCTGTATAGAACAACAGAAAATTAGAGATCAAGATTATGAAGTTTATTCTTTGT
ATCAAGAATGCAAAATAGCTTCTAAAGCATATGGAATTGATACAGTTTTATTCTC
TCTAAAGAATTTTCTTAATTATACAGGAACTCCTGTAAATGAAATGCCTAATGCA
AGAGCTTTTGTAGGCCTAATAGATCCCAAGTTTCCTCCTTCCTATCCCAATGTTA
CTAGGGAACATTATACTTCCTGTAATAATAGGAAAAGAAGAAGTGTTGATAATA
ACTATGCTAAGTTAAGGTCTATGGGGTATGCACTTACAGGAGCAGTGCAAACCT
TATCTCAAATATCAGATATTAATGATGAAAACTTACAGCAAGGAATATATTTATT
AAGGGATCATGTAATAACCTTAATGGAAGCTACATTGCATGATATATCTGTTATG
GAAGGAATGTTTGCTGTACAACATTTGCATACACATTTGAATCATTTGAAGACAA
TGCTTCTAGAAAGAAGAATAGACTGGACCTATATGTCTAGTACTTGGCTACAAC
AACAATTACAGAAATCTGATGATGAGATGAAAGTAATAAAGAGAATTGCTAGA
AGTTTGGTATATTATGTTAAACAAACCCATAGTTCTCCCACAGCTACAGCCTGGG
AGATTGGATTATATTATGAATTGGTTATACCTAAACATATTTACTTGAATAATTG
GAATGTTGTCAATATAGGTCACTTAGTTAAATCAGCTGGACAATTGACTCATGTA
ACTATAGCTCATCCTTATGAAATAATCAATAAGGAATGTGTAGAGACTATATATC
TGCATCTTGAAGACTGCACAAGACAAGATTATGTCATATGTGATGTGGTAAAGA
TAGTGCAGCCTTGTGGCAATAGCTCAGACACGAGTGATTGTCCTGTCTGGGCTGA
AGCTGTAAAAGAACCATTTGTGCAAGTCAATCCTCTGAAAAACGGAAGTTATCT
GGTTTTGGCAAGTTCCACAGACTGTCAGATCCCACCTATATGTTTCCTAGCATCGTG
ACTGTTAATGAAACAACGTCATGCTTTGGACTGGACTTTAAAAGGCCACTGGTTG
CGGAAGAAAGATTGAGCTTTGAGCCACGACTGCCAAATCTACAACTAAGATTAC
CACATTTGGTTGGAATTATTGCAAAAATCAAAGGGATAAAAATAGAAGTCACAT
CCTCTGGAGAAAGTATAAAAGAGCAGATTGAAAGAGCAAAAGCTGAGCTCCTTC
GACTGGACATTCACGAGGGAGATACTCCTGCCTGGATACAACAGCTAGCTGCAG
CAACAAAGGACGTCTGGCCAGCAGCAGCTTCTGCTCTACAAGGAATTGGTAACT
TTTTATCTGGGACTGCCCAAGGAATATTTGGAACTGCCTTTAGTCTCTTGGGATA
CTTAAAGCCTATCCTAATAGGAGTAGGGGTCATTCTCTTGGTTATTCTTATATTTA
AGATTGTATCATGGATTCCTACGAAAAAGAAGAATCAGTAGCCTCCACCTCTGG
AATTCAGGACCTGCAGACTCTGAGTGAGCTTGTTGGCCCTGAAAATGCCGGAGA
GGGAGAGCTGACTATTGCTGAGGAACCTGAAGAAAATCCTCGACGCCCCAGACG
ATATACCAAAAGAGAAGTCAAATGTGTGTCTTATCATGCATATAAAGAAATTGA
GGACAAACATCCTCAACATATTTAAACTGCAGGATTGGATCCCCACACCAGAGGA
AATGAGTAAGTCACTCTGTAAAAGACTTATTTTATGTGGATTGTATAGTGCAGAA
AAGGCCTCAGAGATTTTAAGGATGCCTTTTACAGTTTCTTGGGAACAATCAGATA
CTGACCCTGACTGTTTTATTGTAAGCTATACATGTATATTTTGTGATGCTGTAATA
CATGATCCCATGCCCATAAGATGGGATCCTGAAGTTGGAATTTGGGTAAAATAT
AAACCCCTCAGAGGAATTGTTGGATCTGCTGTGTTTATTATGCATAAACATCAAA
GAAACTGTTCTCTTGTTAAACCTTCTACCAGTTGCTCAGAAGGTCCAAAACCAAG
ACCTAGGCACGATCCTGTCCTTCGATGTGACATGTTTGAAAGCATCACAAGCCT
CGGCAGAAACGACCCAGGAGACGATCCATCGATAATGAGTCATGTGCTTCCAGT
AGTGACACCATGGCCAATGAGCCAGGATCACTATGCACCAACCCTCTTTGGAAT
CCTGGACCGCTACTATCAGGGCTACTTGAAGAGTCCAGCAACCTACCAAACTTG
GAAGTTCACATGTCAGGTGGACCCTTCTGGGAAGAGGTTTATGGGGACTCAATT
TTGGGTCCCCCCTCTGGGTCAGGTGAACATTCAGTTTTATAAGAATTATCAGATT
CTAACTTGCTGTCAGGCTGTAGACCCATTTGCTAATATTTTTCATGGTACTGATG
```

TABLE 7-continued

Nucleic Acid Sequences of Vectors

| SEQ ID NO | Sequence |
|---|---|
| | AAGAAATGTTTGACATTGATTCAGGTCCTGATGTTTGGTGTTCTCCCTCTTTGTGT
TTCAAGGTAATTTATGAAGGGGCAATGGGCCAAAAGCAAGAACAAAAAACCTG
GCTGTGCAGACTAGGACATGGTCATCGTATGGGAGCATGCGATTACCGTAAAGT
AGATCTGTATGCAATGAGACAAGGAAAAGAAAACCCTTATGGAGATAGGGGTG
ATGCAGCTTTGCAATATGCTTATCAGGTTAAAAGGGGCTGTAAAGCAGGGTGCT
TGGCATCACCTGTACTTAACTACAAAGCTTTGCAGTTTCATAGAACCATTATGGC
AGACTTCACCAATCCTAGGATTGGAAAAGGACATCTTGCTCATGGATACCAAGC
AGCTATGGAAGCTTATGGACCTCAAAGAGGAAGAAACGAGGAGAGGGTGTGGT
GGAATGCCACTAGAAACCAGGGAAAACAAGGAGGAGAGTATTACAGGGAAGGA
GGTGAAGAACCTCATTACCCAAATACTCCTGCTCCTCATAGACGTACCTGGGATG
AGAGACACAAGGTTCTTAAATTGTCCTCATTCGCTACTCCCTCTGACATCCAACG
CTGGGCTACTAAAGCATTGCCTTATGGCTGGAAAGTGGTCACCGAAAGCGGAAA
TGATTATACTAGCCGCAGAAAGATCAGAACATTGACAGAGATGACTCAGGATGA
AATTAGAAAAAGGTGGGAAAGTGGATATTGTGACCCCTTCATTGACTCAGGAAG
TGACTCAGATGGACCCTTCTAAAAGCCACAGACAGTAAAAATGTGTTAGCACTT
TATACAATATTATATCTGCTTAAGCTATAGAAGCTTTCACATACTCAGTAGCTGT
TTCACAATCAACAAAACAATGATGATGTAATCATAAGGAAGTAGTTTAAAATAG
GTTAAGTAAGTTTATTAGTTATATAGAAAATAATATAGGATAAGGTATAAGGAT
TAAGGTATGAGGTGTGTGGCTCAACACGTAGGGTGACAAGAAATCTACTGTAA
TAGGACACAACACCTCTAAAGTTGCCCGTGGGAAGGTGAAGTGAGATCGAATCT
TTCCTTAACGCAGACAGCTTTTTATCCACTAGGGATAATGTTTTAAGGAATACTA
TAGTAATAGATTGATAGTTTTAACAATGATGGAAATAGTATATAAGGATAGTTTC
TAGATTGTACGGGAGCTCTCTTCACTACTCGCTGCGTCGAGAGTGTACGAGACTC
TCCAGGTTTGGTAAGAAATATTTTATATTGTTATAATGTTACTATGATCCATTAA
CACTCTGCTTATAGATTGTAAGGGTGATTGCAATGCTTTCTGCATAAAACTTTGG
TTTTCTTGTTAATCAATAAACCGACTTGATTCGAGAACCTACTCATATATTATTGT
CTCTTTTATACTTTATTAAGTAAAAGGATTTGTATATTAGCCTTGCTAAGGGAGA
CATCTAGTGATATAAGTGTGAACTACACTTATCTTAAATGATGTAACTCCTTAGG
ATAATCAATATACAAAATTCCATGACA |
| SEQ ID NO: 1456 | TGTGGCAGGCAGCCACTAAATGTATTGGTCCTGGTGAGGGAGATTATTGGTGTG
AGTATGATCACCGTGGGTATTTCCCTATTATACCTAACAAGCTATCTCCTACGTG
GGTGAGACATGCTGCCCCCTATGGTATACAAAGGCTCGCAACACCATATGATCT
CCAGATGTTTGCAAATGAGTTATTGCCACCTGGTTACAGTATTAATACTCCCAGT
GGAACTTGCTATGTGAGCAATCGCAGGCTTCACTATGGAAATGAAGGAACTCTT
CAGGAGTATCAAGAGAACTGTGACAGAATTAAAAGAGGATATGAGGATATTTCC
TCTAGTGATTCTTCAGATGAGGATTAGGGGAAGTTTACCCAGCAACTGCTTATGC
TTGCTTATGATTCATGCCTTTGTTTAGGATAAGAATGTATTTAACCATAGTTAATC
CTTAGGAAGCATTTGGTAAATTCTACTAAGCAAACCTGTTCATTTACTACCGTGC
TTCCGATGGAGAACTTAGGGACGAGGCTGTGAGTTCGATATCATCCTCATCTCGA
GTGTCTCCCTTTTGCTTTTATAGTAATTAGAAATTATGCAATAGGTATAAGTATA
AAATAATAATAAGATAATCCTAAGGGAGGGAGTGGAACGTCCTGATAGAAAAC
AGGCATGACGCTCTCCCATCCCTCCTTTTCATATGTTCAAATCTAAGGTAATATT
ATTGATTCCTTGCCAGCTGTTAGCATAGAAATTAAATAAAACAGGAAACCACAA
GTAGGTGAAGGCTAGCTCACTGAATAAATTGACTAGTCTTTGCTCAAGAACCCA
GGGAGCAATGTTGTATGTTCAAATCTCAATAATGCATCCTGGTCGTTCTTTATGA
AGTTATGTCATTGTAAACAAAATATGAAAGTTAGAAATGACTGTCCAAAAAGCC
ACAAAGGGAAATAGCTAATGTGCAAAGTATTAGTCTTGTACTTGGCCGTTCTCCT
TTGGTATTCAAGTTCAAATCCTGTAAGCAGTATTACAGCTGATGTAATGTTAAGT
AATAACTTGTTTTCTATATGAGTGTAATATTAGCTCCTGATGACTCACGAGGTGA
ATGGCTCACAGTGAACGACGACTGAACATTCCTTACGCTGCGTTGCCACCACCTC
CAGGAATGCAGTAGGTATGGAGTAGTGAATTCCAGAATCTCTTCATACTAACTA
CATTCTTTTGTATCCACAGTTAGGAATTAGTAAAGGTAGTTTGGAATTCTGTATT
AGCTTTTAGAAGAAGTATAAAAGCACTATGATAGATTGTACGGGAGCTCTTCAC
TACTCGCTGTGCCGAGAGTGTTCGAGACTCTCCAGGCTTGGTAAGAAATATTATA
ACTTTGTTATTCTGATCCTTTCTGTGCTCTGCTATTTAGATTGTAATGGGTAAAGG
CAATGCTTAATCAGATTTAATACAATAAACCGACTTAATTCGAGAACCATACTTA
TTTTATTGTCTCTTTCAATACTTTATGTAAAGTGAAAGGAGTTGTGTATTAGCCTT
GCTTAGGGAACCATCTAGTGGAATAAGTGGGTACTACACTTATCATAAAAGGTG
TTAGTTCCTAAGGATAATCAATACACAATATTCCATGACAATTGGCGCCCAACGT
GGGGCTCGAATATAAGTCGAGGTATTATTTAAAGTGTTTAAAAATCTATTCCCTA
GGGACCTTCACGCACCGCGGAAGGTATTAATTGTTGCCTAAATAAAATGGCAGC
TGTTGAAGGTGATTTAGATGTCCAAGCATTAACTGATTTGTTTAAATAATCTAGGG
ATCAATAGAGATCCTAGACATAGAGAGGTAATTGCCCTCCGAATGACCGGAGGA
TGGTGGGGACCAGCTACTAGATATAATCTGATAACTGTACTATTACAAGATGAC
CAAGGACAACCTCTTCAGCAACCTAGATGGAGAGCTGAAGGTAGAGCTGCTAAT
CCAGCAGTCATGCTCACTCTAGAAGCTCCTTGGCAAGACCTCCGGATGGCTTTTG
ATAATGTTGATTTAGCTGACGATACTTTAAGATTTGGACCTTTAGCTAATGGAAA
TTTATATCCCAGGTGATGAATACTCTTTGGAATTCATACCCCCTGCTATGCAAGAA
ATAGCACAAATGCAAAGGGATGAACTTGAGAATGTATTGGATATTGTTGGACAA
ATAACAATGCAAATGAGCGACTTAATAGGTATGCAAGACGCTCAAATTAGAAGGA
CTGGAAGGTCAAATTAGAGGACTAAGAGGCAATCTACCAGTTGCAGGAACTCCA
CCTCCACCACCTTCCTAGTTTAGATTTACAACCTGCTGCTGCCTCTTCACCTTATGT
TGCACCAGCATCTTCAGCTCCTGCTGCTCCTGTAGCATCTGCTGATTTAGGATGG
TTTGCTGGAGGACCTAGTCCTGGATCAGTAGATCCAAGATTGGCCAGGGTAGCT
TATAACCCTTTTTTGCCTGGTCCAAGTGATGGTTCTGGGGTAGCCCCGGTTCAGC |

TABLE 7-continued

Nucleic Acid Sequences of Vectors

SEQ ID NO Sequence

CCAGTGCTCCTCCTGCGGCTTCACCTTTACTACCACTACCACCAGCTCAACCCGT
GCAGCCAGTTATTCAATATGTGCATCCACCTCCAATGAATCCGGCACAACAGATT
ATACCCATTCAACATATACGAGCAGTAACTGGGAATGCTCCAACTAATCCACGA
GAAATACCAATGTGGATAGGAAGAAATGCTTCGGCTATAGAAGGGGTGTTTCCT
ATGACAACTCCCGATTTAAGATGTAGAGTAATTAATGCTCTACTTGGAGGAAAT
CTCGGACTTAATTTAGAGCCTCAACATTGTGTTACCTGGGCTTCAGCTATAGCAA
CACTTTATGTGAGGACTCATGGTTCTTACCCTATTCATCAATTAGCTGAAGTCCTT
AGAGGAGTAGCCAATTCTGAAGGAGTAGCTGCTGCCTATCAGCTTGGCATGATG
TTAACTAATAGAGACTATAATTTAATTTGGGGAATAATTAGACCCCTGTTGCCTG
GACAAGCTGTAGTTACTGCTATGCAACATCGCCTTGATCAAGAAATCAATGATG
CTGCTAGAGTAGCTTCTTTTATTAATCATCTGAATGGTGTATATGAACTCCTAGG
CTTGAACGCCAGGGGACAAAGCCTTAGGATACCTGCTTCTGGGGGACAAACTAC
GGCTGGAACCTCTGCAGGAAGGGGTACTCGGGGCCGTAGGAGTCAGCAAGGAA
CCCCTGGAAGACAATCTTCAGGACAATCACAACAACAAGGAAGAAGAAGTTCCC
AGGGCCAGTCTAGGCAATCTGATAGTAGTGATCAGAATGTGCAAAGACAGTCAC
AAGGAGGAAATGGTAGAGGAGGATATAATCTAAGACCACGTACATACCAGCCG
CAAAGGTACGGAGGCGGACGAGGTCGCAGATGGAACGATCAACCTGCAAGATC
AGATAATCAACAGCGTTCCCAGTCTCAGCAACCGCAGTCAGAGGCTCGTGGCGA
GCAGTCACGAACATCTGGCGCGGGGCGTGGACAAGGAGGAAGAGGGAACCAAA
ACCGAAACCAGCGATCAGCTGGTGGAAACGCAGATAGAACTGTGAATACAGTG
ACAACTGCATCCGCCTCGACCTCTGCCTCAGGTCAAGATGGATCCTCTCCAGCTC
CTCCAGCCTCTGGAAGCGGAAATCAAGGGAACTAAATTAAAAGCCCACTGGGAC
AGTGGAGCTACAATCACTTGTATTCCAGAAGCCTTTCTTGAAGATGAACAACCA
ATACAGACTATGCTAATTAAGACTATTCATGGAGAAAAACAACAGAATGTTTAT
TATTTGACATTTAAGATACAAGGAAGAAAAGTGGAAGCAGAAGTACTTGCTTCC
CCATATGACTATATTTTATTAAATCCATCAGATGTCCCATGGCTTATGAAGAAGC
CTTTACAATTGACTGTGTTAGTTCCTCTTCAAGACTACCAAGAAAGACTTTTAAA
ACAGACTACTTTGCCTAAAGAACAAAAGGACCAATTAGAAAAATTATTTTTAAA
ATATGATGCACTTTGGCAGCATTGGGAAAATCAAGTAGGACATAGGAGAATAAA
ACCACATAACATTGCAACTGGTACATTAGCCCCTAGGCCTCAAAAACAATATCC
AATAAATCCTAAAGCAAAACCTAGTATACAAATTGTAATAGATGATCTGTTAAA
ACAAGGTGTCTTAATACAACAGAACAGCACTATGAATACTCCAGTGTATCCAGT
TCCAAAACCTGATGGCAAATGGAGAATGGTTTTAGATTATAGAGAAGTAAATAA
AACTATCCCTTTAATTGCTGCACAAAATCAACATTCAGCAGGGATACTCTCCTCA
ATTTACAGAGGAAAGTATAAAACTACTTTAGATCTTACAAATGGATTCTGGGCA
CATCCGATAACTCCTGAATCTTATTGGTTAACAGCTTTTACTTGGCAAGGAAAAC
AATATTGTTGGACTAGACTACCACAGGGATTTCTCAATAGTCCTGCTCTATTTAC
AGCAGATGTTGTTGATTTGTTAAAAGAAGTACCAAATGTGCAAGCATATGTGGA
TGATATTTATATGAGTCATGATGACCCTCAAGAGCATCTTGAACAACTTGAGAA
AGTTTTTTCCATATTACTCAATGCTGGTTATGTGGTTTCTCTTAAAAAATCTGAAA
TTGCTCAGAGAGAAGTAGAATTCTTAGGGTTTAATATTACAAAAGAAGGCCGAG
GCCTTACAGAGACTTTTAAACAAAAGTTATTGAATGTAATTCCACCTAAAGATTT
GAAACAGTTACAGAGCATATTAGGATTATTGAATTTTGCTAGAAATTTTATTCCT
AATTACTCTGAGTTGGTAAAACCTTTATATACTATTGTAGCTAATGCAAATGGTA
AATTTATATCTTGGACGGAAGAAAACAGTAACCAATTGCAATATATTATTTCAGT
GTTAAATCAGGCAGATAATTTGGAAGAAAGAAACCCAGAGACCAGGTTAATTCT
TAAAGTCAATTCCTCTCCTTCTGCTGGATATATTCGATATTATAATGAAGGATCT
AAAAGACCTATTATGTATGTTAATTATGTGTTTTCCAAAGCTGAAGTTAAATTTA
CTCAAACTGAAAAAATGTTAACAACTATGCATAAAGGCCTTATTAAAGCCATGG
ATTTAGCAATGGGACAAGAAATCTTAGTATACAGTCCAATTGTTTCTATGACCAA
AATTCAGAAAACCCCATTGCCTGAAAGAAAGGCATTACCTGTTAGATGGATTAC
TTGGATGACATATTTAGAGGACCCTAGAATTCAATTTCATTATGATAAAACTCTG
CCTGAGTTGCAGCAAACTCCTTCTGTTACAGAAGATGTTATTGCAAAACTAAAC
ATCCAAGTGAGTTTGCAATGGTATTCTATACTGATGGGTCAGCAATTAAACATCC
TGATATTAATAAATCTCATAGTGCTGGTATGGGTATTGCTCAAGTTCAATTTCAA
CCTGAATATAAAGTTATCCACCAATGGTCTATACCTTTAGGAGATCATACTGCTC
AATTAGCTGAAATTGCAGCAGTGGAATTTGCTTGTAAAAAAGCCTTAAAAATCT
CTGGTCCTGTCCTTATAGTCACTGACAGCTTTTATGTCGCTGAAAGTGCTAATAA
GGAATTGTCATATTGGAAATCTAATGGTTTTCTTAATAACAAGAAAAAGCCTCTT
AAACATGTTTCAAAATGGAAGTCCATAGCTGAATGTTTACAGCTCAAACCTGAC
ATTACTATAATACATGAGAAAGGACATCAACAACCTATGACTACCTTACATACA
GAAGGAAATAATTTAGCTGATAAGCTTGCCACCCAAGGGAGTTATGTGGTTCAT
TGTAATACCACCCCAAGCCTGGATGCAGAGCTGGATCAGTTACTACAAGGACAT
AATCCTCCAGGGTATCCAAAACAATATAAATACACCCTTGAGGATAATAAAATT
ATAGTTGAAAGGCCTAACGGACAACGATAGTGCCTCCAAAATCTGATAGAGAA
AAGATTATCTCTATGGCCCACAACATTGCTCATACAGGACGAGACGCTACTTTCT
TGAAAGTCTCTTCCAAGTATTGGTGGCCTAACCTAAGAAAGGATGTGGTTAAAG
TCATCAGACAATGTAAACAGTGTCTGGTAACAAATGCTGCAAATTTAACTTCGCC
TCCAATACTTAGGCCTGAAAAGCCTCTTAAGCCTTTTGACAAATTTTATATTGAT
TATATTGGACCATTACCACCTTCCAATGGCTATCTACATGTCCTTGTAGTAGTCG
ATGGTATGACAGGCTTTGTATGGTTATACCCCACAAAGGCTCCCTCGACTAGCGC
AACTGTTAAAGCTCTCAATATGCTCACTAGTATTGCAATTCCAAAGGTGCTGCAT
TCTGATCAAGGAGCAGCATTCACCTCTTCAACTTTTGCTGATTGGGCTAAAGAAA
AAGGTATACAATTGGAATTCAGTACTCCTTACCATCCCCAAAGTAGTGGCAAGG
TGGAAAGGAAAAATAGTGACATTAAACGACTTTTAACTAAACTGCTAATTGGGA
GACCTGCTAAGTGGTATGATCTATTGCCTGTTGTACAATTGGCATTAAATAATTC

TABLE 7-continued

Nucleic Acid Sequences of Vectors

SEQ ID NO Sequence

TTATAGTCCATCTTCTAAATATACTCCTCATCAACTCTTGTTTGGTGTAGATTCCA
ACACACCGTTTGCCAATTCTGACACACTTGACTTATCCAGAGAAGAAGAGTTATC
TCTTTTGCAGGAAATCAGATCTTCTTTGCACCAACCAACCTCCCCTCCTGCCTCCT
CTCGTTCCTGGTCACCTTCGGTTGGCCAATTGGTCCAGGAGAGGGTAGCCCGCCC
TGCTTCACTTCGACCTCGTTGGCACAAACCAACTAGCATATTGGAAGTAGTAAAC
CCACGGACAGTGGTTATTTTGGACCATCTTGGCAACCGACGAACTGTAAGTGTG
GATAATCTTAAATTAACAGCTCACCAAATAATGGCACCACCAATGACTCTGGA
ACAATGGCTCCTGTGGAAGAAGATGAATCAGGCTCACCAAGCTCTTGAAAATGT
AACTGTATTGACTGAAGAACAGAAACAGCAGGTTATTGTGGACATTCAGCAAGA
AGAAGTTATTCCTACTAGGATGGACAAATTGAAGTACCTAGCATATTCATGTTGT
GCCACTAGTACACGTGTATTATGCTGGATAGTATTAATTTGTATACTATTATTAG
TTGTGTTTATCTCTTGTTTTGTGACCATGTCCAGAATACAATGGAATAAGGATAT
TGCTGTTTTAGGCCCAGTCATAGACTGGAATGTTAGTCAACAAGCTGTGATTCAA
CAAATCAGAGCTAAAAGATTAGCAAGGTCACTTAGGGTGGAACATGCTACAGAG
GCGTATGTGGAAATTAATATGACCAGCATACCCCAAGGAGTGTTATATATCCCTC
ATCCAGAACCCATAATTCTCAAGGAGAGGGTTCTTGGTCTTTCACAGGTTATAAT
GATAAATTCTGAAAATATTGCTAATACTGCTAACCTTACACAGAAACTAAGGT
ATTATTGGCAGACATGATTAATGAAGAAATGAATGATTTAGCCAATCAAATGAT
AGATTTTGAAATTCCTTTAGGAGATCCGAGAGACCAAAAGCAATATCAGCATCA
AAAATGCTATCAAGAATTTGCTCATTGTTATTTGATTAAATATAAGACCGCTAAG
GGATGGTCCAGTTCTACGGTGATTGCAGATCAATGTCCTTTGCCAGGAAATCATC
CCACAGTACAATATGCCCATCAAAGCATATGGGATTATTATATTCCATTTGAACA
AATTAAACCAGAAGGGTGGACTTCTAAAACATATTATGAAGATGCCAGAGTTGG
AGGATTTTATATCCCAAAGAGGCTTAGGAATAATTCATATACTCATGTGTTACTT
TGTTCAGATCAAATTTATGGAAAATGGTATAATATAGATCTTACTACCCAGGAG
AGGGAAAGATTATTGGTACAAAAGTTAATTAATTTAACTAAAGGAAATACTTCA
CAACTAAAAGATAGGGCCATGCCCACAGAATGGAATAAGCAAGGAAAAGCTAA
TTTATTCAGGCAAATTAATCCTTTAGACGTTTGTAATAGACCAGAAATGGTATTC
TTATTAAATTCTTCCTATTATGAGTTCTCCTTATGGGAAGGTGATTGTGGATTTAC
TAGACAAAATGCTACTCAAGCTAATCCATTATGTAAAGATTTTTACAATAATTCC
AAATGGAAAAACCTGCATCCGTATGCCTGTAGGTTTTGGAGGTATAAACAAGAA
AAAGAAGAAACAAAATGTAGTAATGGGGAAAAGAAAAGATGTCTTTATTATCCC
CAATGGGATAGTCCAGAGGCCCTATATGATTTTGGGTTTCTAGCTTATCTAAATG
CTTTTCCATCTCCCATATGTATTAAAAATCAAACTATTAGAGATCCAGAATACGA
GGTATACTCTTTATATATGGAATGTATGAATGCCTCTGATAGATATGGGATTGAC
AGTGCATTATTAGCTCTTAAAACATTTCTAAATTTCACTGGTCAGTCTGTGAATG
AGATGCCATTAGCCAGGGCCTTTGTAGGCCTCACTGATCCTAAATTTCCTCCTAC
ATATCCAAATGTTACAAGGGAAACTTCTGGTTGTAATAATAATAGAAGACAACG
CAGAAGTATTAATAACTATGAAAAGATTAGATCTATGGGATATGCATTAACAGG
AGCTGTTCAAACTTTATCCCAAATATCTGATATTAATGATGAGAGGCTGCAACAA
GGAGTATATTTACTCCGGGATCATGTGGTAACCCTGATGGAAGCCGCTCTTCATG
ATGTTTCAATTATGGAAGGAATGTTGGCAATTCAGCATGTACATACTCATCTTAA
TCATCTCAAGACTATGCTTTTAATGAGAAAAATAGATTGGACCTTCATCAGAAGT
GATTGGATTCAACAACAATTGCAAAAATCTGAAGATGAAATGAAACTCATAAGA
AGAACTGCAAAAAGTTTAGTTTATTATGTTACCCAAACTTCTAGTTCTCCTACTG
CTACTTCTTGGGAGATAGGAATATATTATGAAATAACCATTCCTAAACATATATA
TTTGAATAATTGGCAAGTGATCAATGTAGGTCATTTAGTAGAATCAGCTGGACAT
CTGACTCATGTCAAAGTTAAGCATCCTTATGAGATAATTAATAGAGAATGCAGC
AACACTCAATATTTACATCTTGAAGAATGCATCAGAGAGGATTATGTGATTTGTG
ATATAGTACAAATAGTACAACCATGTGGGAATGAAACAGAGTTAAGTGACTGTC
CAGTCACTGCTCTCAAGATAAAGTCTCCATATATTCAAGTCTCTCCCTTAAAGAA
TGGAAGCTACTTAATTTTGTCCAGTACAAAAGATTGCTCTATACCAGCATATGTA
CCTAGTGTGGTTACAGTCAATGAAACAGTTAAGTGCTTTGGAGTAGAGTTTCATA
AACCACTCTACGCTGAAACAAAAACCAGCTATGAACCACAGGTTCCACATTTGA
AGCTTCGTTTACCCCACTTGACTGGGATTATTGCCAGCCTGCAATCACTGGAAAT
AGAGATTACTTCAACTCAAGAGAATATAAAAGACCAAATTGAAAGAGCCAAAG
CACAGCTACTTCGGCTGGACATCCACGAAGGAGACTTTCCTGACTGGCTTAAGC
AAGTTGCCTCTGCAACCAAGGACGTGTGGCCTGCAGCTGCTTCATTCCTACAAGG
AGTAGGTAATTTTCTATCTAACACTGCCCAAGGGATATTTGGATCAGCGGTAAGC
CTCCTATCCTATGCCAAGCCTATCTTGGTGGGAATAGGAGTTATCCTGCTTATTG
CCCTTCTCTTTAAGATCATATCATGGCTTCCTGGGAAGATCAAGAAGAACTAAGG
GAACTTCTGCATCATCTCCCAGAAGATGATCCCCCGGCAGATCTTTCTCACTTAC
TGAATCTTGATGAAATGGAACCTAAGGTTCTTGGAGGACAAAATCCTGGAGATG
AGAAACTACGACAACAAGTAATCAAGCCTCCCAGTATACATCCATCTACAGTAA
CTTGGCATTTTGGATATAAAGATAAAGAAGATCAACAACCAGAAATAAAAATGA
GAGACTGGGTACCAGACCCTTCAAAAATGAGTAAGTCAACATGTATGAGATTAA
TATTGTTAGGATTATACCAAGCTTGTAAAGCACAGGAGATTATAAAAATGGACT
TTGATGTACATTGGGAACAATCTAGAGTTAATAAGCAATATTTTGAAGTAGAAT
ATAGTTGTAGAATGTGTAGAACAGTTCTACATGAACCTATGCCCATAATGTATGA
TCCAGAAACTGAACTTTGGGTAAAGCAGGACGCCTTAGAGGACCCCTAGGATC
TGCTGTTTACACACTTAAAAAACATTATGAACGATGCTTATCTGCCCTTCCTAGC
TTCGAAGGAACTCGGCTCCCAAAGCGTCGCGCTAATCCTAGCAGAAGATATGAA
GCATTCAGAAAGCATACTCCAACTAGGAAACGGCGCTCCAAGGAAGGGATTTCC
ACTGACCAGCAGCCCTCTACTTCCAGTGGTGACCCCATGGCCCTTATCTCAGGAC
CATGTGGCCCCCACTCTATACAGCCTCCTGGTTGCATATTACAAGAGCTTCCAAA
ACCAGAAGTTGGAACCTCCGAAATGGCTGTGGCAATGTCTGGAGGACCCTTCTG

TABLE 7-continued

Nucleic Acid Sequences of Vectors

| SEQ ID NO | Sequence |
|---|---|
| | GGAGGAAGTGTATGGTGACTCAATTTTTGGTGCCCCCTTTGGGACAAGTGATGAT<br>CAGTTGCTATCGCAATTTGACTAGTATAATAATATGTCAAGCAGTAGATCCTTGG<br>GAAAATAATAATGAAACAGATTGGAAAAGGGATCCTATGGCTAGACCTAGGATC<br>AGATGTGATCATGCCCTTTGTTTTAAAGTAGTTTATGAAGGAACCCCTTGGCGTA<br>CTCATGATCAGAAGAGTTGGCTTATTCGCCTAACTGAGGGACATAAACATGGGA<br>TGGAAGAATTGTCCCCAGGTGACTGGAAAATACTCCAGGAATCCCGTCCTTATC<br>CTTATGGACCAGTTGGAGAAGATCCTAACTTGCAATATGCTGTCAGTGTTAAAAT<br>GAAGGTAACTGGGGGCCCTTTAACCTCAACAGTGTTAGCCTTAAAAGCTTTATGC<br>TTTCATAGAGTTAACATTTGTAATATGGATAATCCTGGTCTAGGAGAGGGACATC<br>CCCCTCTTGGATATTCTCATGCACTGAAGGCATATGGACCTCAGTATGGTAGTTG<br>CGAGGAGAGGGTGTGGCAGGCAGCCACTAAATGTATTGGTCCTGGTGAGGGAG<br>ATTATTGGTGTGAGTATGATCACCGTGGGTATTTCCCTATTATACCTAACAAGCT<br>ATCTCCTACGTGGGTGAGACATGCTGCCCCCTATGGTATACAAAGGCTCGCAAC<br>ACCATATGATCTCCAGATGTTTGCAAATGAGTTATTGCCACCTGGTTACAGTATT<br>AATACTCCCAGTGGAACTTGCTATGTGAGCAATCGCAGGCTTCACTATGGAAAT<br>GAAGGAACTCTTCAGGAGTATCAAGAGAACTGTGACAGAATTAAAAGAGGATA<br>TGAGGATATTTCCTCTAGTGATTCTTCAGATGAGGATTAGGGGAAGTTTACCCAG<br>CAACTGCTTATGCTTGCTTATGATTCATGCCTTTGTTTAGGATAAGAATGTATTTA<br>ACCATAGTTAATCCTTAGGAAGCATTTGGTAAATTCTACTAAGCAAACCTGTTCA<br>TTTACTACCGTGCTTCCGATGGAGAACTTAGGGACGAGGCTGTGAGTTCGATATC<br>ATCCTCATCTCGAGTGTCTCCCTTTTGCTTTTATAGTAATTAGAAATTATGCAATA<br>GGTATAAGTATAAAATAATAATAAGATAATCCTAAGGGAGGGAGTGGAACGTCC<br>TGATAGAAAACAGGCATGACGCTCTCCCATCCCTCCTTTTCATATGTTCAAATCT<br>AAGGTAATATTATTGATTCCTTGCCAGCTGTTAGCATAGAAATTAAATAAAACA<br>GGAAACCACAAGTAGGTGAAGGCTAGCTCACTGAATAAATTGACTAGTCTTTGC<br>TCAAGAACCCAGGGAGCAATGTTGTATGTTCAAATCTCAATAATGCATCCTGGTC<br>GTTCTTTATGAAGTTATGTCATTGTAAACAAAATATGAAAGTTAGAAATGACTGT<br>CCAAAAAGCCACAAAGGGAAATAGCTAATGTGCAAAGTATTAGTCTTGTACTTG<br>GCCGTTCTCCTTTGGTATTCAAGTTCAAATCCTGTAAGCAGTATTACAGCTGATG<br>TAATGTTAAGTAATAACTTGTTTTCTATATGAGTGTAATATTAGCTCCTGATGAC<br>TCACGAGGTGAATGGCTCACAGTGAACGACGACTGAACATTCCTTACGCTGCGT<br>TGCCACCACCTCCAGGAATGCAGTAGGTATGGAGTAGTGAATTCCAGAATCTCT<br>TCATACTAACTACATTCTTTTGTATCCACAGTTAGGAATTAGTAAAGGTAGTTTG<br>GAATTCTGTATTAGCTTTTAGAAGAAGTATAAAAGCACTATGATAGATTGTACG<br>GGAGCTCTTCACTACTCGCTGTGCCGAGAGTGTTCGAGACTCTCCAGGCTTGGTA<br>AGAAATATTATAACTTTGTTATTCTGATCCTTTCTGTGCTCTGCTATTTAGATTGT<br>AATGGGTAAAGGCAATGCTTAATCAGATTTAATACAATAAACCGACTTAATTCG<br>AGAACCATACTTATTTTATTGTCTCTTTCAATACTTTATGTAAAGTGAAAGGAGT<br>TGTGTATTAGCCTTGCTTAGGGAACCATCTAGTGGAATAAGTGGGTACTACACTT<br>ATCATAAAAGGTGTTAGTTCCTAAGGATAATCAATACACAATATTCCATGACA |
| SEQ ID NO: 1457 | TGTCATGGGCCAAAGAGAATTCTCACAGAGGAGAATACTCTCTGCTGCCATCTA<br>GTGACGATGAGGAAGAAGAAATGTCAGAAAGAGAGGAATTATTGTGCCATATA<br>AATCAGTGTCAACAAAAGCTCTTTTATCCCGGAGGGACGACTGATGTCCTTGGA<br>ATGGAAAGCAATGTTTGGCTCACTAAATTTGTTAATATTAAATTTCCTAAAGGAA<br>CAAAAGTGATACTTCCTGATGGAAGAAAATTCATAGCCTGTGATCCTGAGCTAA<br>AACCATTATTGCAGGAATTGAAATTCTTGGATAGGGCAACATCTGAGTCATCTG<br>ACTCTGAATAGAAAGCCTGAATTTACCTGGATTATGCAACTTTGTCCGAGGTGGC<br>AGAGTGGTTATGTATCTGTCATACTCGGGGAAAGTTTTGTCTTTACATGTTCAAG<br>ACATATAAAGGGTGGAAAAATATATTCCTGACTAAACTTCCTGGGGACTAGAGG<br>TGTGGAAACTTTGCTGCCTCTGCTTCACGGGAAGTTTTTGGTTCGAATCCTTTTTT<br>AGGTACTTAGTTAAGATAAGTAGTGAATAAATTACTCTCGTTCATGTATTCATAT<br>CGAAACTATGTATCCTTTAAAACCATGTATTCTTTAGTCATCTAGATACTTAGAG<br>TATGAAAAAGAAACTGCAATAGTAACTATCAATGTTAGTAAATAAAGTACAGC<br>TTAGTCATCTGATGATGTCACGAGAAAAGAACCTAGAAGAGAAGAACAACTTTC<br>GGCATGCAACAGAGCGGGAGCTTGGTGTAGGAGCTAAGTCACCGTCTTACATCT<br>AGAGCCTACTCTTCTTGAACTGTTCGAATCCTATTTTTGGAACTCTTACATCACCT<br>TTAAGAGACTGAAAAGCATGACTCGTGCACAGGAAGCTCCTTTAGGGTAGAGGA<br>AATGTTCTAATCTCCTATCTTAAAGGGTTGCTTCATTTAAGGTTCGAAACTGTGT<br>ACTGGAAGTAGATTTTGCATAACTTTAAACTTTTAGTTGCATGTTTCTGCTATTAG<br>CAGCATATAAAAGGGTTATGGTAGATTGTACGGGAGCTCTTCTCACAGACTTGG<br>CTGCGTCCAGGGTGAGATTGAGACTCTCCAGCTTGGGTAAGATTTTGATATGTAT<br>TTTGCTTGAATATTATTTGCCTTGCTCAAAATTAAATAAATTGGCTTTTCTTTCAC<br>TCAATTGAAGCTTCATATAATTATATTATTGTCTGAAGCCAGAACTCACATGAGT<br>GGTGTTTCTCTATTCTTGGGGAAAAGTGTTCTTCTATTTGAAAGTGTTAGAGCTA<br>CTAAGTGAAGAACTAATCTATCCCAGGTATAGGCCACGACAGTTGGCGCCCAAC<br>GTGGGGCTCGATTGAGTGAAATTTAAATTAAGCTGAGGAGAATAATCCCTAGGG<br>ACCTTACCTTACTGAGGAAGGATGGCTCGAGAATTAAATCCTCTCCAATTACAGC<br>AACTGTATATAAATAATGGCTTACAACCTAATCCAGGACATGGAGATATTATTG<br>CTGTCAGATTTACAGGAGGACCTTGGGGTCCAGGTGATAGATGGGCTAGAGTGA<br>CAATACGATTACAAGATAACACAGGACAACCTTTACAGGTTCCTGGATATGATT<br>TGGAACCTGGGATAATAAATTTGAGAGAGGATATCTTGATAGCAGGGCCATATA<br>ATTTAATAAGAACTGCCTTTTTGGACTTAGAGCCTGCCAGAGGACCTGAAAGGC<br>ATGGTCCCTTTGGAGATGGCAGATTACAGCCTGGAGATGGTTTATCTGAAGGATT<br>TCAACCTATCACTGATGAAGAAATACAAGCAGAAGTAGGAACTATTGGTGCTGC<br>TAGAAATGAGATAAGATTATTACGAGAAGCTTTACAGAGATTACAAGCTGGAGG |

TABLE 7-continued

Nucleic Acid Sequences of Vectors

SEQ ID NO Sequence

TGTGGGTAGACCTATACCAGGAGCAGTTTTACAACCACAACCAGTAATAGGGCC
GGTAATACCAATTAATCATCTTAGGTCGGTTATTGGCAATACTCCACCAAATCCA
CGAGATGTCGCCCTATGGCTTGGAAGATCTACAGCCGCTATTGAAGGAGTATTTC
CCATAGTGGACCAAGTCACTCGTATGAGGGTAGTTAATGCCTTAGTAGCATCTCA
TCCCGGCCTAACGTTGACTGAGAATGAGGCCGGGAGCTGGAATGCTGCCATATC
AGCTTTATGGAGGAAAGCTCACGGTCTGCAGCTCAGCATGAATTGGCAGGAGT
ATTAAGTGATATTAATAAAAAGGAAGGCATACAAACTGCATTCAACCTAGGAAT
GCAATTTACAGATGGAAACTGGTCCTTAGTATGGGGAATAATCAGGACTCTTTTA
CCAGGACAAGCCCTAGTAACCAATGCTCAGTCACAATTTGACCTAATGGGAGAT
GATATACAACGAGCAGAAAATTTCCCCAGGGTCATTAACAATCTATACACTATG
CTGGGTCTCAATATACATGGGCAAAGTATTAGACCTCGGGTCCAAACACAGCCA
CTACAAACTCGACCCCGGAACCCGGGACGATCTCAACAAGGTCAACTAAATCAG
CCGAGACCCCAAAATAGAGCTAACCAATCTTATAGACCCCCTAGACAACAACAG
CAACACTCTGATGTTCCCGAACAGAGAGATCAGAGAGGACCGTCGCAACCTCCT
CGTGGAAGTGGAGGAGGATATAATTTTAGAAGAAATCCGCAGCAGCCTCAGCGC
TACGGCCAAGGACCACCAGGACCAAACCCGTACCGACGATTCGGAGACGGCGG
TAATCCTCAACAGCAGGGACCACCACCAAACCGAGGGCCTGATCAAGGACCTCG
GCCAGGAGGCAATCCCAGAGGAGGAGGAAGAGGTCAAGGTCCAAGAAATGGAG
GAGGAAGCGCTGCCGCAGTACATACAGTAAAAGCGTCTGAAAACGAAACTAAA
AATGGATCTGCTGAAGCCGTTGACGGTGGAAAGAAAGGGGGTAAAGATTAAAG
GTTACTGGGACTCCCAAGCCGATATTACCTGTGTTCCAAAGGACTTGCTTCAAGG
AGAAGAACCTGTTAGGCAGCAAAATGTGACTACTATACATGGAACGCAGGAAG
GAGATGTATATTATGTAAATTTAAAAATAGACGGTAGAAGAATTAATACAGAAG
TAATAGGGACAACTTTGGACTATGCTATTATAACTCCTGGAGATGTACCTTGGAT
TTTGAAGAAACCTCTAGAATTGACTATTAAACTAGATTTAGAAGAGCAGCAAGG
GACTTTACTTAACAATTCCATTTTATCTAAAAAAGGGAAAGAAGAATTAAAACA
ATTATTTGAGAAATATAGTGCCTTATGGCAAAGTTGGGAGAATCAGGTGGGTCA
TAGAAGAATTAGGCCACATAAAATAGCAACTGGTACAGTAAAACCCACACCTCA
GAAACAGTATCATATTAATCCAAAGGCAAAACCTGATATTCAGATTGTGATAAA
TGATTTACTAAAACAAGGGGTACTAATTCAAAAGGAAAGTACTATGAACACTCC
TGTCTACCCAGTACCCAAGCCAAATGGTCGCTGGAGAATGGTACTGGACTACAG
AGCAGTAAATAAAGTCACACCTTTGATAGCTGTACAAAATCAACACTCGTATGG
AATTTTAGGAAGTCTTTTTAAAGGTAGATATAAAACTACAATTGATTTATCCAAT
GGTTTCTGGGCACACCCCATAGTCCCAGAGGATTATTGGATTACTGCATTCACTT
GGCAAGGAAAACAATATTGTTGGACTGTTTTACCACAAGGTTTTTTAAACAGCCC
TGGGTTGTTTACTGGAGATGTTGTAGATCTTCTACAGGGAATTCCCAACGTGGAA
GTCTATGTGGACGATGTATATATTAGTCATGATTCTGAAAAAGAACATTTGGAAT
ATCTGGATATTTTGTTTAATAGATTAAAAGAAGCAGGATATATAATATCTCTTAA
AAAATCCAATATTGCCAATTCTATTGTGGATTTTCTTGGTTTTCAGATTACTAATG
AAGGCCGGGCCTGACAGATACTTTTAAAGAAAAATTGGAAAATATTACTGCCC
CTACCACTCTTAAACAATTGCAAAGCATACTAGGTCTTTTAAATTTTGCCAGAAA
TTTTATTCCTGACTTTACTGAATTAATTGCTCCTTTATATGCATTGATACCAAAGT
CTACCAAGAATTATGTTCCTTGGCAAATAGAACATTCAACCACTCTGGAAACTTT
AATTACTAAACTAAACGGGGCAGAATATTTACAAGGAAGAAAAGGAGATAAAA
CATTGATCATGAAAGTCAATGCTAGTTATACAACAGGATATATAAGGTATTATA
ATGAAGGGGAAAAGAAGCCAATATCCTATGTAAGTATATAGTGTTCAGCAAAACTG
AATTGAAATTCACTGAACTAGAGAAATTGCTGACCACTGTGCACAAGGGTCTTTT
AAAGGCCTTGGACTTGTCAATGGGGCAAAACATTCATGTTTATTCCCCCATTGTA
TCCATGCAAAATATTCAAAAAACACCACAGACTGCTAAAAAGGCTTTGGCCTCT
CGATGGTTGAGTTGGCTTTCTTATTTGGAAGATCCGAGAATTAGGTTCTTTTATG
ATCCACAGATGCCTGCTCTAAAAGATTTGCCTGCTGTAGACACCGGAAAAGATA
ATAAAAAACATCCTAGCAATTTTCAACATATATTTTACACTGATGGTTCTGCTAT
CACGTCCCCTACTAAGGAGGGACATTTAAACGCTGGAATGGGAATAGTTTATTTT
ATAAACAAAGATGGAAATTTACAAAAGCAACAGGAATGGTCCATTAGTTTGGGG
AATCATACAGCACAATTTGCAGAAATAGCTGCTTTTGAGTTTGCCCTTAAAAAAT
GTTTGCCTTTGGGAGGAAACATTCTTGTGGTTACTGACAGCAATTATGTTGCAAA
AGCATATAATGAGGAACTTGATGTTTGGGCCTCTAATGGCTTTGTGAATAACAG
GAAGAAACCTTTGAAACATATTAGTAAATGGAAATCGGTTGCTGACCTTAAAAG
ATTAAGGCCAGATGTTGTTGTGACCCATGAGCCAGGTCACCAAAAACTTGACTC
ATCTCCTCATGCTTACGGGAATAATCTGGCTGATCAACTGGCCACGCAAGCCAGT
TTTAAAGTACATATGACTAAAAATCCCAAGCTGGACATTGAGCAAATAAAGGCA
ATTCAAGCATGTCAAAATAATGAAAGATTACCTGTTGGTTATCCAAAACAATAT
ACCTATGAGTTGCAAAATAATAAATGTATGGTTTTAAGAAAAGACGGTTGGAGG
GAAATTCCTCCTTCCCGAGAACGGTATAAAACTTATTAAAGAAGCACATAACATT
AGTCATGCAGGCCGAGAAGCCGTGTTATTAAAATACAAGAAAATTATTGGTGG
CCAAAAATGAAGAAAGATATATCATCTTTTCTTTCTACATGTAATGTATGTAAGA
TGGTAAATCCTTTGAATTTGAAACCTATTAGCCCTCAAGCTATTGTACACCCAAC
CAAACCTTTTGATAAATTTTATATGGATTACATTGGGCCATTGCCACCATCAGAA
GGTTATGTGCATGTTTTAGTTGTGGTAGATGCTGCCACTGGATTTACTTGGTTGT
ACCCCACTAAGGCTCAAACCTCCAAGGCCACAATTAAAGTTCTTAATCATCTCAC
TGGACTAGCAATTCCAAAGGTGCTGCATTCTGATCAAGGATCAGCATTTACTTCT
GAAGAATTTGCTCAGTGGGCAAAGGAAAGGAATATACAATTGGAATTCAGTACT
CCTTACCACCCTCAAAGTAGTGGGAAAGTGGAAAGGAAAACAGTGAAATTAA
GAAACTTTTAACTAAGCTCTTGGTTGGGAGGCCTTTAAAGTGGTATAACCTTATA
TCCAGTGTGCAACTTGCTCTAAATAACACTCATGTTGTCAGCACCAAGTATACTC
CTCATCAACTAATGTTTGGAATTGATTGTAATTTACCATTTGCTAATAAGGATAC

TABLE 7-continued

Nucleic Acid Sequences of Vectors

SEQ ID NO Sequence

CTTGGACTGGACAAGAGAAGAAGAACTTGCTCTCTTGCAGGAAATTCGTGAATC
TTTACAACACCCTGTACAACCCCCCACCTGCTCTGGTTGGTCACCATACGTTGGC
CAGCTGGTCCAGGAGAGGGTGTACAGGCCGTCACAATTAAGGCCTAAGTGGAGG
AAGCCTACAAAGGTCTTGGAAATATTGAATCCTAGAACTGTGATTATAGTGGAC
CATCTAGGCCAACGGAAATCTGTGAGTATTGACAATTTAAAACCTACAGCACAC
CAGCATAATGGAACAAGAACATGTGATGACCCTGAAGGAATGGATGGAATGGA
ATGCTCACAAACAACTACAGAAACTTCAGTCGACTCATCCTGAGTTGCATGTTGA
CATACCTGAGGATATTCCTTTAGTACCAGAGAAGGTACCTTTGAAAATGAGGAT
GCGATATAGATGTTATACTTTGTGTGCTACTTCTACTAGAATAATGTTTTGGATA
CTATTCTTTCTTCTATGTTTTTCAATAGTTACCTTGAGTACAATTATAAGTATTCT
TAGATATCAATGGAAAGAAGCAATAACACATCCTGGCCCAGTCTTAAGCTGGCA
GGTGACTAATTCACATGTAACCATGGGAGGAAATACTTCCTCTTCCTCCAGACGG
AGACGTGATATACAATACCACAAACTTCCCGTAGAGGTTAACATCTCAGGGATC
CCACAAGGTCTTTTCTTCGCACCTCAACCAAAACCTATATTTCACAAAGAAAGAA
CTTTAGGTCTTTCTCAAGTGATTCTTATTGACTCTGATACTATTACTCAAGGTCAT
ATTAAACAACAGAAAGCATATTTAGTCTCAACAATTAATGAAGAGATGGAGCAA
TTACAAAAGACAGTATTACCTTTTGACTTACCCATCAAGGACCCTCTAACTCAAA
AGGAATACATAGAAAAAAGGTGCTTTCAAAAATATGGACATTGTTATGTTATAG
CTTTTAATGGAAATAAAGTTTGGCCTTCACAAGATTTAATACAAGATCAATGTCC
ATTACCTCCTCGCTTTGGAAATAACTTAAAGTATAGGAACCACACTATATGGAA
GTATTATATACCATTGCCATTTAAAGTATCCTCCAATTGGACAAGAGTAGAATCC
TATGGTAATATTAGGATAGGCAGCTTTAAAGTTCCTGATGAATTTAGACAAAAT
GCCACACATGGAATATTTTGTTCTGATGCACTATATAGTAATTGGTATCCACGTG
ATCTACCTTCTTCGGTACAACAATCCTTTGCTCAAGCATATATAACAAAGGTACT
TATGAAAAGGAAAAAGCAACCTACTTTACGAGATATAGCTTTTCCAAAGGAATT
GAGCCCTGTAGGCTCTGGTATGCTATTCAGACCTATTAACCCATATGATATCTGT
AATATGCCAAGAGCAGTATTATTATTAAATAAAACATATTATACTTTCTCACTAT
GGGAAGGAGATTGTGGATATTACCAACACAATCTTACTCTTCATCCCGCATGTAA
GAACTTCAATAGAACTAGACAAGACCATCCATATGCTTGCAGATTTTGGAGAAA
CAAGTATGACTCTGAGTCAGTGCAATGCTATAATAATGATATGTGTTATTATAGA
CCTTTGTATGATGGAACTGAGAATACTGAGGATTGGGGATGGCTGGCATATACT
GACTCTTTTCCATCCCCCATCTGTATTGAAGAAAAGCGAATCTGGAAGAAAAATT
ATACTCTGTCATCTGTATTAGCAGAATGTGTAAATCAAGCCATGAATATGGTAT
AGATGAAGTATTATCCAAACTAGATCTGATATTTGGGAATCTGACTCATCAATCA
GCAGATGAGGCCTTCATTCCGGTTAATAATTTCACTTGGCCTAGATATGAGAAAC
AAAATAAACAACAAAAAACCTCTTGTGAAAGAAAGAAAGGTAGAAGACAAAGA
AGGTCCGTAAGTACGGAAAACCTAAGAAGGATACAAGAGGCAGGCTTAGGCCT
GGCCAATGCAATTACTACTGTGGCTAAGATCTCTGACCTGAATGATCAAAAATT
AGCCAAGGGAGTACATTTGCTTAGAGATCATGTTGTCACTCTAATGGAAGCCAA
TTTGGATGATATTGTGTCCCTAGGAGAGGGAATACAAATAGAACATATACATAA
TCACTTAACCTCTTTGAAATTGCTTACTTTGGAAAATAGAATTGACTGGAGGTTT
ATAAACGATTCATGGATTCAAGAAGAATTAGGTGTTTCAGATAATATAATGAAA
GTAATAAGGAAAACTGCAAGGTGCATTCCTTACAATGTCAAACAAACTAGGAAT
CTAAATACTTCCACTGCATGGGAAATATATTTATATTATGAGATCATCATTCCTA
CCACTATATATACACAGAATTGGAATATAAAGAATCTAGGTCACCTTGTAAGGA
ATGCAGGATATTTATCTAAGGTGTGGATTCAACAACCATTTGAAGTACTAAACC
AGGAATGTGGAACAAATATATATTTACATATGGAAGAATGTGTTGACCAAGACT
ATATAATATGTGAAGAAGTAATGGAACTTCCTCCTTGTGGAAATGGAACTGGTT
CAGACTGCCCAGTGCTAACCAAACCACTTACAGATGAATACTTGGAAATTGAAC
CCCTAAAGAATGGGAGTTATTTGGTTTTATCAAGTACTACAGACTGTGGCATACC
AGCTTACGTGCCTGTGGTTATAACGGTGAATGACACAATCAGCTGTTTTGATAAA
GAGTTTAAAAGGCCACTTAAACAGGAACTAAAAGTAACAAAATATGCACCATCC
GTTCCTCAATTAGAACTAAGAGTTCCTCGGTTAACAAGCCTGATTGCAAAAATA
AAAGGAATTCAAATAGAAATTACCAGCAGCTGGGAAACTATAAAAGAGCAAGT
CGCAAGGGCCAAGGCAGAGCTTCTACGCTTGGACCTTCACGAAGGAGACTATCC
AGAGTGGCTGCAGCTCCTTGGAGAAGCAACTAAAGACGTTTGGCCTACAATCTC
CAACTTCGTTTCTGGAATAGGTAATTTCATAAAGGACACTGCTGAGGTATTTTT
GGAACTGCCTTTAGTTTTCTGGGATATGTAAAACCTGTACTTTTGGGATTTGTGA
TAATATTTTGCATAATTTTAATTATAAAAATCATAGGATGGCTTCAAAATACCCG
GAAGAAGGACCAATAACTGAGGGGGTTGAAGAAGATTTTAACTCCCATTCCACT
TCTGGTTTGGACCTTACCTCAGGTAATAAAGAAGAACCTTTGATTTCTTTAGCCC
TATTGTCTATGCATACCAGTAAAATTGTTGTTTGGATAAGGGATCACTTTTTTGT
AAAAATATTATCCTTTGGAGGGAAGCAAAAGTTGTATTATATATGCAACCAATG
TCATAAAGGAATTCCTGAAAGTGGATACATAACTCTCAATACTAAATATTATCTA
TATGAGAAAGGACCTACTGAGACTGGCACCAAAGGTCTAACTCTTATGAGAAGG
CATGTGCAAAATTCCCCTTGTTTCCTGAACAGTCGGAAAGAATCCGGAACACCC
AAGACGGATCCTACTCGTCCTGCAACATCTTATAGCCTATGCCGAAGCGACTATC
AAGAAGCAGGATGTTCCCGGCCCACTCCTTCCAATTCTGAGTCCGTATGTAATGG
CTTGGGACAACCCTCAGAACGTGGTCACACGTCTGGTGAATCGGGGGAATCAT
GGAAGAAGTATCTTTTATCTCCTGGTTGGAAGGATTGTGGGGAGAGGGATTTGA
CTATGCTAACTAGAGAATTGTTGGTACCAGGAATAGGCCTGGTACAAATCGCCG
CTACACTTACTAAAACCTATGTTAATGTGTAATGGGCGATGTATTACAGGTTC
TAGAACCGACCCAGATTGTGATCCTTTGTTCTGTAAGTTGTTATGCTGGAAACAA
AATATACAAGACCCTAGAGAGTGTAACCTAGAAGAATGGTGCCTGTATAGTCTT
GATCCTGAACATGATCCCCTTTGGGATCCAAAAATGATTGTGCGTAGACATAGG
AATCTTTTACCTTATTGTATGAGACCCTTTCTCATTTGGATGAATTATATTTCTCA

TABLE 7-continued

Nucleic Acid Sequences of Vectors

| SEQ ID NO | Sequence |
|---|---|
| | CAATCCTCTTACACAGCAATGTATTATGATGAAAACTTTGAATATGCTTTGGAGA<br>GCACAAGCTGATGATCCAAGTGATGTTGCTTCCCTGTATCCCAGAGTCAAAGTTT<br>TTAAGGCATCTCATTTTGACATATTTGGAAGTGCCTCTGGGAACAGTGAGGAGA<br>GGGTGTCATGGGCCAAAGAGAATTCTCACAGAGGAGAATACTCTCTGCTGCCAT<br>CTAGTGACGATGAGGAAGAAGAAATGTCAGAAAGAGAGGAATTATTGTGCCAT<br>ATAAATCAGTGTCAACAAAAGCTCTTTTATCCCGGAGGGACGACTGATGTCCTTG<br>GAATGGAAAGCAATGTTTGGCTCACTAAATTTGTTAATATTAAATTTCCTAAAGG<br>AACAAAAGTGATACTTCCTGATGGAAGAAAATTCATAGCCTGTGATCCTGAGCT<br>AAAACCATTATTGCAGGAATTGAAATTCTTGGATAGGGCAACATCTGAGTCATC<br>TGACTCTGAATAGAAAGCCTGAATTTACCTGGATTATGCAACTTTGTCCGAGGTG<br>GCAGAGTGGTTATGTATCTGTCATACTCGGGGAAAGTTTTGTCTTTACATGTTCA<br>AGACATATAAAGGGTGGAAAAATATATTCCTGACTAAACTTCCTGGGGACTAGA<br>GGTGTGGAAACTTTGCTGCCTCTGCTTCACGGGAAGTTTTTGGTTCGAATCCTTTT<br>TTAGGTACTTAGTTAAGATAAGTAGTGAATAAATTACTCTCGTTCATGTATTCAT<br>ATCGAAACTATGTATCCTTTAAAACCATGTATTCTTTAGTCATCTAGATACTTAG<br>AGTATGAAAAAGAAACTGCAATAGTAACTATCAATGTTAGTAAATAAAGTACA<br>GCTTAGTCATCTGATGATGTCACGAGAAAAGAACCTAGAAGAGAAGAACAACTT<br>TCGGCATGCAACAGAGCGGGAGCTTGGTGTAGGAGCTAAGTCACCGTCTTACAT<br>CTAGAGCCTACTCTTCTTGAACTGTTCGAATCCTATTTTTGGAACTCTTACATCAC<br>CTTTAAGAGACTGAAAAGCATGACTCGTGCACAGGAAGCTCCTTTAGGGTAGAG<br>GAAATGTTCTAATCTCCTATCTTAAAGGGTTGCTTCATTTAAGGTTCGAAACTGT<br>GTACTGGAAGTAGATTTTGCATAACTTTAAACTTTTAGTTGCATGTTTCTGCTATT<br>AGCAGCATATAAAAGGGTTATGGTAGATTGTACGGGAGCTCTTCTCACAGACTT<br>GGCTGCGTCCAGGGTGAGATTGAGACTCTCCAGCTTGGGTAAGATTTTGATATGT<br>ATTTTGCTTGAATATTATTTGCCTTGCTCAAAATTAAATAAATTGGCTTTTCTTTC<br>ACTCAATTGAAGCTTCATATAATTATATTATTGTCTGAAGCCAGAACTCACATGA<br>GTGGTGTTTCTCTATTCTTGGGGAAAAGTGTTCTTCTATTTGAAAGTGTTAGAGC<br>TACTAAGTGAAGAACTAATCTATCCCAGGTATAGGCCACGACAGT |
| SEQ ID<br>NO: 1458 | ATGGAGAATCCCTTTCCTAACGATTTGCGATCGTATTGTAATTATTTTGGTATTTG<br>CTTGTTTGATTTAAGGTTGCAATGTATATTTTGTAAATCTATACTTGATATTGTAG<br>ATTTAGCCAAATTTCATAAGAAAGAATTGCGTTTGGTTTGGAGATGTAAAGTTGC<br>TTATGCATGCTGTTCAAAATGTTTGTATGCTAGTGCTAGATATGAAAATGAGAAT<br>CATTTTCAATGTGCTGTAAAGGCGTCTACTTTGCATGATCTTTTGGGAACACCAT<br>TGCATCAAATTTACATGAGGTGTAACCATTGTTTAAGTGGGTTAGATTTGCAAGA<br>GAAATTTGATTTGGTAGCTAGAGATTGTTATGTTATTTTAGTGAGGGGTATTGG<br>AGAGGCCCTTGTAGAGATTGTATTAACAGAGAATATTAAAATGAAAGGTGATAG<br>AGTAACAATTAAGGATGTTGAGTTGCATTTAGAGGAATTGGTGATACCAGCAAA<br>TTTATTAAGTGATGAAAGTTTGTCATTAGATGAAACACCGGAGGAGGAGCAATT<br>GTCACCTTACAGGGTGGATAGTTTATGCACTAGGTGTAACAAGTGTATCAGGATT<br>TCTGTAGTTTGCACAACTGGAGCCATTTACACATTGGAGCAACTTCTACTTTCGA<br>CCGAGCTGTCCTTTTTGTGCGCTGGGTGTTCCAGGACCACCGTGCGAAATGGCAG<br>ACGCTTCTAAAGGTATTGACTCGGTAGATGACAGTTCATGGTTTATTGTAAATGA<br>AGCAGATTGTATGGATGACATAGAGACTTTAGATACATTGTTTGATGAAAGTGA<br>TTGTGATTCTACAGTCTCGAATCTAATAGACGATGAGAATTTTCAAGAACAGGG<br>AAACTCCCTGGCGTTGTTCAACATACAGTGTGCAGAGGAGTGTGATAAAACTGT<br>TTCACTACTAAAACGAAAGTATGCTCAAAGTCCGCAGGGATCATCTGTGGCTGA<br>GCTTAGCCCGAGACTGGAAGCTGTTAAAATTTCACCTGAAAAGAAAGACAAAG<br>TAAAAGGAGATTGTTTCAGGACAGTGGATTAGGCGAAGATGAAGCTGAACTTAT<br>TTCTGAACAGGTAGAAGTGCAAACAAATGAAAATGGCGGCGACACATTAAGTGC<br>CGCATGTAATAGTATTTTAAACAGCAAATGTAAGCGGTCGCTATTGTTTGTAAAA<br>TGTGAGACTTTATTTGGTGTATCTTACAATGAACTTACTAGACAATTTAAAAGTC<br>ACAAATCATGTTGTGAAATTGGATTGTATTTGTGTATGCAGCGGGAACAGAAG<br>TTCTTGAAAGTTCAAAAGTATTGTTACAGCAGCATTGTGAAAATTTTCAGGTGAT<br>ATTATGTGATTTTTCTGGATTATATGTGTTGCAATTTAAGCATGGAAAAAATAGA<br>GAAACCGTTGAAAGACTATTTTGCAACATATTGCATGTTACAGATAGTCATCTTT<br>TATCAGATCCTCCTAGAAGTAGGAGCGTACCTGCAGCATTATTTTTTTTAAAAG<br>AAGTGTATCTAAAACATCTTATGTGTACAATAATTTGCCAGCGTGGGTGACAAA<br>GCTGACACAATTTAATCATCAGGTGGCAACACAGCCAGAAGCATTTGAGTTGTC<br>AAAAATGATTCAATGGGCGTATGACAATAGAATGACTGAAGAAGCAGAAATTG<br>CTTATGGTTATGCTTTATTAGCAGATGAAGATACAAATGCTGCTGCATTTTTAAA<br>AAGCAATGTTCAATTAAAATATGTTAGAGACTGCTGTACTATGGTAAAATTGTAC<br>TTCAGACAAGAAATGAGAGAAATGAGTATTTCACAGTGGATATGGAAGTGTTGT<br>AATGATTGTGAAGGCGAGGCAGACTGGAAACTTATACTTAATTTTCTAAAATTCC<br>AAAATATTAATGTAATACAATTCCTCACATGTTTAAGAACATTGTGTAAAAGAAT<br>TCCTAAAAAAATTGTATTTTATTCTATGGACCACCAGATACAGGAAAATCATTT<br>TTTGCCTACTCACTTGTTAAATTCTTACAAGGTAAAATATTGTCATTTGTAAATA<br>AAACAAGTAACTTCTGGTTACAGCCATTATTAGATTGTAAATTTGCACTGTTAGA<br>TGATGTGACTTATCCATGTTGGCAATACATTGATCAAACATGAGAGGAGCCTT<br>AGATGGCAATACAATGTGTGTAGATGCAAAACATAGAGTGCCACAACAAATTAA<br>ACTACCACCTTTGATATTAACCAGTAATATTGATGTTGTAAAGGAAGAATCCTTA<br>CAATATTTACATAGTAGGTTAATGTGCTTTGAATTTGCAAATAAGTTACCGTTTG<br>ATACTCATGGCATTCCTGTTTATAATTTTACTAATCAGGTGTGGAAGTGTTTCTTC<br>CAAAAACTGTCAAGACAATTAGACCTGGAAGAAGAAAACATCCAACATGAATC<br>AATCCAGATCTGACAGAACGTTTAGATGCATTGCAAACAGCCCTGATGAACATTT<br>ATGAAGAAGCACCAACTGATTTACCTTCGCAAATTAGACACTTTGATTTATTAAG |

TABLE 7-continued

Nucleic Acid Sequences of Vectors

SEQ ID NO Sequence

GAAACAAAGTGTACTTGAATATTATGTTAGAAAAGAAGGTTATACACAGTTGGG
CCTATATCATATTCCAACATTAAAGGTATCTGAATACCATGCCAAGGAAGCTATT
AAGATGGGAATTGTGCTTAGATCATTACAAAAATCACCCTATGCAGATGAAGAG
TGGTCTTTGCAAGATGTAAATGCTGACTTTTTTAATTCGCCTCCTAGAAATTGTTT
TAAAAAAGGAGGGTATGATGTAGAAGTTTGGTTTGATCATAATCCTTTAAATAC
ATTTCCATATACAAACTGGACATGGATATACTACCAGGATGATGAGGAAAATTG
GCATAAAGTTCAAGGAGAAACAGATTATAATGGGTTGTTTTATAGAGAAACGGA
TGGAACTGTAGTATACTTTTTATTATTTGAAAGTGATGCTGCCAGATATGGAACT
AAAAATGAGTGGACTGTGAATGTTAAAAATGAACAAATCTCCCTTCCTGCCAAC
AGCAACGGTCGGAGGTCTTCGTCTGGGACCCCAACTCACTCTACCACCAACTCTG
TCGCTGAGCCGGGGCCCTCCAGATCCACCGAGGAGGCCGACGGACGAAGAACG
CCACAAGCACAGACGCAGAGCGTTGGGGCTTCCAAAAAACCATCTTCGGTCGGA
CGACGAAGGCGACGAAAACAAGGAAAACAAACCCCCAGCAACGAAGACGAA
CTGGAGGAGGAAGCGGAGACGAAGCAGACAGCGGTGGAATCTCTGCTGAGGAA
GTTGGAAGTAGCCATCGATCAGTTGCACGATCAGGTCTATCGAGACTTGAACGA
CTTCAAAAGGAGGCTCGGGATCCGTATATAATACTTGTCAGAGGGCCTCAGAAT
ACATTAAAGTGTTGGAGGTATAGAATCCAAACAAAAGCCAATTTTCCCTTTCTTT
ATATAAGTACAGTATGGAAATGGGTGACTAAGGATGCTGTTGGACATGAGGGTC
GGGTACTTATTGCATTTTTAAGTAAAGAGTCCAGGGATTTATTTGCAAATTCTGT
GCATTTTCCTAAAAATACTACACATTCATATGGTTCTCTAGATGCTTTGTAATAA
TGATGCGAATACGTAGGAAACGGGCATCTCCTACAGATTTACATAGGAGTTGTG
CTTTAGGTGGGGATTGCTTTCCTGATGTTGAAAATAAACTTTCAGGCAATACTCT
TGCAGATATTTTATTAAAGGCATTTGGAAGTATTCTTTATTTGGGTAACTTGGGC
ATTGGAACTGGTAAGGGTGGTGGAGGTCAATATGGATACACACCTTTTGGAGGC
ACAAGGCCTAGCATATCCAGGGCTCCAGTAAGGCCTGCAATTCCTGTAGATACA
GTAGTTCCAGGTGAAGTATTACCAGTAACACCTTTGGATCCTGCTATTGTGCCAT
TAACAGATGGATTACCAGAACCTGCTGTAATAGATGTTCCTGGAGCTGGTCCTG
GTTTGCCTACAGAAACCATAGATGTGACAACTGAGTTAGATCTTGTTTCTGAAGT
AACTGGTGTTGGTGAACATCCTTCCGTTACATATGATACAAACAATGTAGCTCAG
ATAGATGTTCAAGTACAACCTCCTCCTCCCAAGCGGATTCTTTTAGATACTTCAA
TTACTGACACAGAATTAGCTGTGCAGACTCATGCATCACATGTTGATGAACATTA
CAATGTATTTGTTGATGCACAATTTCATGGGGAACATATAGGAGCTTTTGAACCT
GAAAGTATAGAATTACAAGAAATTAATTTAAGACAAGAATTTGAAATTGATGAG
GGCCCTTTAAGAAGTACTCCCTTATCATCCCGCGCAATCAGTCGAGCTAGAGATT
TGTATAATAGATATGTGCAACAAGTTCCAACAACACAACTCGCTTCCGTCTCTAC
CCCGAGGGTTACATTTGAATTCGAAAATCCCGCCTTTGAAGCTGAAATAGCTGA
CGTGTTCAACAGGGAGGTTCAGGAGTTAGCAACACAGGGGCAGGATGAGGCAG
GGACAGACCTAATTCGCTTAAGTGACATCAGATATGGCGAATCACCAGCGGGTA
CAGTCAGGGTTAGTAGGTTAGGTCAAAGGGAGGGAATGATTATGAGGAGTGGCT
TACAAGTAGGCCAACGTGTACATTTTTACTATGACATATCTCCTATACCTAAGGA
AGCTATAGAACTAAGAACATTTGGAGAGTATAGCCATGAATATACTGTAGTAGA
TGACCTAGCCAGTTCATCTTTTATAAATCCCTTGAACAACCGGTAGATGGCTCT
CTTGAATTTTCTGATGCAGCATTAATAGATTCAGTAGAAGAAGATTTTTCAGGCA
CACATTTAATTTTGACATCAGCAAATGCAGCTGATTCCATAGACATACCTGTAAT
CCCCCCGGGTATTGGTGTTAGGGTGTTTGTAGATGATTATGCCAAAGGACTATCA
GTATTACATCCTACTATAATAGATAACGGGGCTATATACCCCACAGACATAAGC
AGCAATATTTTACCTCTTACTCCATCATTTAGTATTGATGTTAATTACTCCGATTA
TAATATACATCCTGCTAATATAAGGCGCAAACGCAAACACTCCTCCTCTCTTTAC
TTTTAGATGGCTACTTGGACCCCTAACACTGGACGGCTTTATCTTCCTCCTGCTA
AACCTGTGGCGACTGTTCTATCGACTGATGATTATATTGTACCGACGAATCTTTA
TTTTCATGCCAATTCGGACAGACTGTTGACTGTTGGCCATCCTTACTTTGACGTTT
TGAATGACGCTACTAAAGCAATAGAGGTTCCAAAGGTGTCTGGAAATCAGTTTA
GAGTTTTAAGATTGAAGTTACCTGATCCTAATAAATTTGCTTTGATAGATAAGTC
TGTTTATAATCCAGAAAAGGAAAGGCTAGTATGGCGACTACGAGGTGTACAGAT
TGACAGAGGTGGTCCTCTAGGCATAGGAACGACTGGTCATCCGTTATTTGACAG
ATTGGCAGATACGGAAAATCCTAATGTTTATGCCCCTGCAGAGGTAGATGACAG
TAGACAAAATATGTCATTTGACCCCAAACAAAATCAGCTTTTTATAGTGGGTTGT
TTACCAGCAACAGGTCAGCATTGGGATATTGCTGAACCTTGCAAAGATCCAGCG
CCACCACCTAACTCCTGTCCACCTATAAAGTTGATGCATAGTATTATTCAAGACG
GGGACATGAGTGATATAGGTTTGGGTAATGTAAACTTCAATAATTTTTCAGCTTC
TAGATCTGATGCTCCTTTAGATGTTATAAACTCTGTTTGTAAATGGCCAGACTTT
GTTCAAATGACCAAAGATACTTATGGAGACAGAGTTTGGTTTTTGGTAAAAGA
GAACAAGTTTACACTAGACATATGCTTGTCAAAGGTGGTGTAGACGGAGACAGC
TTACCCCATGAACCTACAAGAGCTTATTATATTACTCCAAATACTGGTACATTAC
CAGATGGTAATTTAGGTAAAATCAGTTACTTTCCAACTCCTAGTGGTTCCCTGGT
CTCCAGTGAAGCCACAATTTTCAACAGGCCTTATTGGTTACATCAGGCTCAAGGA
AAAAATAATGGTATTGCATGGGTAATAATATTTTATAACCTTATTAGACAATA
CCCACAATACTAACTTTATATTATCAGTGTATACTGGTGCACGACCTATGGAGGA
GGGTTATACTTACAAGAAGGCTGATTTTAAAAAGTTTTTGCGTCACACTGAAGA
GTTAGAGCTTGAAATAGTTATGCAGCTCTGTAAGGTACCTTTAGAGGCTAATGTG
TTGGCCCACATCAATGCTATGGATCCTACTATACTTGAAAATTGGCAGTTAGCAT
TTGTTCCAGCGCCACCTCAGAACTTGGAGGACACTTACAGATATATTCAATCTCT
AGCAACAATGTGTCCTGCGGATGTCCCTCCAGCAAACAAACCAGATCCTTTTGA
GAAATATTCATTTTGGGATGTTGATTTAACTGATAAATTTACCTCAGAGTTGGAT
CAAACACCCTTTGGGACGCAAGTTCTTGTATACATGGGTATGCTAAATGGTAGG
AAGCGTCCCAGGGTAGATTACACTACAGGTAATACTACTGTGAAGCGCGTGGGC

TABLE 7-continued

Nucleic Acid Sequences of Vectors

SEQ ID NO Sequence

```
AAAACTGCTAAGAGAAGAAAAACTCGTATGTAATTCTTGTATTGTATTCATGTTA
TTAATTATGGTGTTTAACTGCATTCTGAGCCTGCACATATGTGTAATAATAAATT
ACATGTGAGTCATATGTTTGTGGGTATTTATTTACTGTGTGTGCGCTCGTACAGC
TAGTACTGACCCCTCTAGAAGCAACCACTGTTACTCTTCGCAGCCGACCGTTTTC
GGTAAGTCTAAAATTACCACTTTCGGTTGCCAAAGTTTACCGCCTTCGGTTGTTT
ACTGTCAAGACGACCGTTATCGGTTGGTGAGTCAGTAATCCCTTCAGCTGCATGT
TTCTGGCTGTTAGCCTTTGTACCGGGAGTGGTCACATACCTAGCTTTATTCAATA
GTTGTTAACAACAATTACCACTATAGGTTTTTTCAACCGTGTGCGGTTGCTATAA
AACCCTTCAGTGTCAGCAGATTCTTGCATTGCTG
```

In some embodiments, oligonucleotide probes disclosed herein hybridize to or are capable of hybridizing to any one of SEQ ID NO: 1406-SEQ ID NO: SEQ ID NO: 1458 as described below in TABLE 8, identifying each target nucleic acid as an accession number from GenBank.

TABLE 8

Nucleic Acid Sequences of Vectors, Accession Numbers, and Description

| SEQ ID NO | Accession Number | Date Last Modified | Description |
|---|---|---|---|
| SEQ ID NO: 1405 | | | gamma380:GFP lentivirus transfer plasmid |
| SEQ ID NO: 1406 | NC_002077.1 | 11 Mar. 10 | Adeno-associated virus 1 |
| SEQ ID NO: 1407 | NC_001401.2 | 28 Jun. 10 | Adeno-associated virus 2 |
| SEQ ID NO: 1408 | NC_001729.1 | 28 Jun. 10 | Adeno-associated virus 3 |
| SEQ ID NO: 1409 | NC_001829.1 | 28 Jan. 10 | Adeno-associated virus 4 |
| SEQ ID NO: 1410 | AF085716 | 9 Feb. 99 | Adeno-associated virus 5 |
| SEQ ID NO: 1411 | AF028704 | 12 Jan. 98 | Adeno-associated virus 6 |
| SEQ ID NO: 1412 | NC_006260.1 | 11 Mar. 10 | Adeno-associated virus 7 |
| SEQ ID NO: 1413 | NC_006261.1 | 11 Mar. 10 | Adeno-associated virus 8 |
| SEQ ID NO: 1414 | AY530579 | 24 Jun. 04 | Adeno-associated virus 9 |
| SEQ ID NO: 1415 | AY631965 | 30 Nov. 04 | Adeno-associated virus 10 |
| SEQ ID NO: 1416 | AY631966 | 30 Nov. 04 | Adeno-associated virus 11 |
| SEQ ID NO: 1417 | DQ813647 | 20 Feb. 08 | Adeno-associated virus 12 |
| SEQ ID NO: 1418 | EU285562 | 23 Sep. 08 | Adeno-associated virus 13 |
| SEQ ID NO: 1419 | pAAV-DJ (VPK-420-DJ (PN-340001)) | | VPK-420-DJ (PN-340001) |
| SEQ ID NO: 1420 | LC314153 | 25 Apr. 18 | Human mastadenovirus D |
| SEQ ID NO: 1421 | MF416150 | 1 Oct. 17 | Human mastadenovirus D |
| SEQ ID NO: 1422 | KX827426.1 | 28 Apr. 17 | Human mastadenovirus D |
| SEQ ID NO: 1423 | LC066535.1 | 21 Jun. 17 | Human mastadenovirus D |
| SEQ ID NO: 1424 | AB765926.1 | 30 Mar. 17 | Human adenovirus 81 |
| SEQ ID NO: 1425 | LC177352 | 20 Oct. 17 | Human mastadenovirus B |
| SEQ ID NO: 1426 | KT970440 | 30 Sep. 16 | Human mastadenovirus B |
| SEQ ID NO: 1427 | KF268328 | 16 Dec. 13 | Human mastadenovirus B |
| SEQ ID NO: 1428 | KF633445 | 16 Sep. 13 | Human mastadenovirus B |

TABLE 8-continued

Nucleic Acid Sequences of Vectors, Accession Numbers, and Description

| SEQ ID NO | Accession Number | Date Last Modified | Description |
|---|---|---|---|
| SEQ ID NO: 1429 | KY618678 | 14 Nov. 17 | Human mastadenovirus D |
| SEQ ID NO: 1430 | KY618677 | 14 Nov. 17 | Human mastadenovirus D |
| SEQ ID NO: 1431 | KY618676 | 14 Nov. 17 | Human mastadenovirus D |
| SEQ ID NO: 1432 | KF268335 | 8 Jun. 15 | Human mastadenovirus D |
| SEQ ID NO: 1433 | KF268207 | 21 Apr. 15 | Human adenovirus 71 |
| SEQ ID NO: 1434 | KP641339 | 8 Jun. 15 | Human mastadenovirus D |
| SEQ ID NO: 1435 | JN226748 | 23 Jan. 15 | Human adenovirus 69 |
| SEQ ID NO: 1436 | JN860678 | 15 Nov. 12 | Human adenovirus 68 |
| SEQ ID NO: 1437 | AP012302 | 15 Mar. 13 | Human adenovirus 67 |
| SEQ ID NO: 1438 | JN860676 | 31 May 13 | Human adenovirus 66 |
| SEQ ID NO: 1439 | AP012285 | 25 Apr. 12 | Human adenovirus 65 |
| SEQ ID NO: 1440 | EF121005 | 10 Feb. 12 | Human adenovirus 64 |
| SEQ ID NO: 1441 | JN935766 | 29 Mar. 12 | Human adenovirus 63 |
| SEQ ID NO: 1442 | JN162671 | 28 Feb. 14 | Human adenovirus 62 |
| SEQ ID NO: 1443 | JF964962 | 6 Feb. 12 | Human adenovirus 61 |
| SEQ ID NO: 1444 | HQ007053 | 19 Apr. 13 | Human mastadenovirus D |
| SEQ ID NO: 1445 | JF799911 | 17 Apr. 12 | Human mastadenovirus D |
| SEQ ID NO: 1446 | HQ883276 | 24 Aug. 12 | Human adenovirus 58 |
| SEQ ID NO: 1447 | HQ003817 | 20 Dec. 17 | Human mastadenovirus C |
| SEQ ID NO: 1448 | HM770721 | 30 Oct. 14 | Human adenovirus 56 |
| SEQ ID NO: 1449 | FJ643676 | 2 Feb. 10 | Human adenovirus 55 |
| SEQ ID NO: 1450 | AB333801 | 6 Aug. 09 | Human adenovirus 54 |
| SEQ ID NO: 1451 | FJ169625 | 17 Apr. 12 | Human mastadenovirus D |
| SEQ ID NO: 1452 | NC_001362 | 26 Jul. 16 | Friend murine leukemia virus |
| SEQ ID NO: 1453 | NC_001501 | 20 Nov. 17 | Moloney murine leukemia virus |
| SEQ ID NO: 1454 | NC_001702 | 5 Feb. 11 | Murine type C retrovirus |
| SEQ ID NO: 1455 | KX087159.1 | 25 Jun. 18 | Eastern chimpanzee simian foamy virus |
| SEQ ID NO: 1456 | MF280817.1 | 2 Jul. 17 | Macaque simian foamy virus |
| SEQ ID NO: 1457 | Y08851.1 | 19 Jun. 06 | Feline foamy virus |
| SEQ ID NO: 1458 | NC_013035 | 23 Dec. 10 | Human papillomavirus 116 |

B. Detectable Moieties

A detecting agent may comprise a detectable moiety. A detectable moiety may be a small molecule (such as a dye) or a macromolecule. A macromolecule may include polypeptides (such as proteins and/or protein fragments), nucleic acids, carbohydrates, lipids, macrocycles, polyphenols, and/or endogenous macromolecule complexes. A detectable moiety may be a small molecule. A detectable moiety may be a macromolecule.

A detectable moiety may include a moiety that is detectable by a colorimetric method or a fluorescent method. For example, a colorimetric method may be an assay which utilizes reagents that undergo a measurable color change in the presence of an analyte (such as an enzyme, an antibody, a compound, a hormone). Exemplary colorimetric method may include enzyme-mediated detection method such as tyramide signal amplification (TSA) which utilizes horseradish peroxidase (HRP) to generate a signal when digested by tyramide substrate and 3,3',5,5'-Tetramethylbenzidine (TMB) which generates a blue color upon oxidation to 3,3'5,5'-tetramethylbenzidine diamine in the presence of a peroxidase enzyme such as HRP. A detectable moiety described herein may include a moiety that is detectable by a colorimetric method.

A detectable moiety may also include a moiety that is detectable by a fluorescent method. Sometimes, the detectable moiety may be a fluorescent moiety. A fluorescent moiety may be a small molecule (such as a dye) or a fluorescently labeled macromolecule. A fluorescently labeled macromolecule may include a fluorescently labeled polypeptide (such as a labeled protein and/or a protein fragment), a fluorescently labeled nucleic acid molecule, a fluorescently labeled carbohydrate, a fluorescently labeled lipid, a fluorescently labeled macrocycle, a fluorescently labeled polyphenol, and/or a fluorescently labeled endogenous macromolecule complex (such as a primary antibody-secondary antibody complex).

A fluorescent small molecule may comprise rhodamine, rhodol, fluorescein, thiofluorescein, aminofluorescein, carboxyfluorescein, chlorofluorescein, methylfluorescein, sulfofluorescein, aminorhodol, carboxyrhodol, chlororhodol, methylrhodol, sulforhodol; aminorhodamine, carboxyrhodamine, chlororhodamine, methylrhodamine, sulforhodamine, thiorhodamine, cyanine, indocarbocyanine, oxacarbocyanine, thiacarbocyanine, merocyanine, cyanine 2, cyanine 3, cyanine 3.5, cyanine 5, cyanine 5.5, cyanine 7, oxadiazole derivatives, pyridyloxazole, nitrobenzoxadiazole, benzoxadiazole, pyren derivatives, cascade blue, oxazine derivatives, Nile red, Nile blue, cresyl violet, oxazine 170, acridine derivatives, proflavin, acridine orange, acridine yellow, arylmethine derivatives, auramine, crystal violet, malachite green, tetrapyrrole derivatives, porphin, phtalocyanine, bilirubin 1-dimethylaminonaphthyl-5-sulfonate, 1-anilino-8-naphthalene sulfonate, 2-p-touidinyl-6-naphthalene sulfonate, β-phenyl-7-isocyanatocoumarin, N-(p-(2-benzoxazolyl)phenyl)maleimide, stilbenes, pyrenes, 6-FAM (Fluorescein), 6-FAM (NHS Ester), 5(6)-FAM, 5-FAM, Fluorescein dT, 5-TAMRA-cadavarine, 2-aminoacridone, HEX, JOE (NHS Ester), MAX, TET, ROX, TAMRA, TARMA™ (NHS Ester), TEX 615, ATTO™ 488, ATTO™ 532, ATTO™ 550, ATTO™ 565, ATTO™ Rho101, ATTO™ 590, ATTO™ 633, ATTO™ 647N, TYE™ 563, TYE™ 665, or TYE™ 705.

A fluorescent moiety may comprise Cy3, Cy5, Cy5.5, Cy7, Q570, Alexa488, Alexa555, Alexa594, Alexa647, Alexa680, Alexa 750, Alexa 790, Atto488, Atto532, Atto647N, TexasRed, CF610, Propidium iodide, Quasar 570 (Q570), Quasar 670 (Q670), IRDye700, IRDye800, Indocyanine green, Pacific Blue dye, Pacific Green dye, or Pacific Orange dye.

A fluorescent moiety may comprise a quantum dot (QD). Quantum dots may be a nanoscale semiconducting photoluminescent material, for example, as described in Alivisatos A. P., "Semiconductor clusters, nanocrystals, and quantum dots," *Science* 271(5251): 933-937 (1996).

Exemplary QDs may include, but are not limited to, CdS quantum dots, CdSe quantum dots, CdSe/CdS core/shell quantum dots, CdSe/ZnS core/shell quantum dots, CdTe quantum dots, PbS quantum dots, and/or PbSe quantum dots. As used herein, CdSe/ZnS may mean that a ZnS shell is coated on a CdSe core surface (a "core-shell" quantum dot). The shell materials of core-shell QDs may have a higher bandgap and passivate the core QDs surfaces, resulting in higher quantum yield and higher stability and wider applications than core QDs.

QDs may absorb a wide spectrum of light, and may be physically tuned with emission bandwidths in various wavelengths. See, e.g., Badolato, et al., *Science* 208:1158-61 (2005). For example, the emission bandwidth may be in the visible spectrum (from about 350 to about 750 nm), the ultraviolet-visible spectrum (from about 100 nm to about 750 nm), or in the near-infrared spectrum (from about 750 nm to about 2500 nm). QDs that emit energy in the visible range may include, but are not limited to, CdS, CdSe, CdTe, ZnSe, ZnTe, GaP, and GaAs. QDs that emit energy in the blue to near-ultraviolet range include, but are not limited to, ZnS and GaN. QDs that emit energy in the near-infrared range include, but are not limited to, InP, InAs, InSb, PbS, and PbSe.

The radius of a QD may be modulated to manipulate the emission bandwidth. For example, a radius of between about 5 and about 6 nm QD may emit wavelengths resulting in emission colors such as orange or red. A radius of between about 2 and about 3 nm may emit wavelengths resulting in emission colors such as blue or green.

A QD may further form a QD microstructure, which encompasses one or more layers of QD. For example, each quantum dot containing layer may comprise a single type of quantum dot of a specific emission color. For example, each layer may be made of any material suitable for use that (a) allows excitation light to reach the quantum dot and allows fluorescence generated from the quantum dot to pass through the layer(s) for detection and (b) may be combined with a quantum dot to form a layer. Examples of materials that may be used to form layers containing quantum dots include, but are not limited to, inorganic, organic, or polymeric material, each with or without biodegradable properties, and combinations thereof. The layers may comprise silica-based compounds or polymers. Exemplary silica-based layers may include, but are not limited to, those comprising tetramethoxy silane or tetraethylorthosilicate. Exemplary polymer layers may include, but are not limited to, those comprising polystyrene, poly (methyl methacrylate), polyhydroxyalkanoate, polylactide, or co-polymers thereof.

The quantum dot further may comprise a spacer layer which serves as a barrier to prevent interactions between different QD layers, and may be made of any material suitable for use that (a) allows excitation light to reach the quantum dots in the quantum dot containing layer(s) below it and allows fluorescence generated from those quantum dots to pass through it and (b) may segregate the quantum dots in one layer from those in other layers. Examples of materials that may be used to form spacer layers are the same as for the quantum dot containing layers.

The materials used for the quantum dot containing and spacer layers may be the same or different. The same material may be used in the quantum dot containing layers and the spacer layers.

The quantum dot containing layers and the spacer layers within a given QD molecule may be any thickness and may be varied. For example, thicker QD-containing layers may allow for the loading of increased QDs in the shell, resulting in greater fluorescence intensity for that layer than for a thinner layer containing the same concentration of QDs. Thus, varying layer thickness may facilitate preparing QD-containing layer of various intensities, thereby generating spectrally distinct QD bar codes. In various instances, the QD-containing layers may be between 5 nm and 500 nm; 10 nm and 500 nm; 5 nm and 100 nm, and 10 nm and 100 nm. Those of skill in the art will understand that other methods for varying intensity also exist, for example, modifying concentrations of the same QD in one microstructure with a first unique barcode compared to a second QD microstructure with a different fluorescent barcode. The ability to vary the intensities for the same QD color allows for an increased number of distinct and distinguishable microstructures (e.g., spectrally distinct barcodes). The spacer layers may be greater than 10 nm, up to approximately 5 µm thick; the spacer layers may be greater than 10 nm, up to approximately 500 nm thick; the space layers may be greater than 10 nm, up to approximately 100 nm thick.

The quantum dot-containing and spacer layers may be arranged in any order. Examples include, but are not limited to, alternating QD-containing layers and spacer layers, or quantum dot containing layers separated by more than one spacer layer. Thus, a "spacer layer" may comprise a single layer, or may comprise two or more such spacer layers.

The QD microstructure may comprise any number of quantum dot containing layers suitable for use with the microstructure. For example, a microstructure described herein may comprise 2, 3, 4, 5, 6, 7, 8, 9, 10, or more quantum dot-containing layers and an appropriate number of spacer layers based on the number of quantum dot-containing layers. Further, the number of quantum dot containing layers in a given microstructure may range from 1 to "m," where "m" is the number of quantum dots that may be used.

A defined intensity level may refer to a known amount of quantum dots in each quantum dot containing layer, resulting in a known amount of fluorescent intensity generated from the QD containing layer upon appropriate stimulation. Since each QD containing layer has a defined intensity level, each microstructure may possess a defined ratio of fluorescence intensities generated from the various QD-containing layers upon stimulation. This defined ratio is referred to herein as a barcode. Thus, each type of microstructure with the same QD layers possesses a similar barcode that may be distinguished from microstructures with different QD layers.

Thus, each quantum dot containing layer may comprise a single type of quantum dot of a specific emission color and the layer is produced to possess a defined intensity level, based on the concentration of the QD in the layer. By varying the intensity levels of QDs ("n") in different microstructures and using a variety of different quantum dots ("m"), the number of different unique barcodes (and thus the number of different unique microstructure populations that may be produced) is approximated by the equation, ($n^m-1$) unique codes. This may provide the ability to generate a large number of different populations of microstructures each with its own unique barcode.

A set of QD-labeled probes may further generate a spectrally distinct barcode. For example, each probe with the set of QD-labeled probes may comprise a QD with a distinct excitation wavelength and the combination of the set may generate a distinct barcode. A set of spectrally distinct QD-labeled probes may be utilized to detect a regulatory element. As such, when detecting two or more regulatory elements, each regulatory element may be spectrally barcoded.

A quantum dot provided herein may include QDot525, QDot 545, QDot 565, QDot 585, QDot 605, or QDot 655. A probe described herein may comprise a quantum dot. A probe described herein may comprise QDot525, QDot 545, QDot 565, QDot 585, QDot 605, or QDot 655. A probe described herein may comprise QDot525. A probe described herein may comprise QDot 545. A probe described herein may comprise QDot 565. A probe described herein may comprise QDot 585. A probe described herein may comprise QDot 605. A probe described herein may comprise QDot 655.

A quantum dot may comprise a quantum dot as described in Han et al., "Quantum-dot-tagged microbeads for multiplexed optical coding of biomolecules," *Nat. Biotechnol.* 19:631-635 (2001); Gao X., "QD barcodes for biosensing and detection," *Conf Proc IEEE Eng Med Biol Soc* 2009: 6372-6373 (2009); and Zrazhevskiy, et al., "Multicolor multicycle molecular profiling with quantum dots for single-cell analysis," *Nat Protoc* 8:1852-1869 (2013).

A QD may further comprise a functional group or attachment moiety. One example of such a QD that has a functional group or attachment moiety is a QD with a carboxylic acid terminated surface, such as those commercially available though, for example, Quantum Dot, Inc., Hayward, Calif.

C. Conjugating Moiety

The probe may include a conjugating moiety. The conjugation moiety may be attached at the 5' terminus, the 3' terminus, or at an internal site. The conjugating moiety may be a nucleotide analog (such as bromodeoxyuridine). The conjugating moiety may be a conjugating functional group. The conjugating functional group may be an azido group or an alkyne group. The probe may further be derivatized through a chemical reaction such as click chemistry. The click chemistry may be a copper(I)-catalyzed [3+2]-Huisgen 1,3-dipolar cyclo-addition of alkynes and azides leading to 1,2,3-triazoles. The click chemistry may be a copper free variant of the above reaction. The click chemistry may be an inverse electron-demand Diels-Alder reaction between a trans-cyclooctadiene and a tetrazine.

The conjugating moiety may comprise a hapten group. A hapten group may include digoxigenin, 2,4-dinitrophenyl, biotin, avidin, or are selected from azoles, nitroaryl compounds, benzofurazans, triterpenes, ureas, thioureas, rotenones, oxazoles, thiazoles, coumarins, cyclolignans, heterobiaryl compounds, azoaryl compounds or benzodiazepines. A hapten group may include biotin.

The probe comprising the conjugating moiety may further be linked to a second probe (such as a nucleic acid probe or a polypeptide probe), a fluorescent moiety (such as a dye such as a quantum dot), a target nucleic acid, or a conjugating partner such as a polymer (such as PEG), a macromolecule (such as a carbohydrate, a lipid, a polypeptide), and the like.

Samples

A sample described herein may be a fresh sample or a fixed sample. The sample may be a fresh sample. The sample may be a fixed sample. The sample may be a live sample. The sample may be subjected to a denaturing condition. The sample may be cryopreserved.

The sample may be a cell sample. The cell sample may be obtained from the cells or tissue of an animal. The animal cell may comprise a cell from an invertebrate, fish, amphibian, reptile, or mammal. The mammalian cell may be obtained from a primate, ape, equine, bovine, porcine, canine, feline, or rodent. The mammal may be a primate, ape, dog, cat, rabbit, ferret, or the like. The rodent may be a mouse, rat, hamster, gerbil, hamster, chinchilla, or guinea pig. The bird cell may be from a canary, parakeet, or parrot. The reptile cell may be from a turtle, lizard, or snake. The fish cell may be from a tropical fish. For example, the fish cell may be from a zebrafish (such as *Danio rerio*). The amphibian cell may be from a frog. An invertebrate cell may be from an insect, arthropod, marine invertebrate, or worm. The worm cell may be from a nematode (such as *Caenorhabditis elegans*). The arthropod cell may be from a tarantula or hermit crab.

The cell sample may be obtained from a mammalian cell. For example, the mammalian cell may be an epithelial cell, connective tissue cell, hormone secreting cell, a nerve cell, a skeletal muscle cell, a blood cell, an immune system cell, or a stem cell. A cell may be a fresh cell, live cell, fixed cell, intact cell, or cell lysate.

Cell samples may be cells derived from a cell line. Exemplary cell lines include, but are not limited to, 293A cell line, 293FT cell line, 293F cell line, 293 H cell line, HEK 293 cell line, CHO DG44 cell line, CHO—S cell line, CHO-K1 cell line, Expi293F™ cell line, Flp-In™ T-REx™ 293 cell line, Flp-In™-293 cell line, Flp-In™-3T3 cell line, Flp-In™-BHK cell line, Flp-In™-CHO cell line, Flp-In™-CV-1 cell line, Flp-In™-Jurkat cell line, FreeStyle™ 293-F cell line, FreeStyle™ CHO—S cell line, GripTite™ 293 MSR cell line, GS-CHO cell line, HepaRG™ cell line, T-REx™ Jurkat cell line, Per.C6 cell line, T-REx™-293 cell line, T-REx™-CHO cell line, T-REx™-HeLa cell line, NC-HIMT cell line, and PC12 cell line.

The cell sample may be obtained from cells of a primate. The primate may be a human, or a non-human primate. The cell sample may be obtained from a human. For example, the cell sample may comprise cells obtained from blood, urine, stool, saliva, lymph fluid, cerebrospinal fluid, synovial fluid, cystic fluid, ascites, pleural effusion, amniotic fluid, chorionic villus sample, vaginal fluid, interstitial fluid, buccal swab sample, sputum, bronchial lavage, Pap smear sample, or ocular fluid. The cell sample may comprise cells obtained from a blood sample, an aspirate sample, or a smear sample.

The cell sample may be a circulating tumor cell sample. A circulating tumor cell sample may comprise lymphoma cells, fetal cells, apoptotic cells, epithelia cells, endothelial cells, stem cells, progenitor cells, mesenchymal cells, osteoblast cells, osteocytes, hematopoietic stem cells (HSC) (e.g., a CD34+ HSC), foam cells, adipose cells, transcervical cells, circulating cardiocytes, circulating fibrocytes, circulating cancer stem cells, circulating myocytes, circulating cells from a kidney, circulating cells from a gastrointestinal tract, circulating cells from a lung, circulating cells from reproductive organs, circulating cells from a central nervous system, circulating hepatic cells, circulating cells from a spleen, circulating cells from a thymus, circulating cells from a thyroid, circulating cells from an endocrine gland, circulating cells from a parathyroid, circulating cells from a pituitary, circulating cells from an adrenal gland, circulating cells from islets of Langerhans, circulating cells from a pancreas, circulating cells from a hypothalamus, circulating cells from prostate tissues, circulating cells from breast tissues, circulating cells from circulating retinal cells, circulating ophthalmic cells, circulating auditory cells, circulating epidermal cells, circulating cells from the urinary tract, or combinations thereof.

The cell can be a T cell. For example, in some embodiments, the T cell can be an engineered T cell transduced to express a chimeric antigen receptor (CAR). The CAR T cell can be engineered to bind to BCMA, CD19, CD22, WT1, L1CAM, MUC16, ROR1, or LeY.

A cell sample may be a peripheral blood mononuclear cell sample.

A cell sample may comprise cancerous cells. The cancerous cells may form a cancer which may be a solid tumor or a hematologic malignancy. The cancerous cell sample may comprise cells obtained from a solid tumor. The solid tumor may include a sarcoma or a carcinoma. Exemplary sarcoma cell sample may include, but are not limited to, cell sample obtained from alveolar rhabdomyosarcoma, alveolar soft part sarcoma, ameloblastoma, angio sarcoma, chondrosarcoma, chordoma, clear cell sarcoma of soft tissue, dedifferentiated liposarcoma, desmoid, desmoplastic small round cell tumor, embryonal rhabdomyosarcoma, epithelioid fibrosarcoma, epithelioid hemangioendothelioma, epithelioid sarcoma, esthesioneuroblastoma, Ewing sarcoma, extrarenal rhabdoid tumor, extraskeletal myxoid chondrosarcoma, extraskeletal osteosarcoma, fibrosarcoma, giant cell tumor, hemangiopericytoma, infantile fibrosarcoma, inflammatory myofibroblastic tumor, Kaposi sarcoma, leiomyo sarcoma of bone, liposarcoma, liposarcoma of bone, malignant fibrous histiocytoma (MFH), malignant fibrous histiocytoma (MFH) of bone, malignant mesenchymoma, malignant peripheral nerve sheath tumor, mesenchymal chondrosarcoma, myxofibrosarcoma, myxoid liposarcoma, myxoinflammatory fibroblastic sarcoma, neoplasms with perivascular epitheioid cell differentiation, osteosarcoma, parosteal osteosarcoma, neoplasm with perivascular epitheioid cell differentiation, periosteal osteosarcoma, pleomorphic liposarcoma, pleomorphic rhabdomyosarcoma, PNET/extraskeletal Ewing tumor, rhabdomyosarcoma, round cell liposarcoma, small cell osteosarcoma, solitary fibrous tumor, synovial sarcoma, or telangiectatic osteosarcoma.

Exemplary carcinoma cell samples may include, but are not limited to, cell samples obtained from an anal cancer, appendix cancer, bile duct cancer (i.e., cholangiocarcinoma), bladder cancer, brain tumor, breast cancer, cervical cancer, colon cancer, cancer of Unknown Primary (CUP), esophageal cancer, eye cancer, fallopian tube cancer, gastroenterological cancer, kidney cancer, liver cancer, lung cancer, medulloblastoma, melanoma, oral cancer, ovarian cancer, pancreatic cancer, parathyroid disease, penile cancer, pituitary tumor, prostate cancer, rectal cancer, skin cancer, stomach cancer, testicular cancer, throat cancer, thyroid cancer, uterine cancer, vaginal cancer, or vulvar cancer.

The cancerous cell sample may comprise cells obtained from a hematologic malignancy. Hematologic malignancy may comprise a leukemia, a lymphoma, a myeloma, a non-Hodgkin's lymphoma, or a Hodgkin's lymphoma. The hematologic malignancy may be a T cell based hematologic malignancy. The hematologic malignancy may be a B-cell based hematologic malignancy. Exemplary B-cell based hematologic malignancy may include, but are not limited to, chronic lymphocytic leukemia (CLL), small lymphocytic lymphoma (SLL), high risk CLL, a non-CLL/SLL lymphoma, prolymphocytic leukemia (PLL), follicular lymphoma (FL), diffuse large B-cell lymphoma (DLBCL), mantle cell lymphoma (MCL), Waldenstrom's macroglobulinemia, multiple myeloma, extranodal marginal zone B cell lymphoma, nodal marginal zone B cell lymphoma, Burkitt's lymphoma, non-Burkitt high grade B cell lymphoma, primary mediastinal B-cell lymphoma (PMBL), immunoblastic large cell lymphoma, precursor B-lymphoblastic lymphoma, B cell prolymphocytic leukemia, lymphoplasmacytic lymphoma, splenic marginal zone lymphoma, plasma cell myeloma, plasmacytoma, mediastinal (thymic) large B cell lymphoma, intravascular large B cell lymphoma, primary effusion lymphoma, or lymphomatoid granulomatosis. Exemplary T cell based hematologic malignancy may include, but are not limited to, peripheral T cell lymphoma not otherwise specified (PTCL-NOS), anaplastic large cell lymphoma, angioimmunoblastic lymphoma, cutaneous T cell lymphoma, adult T cell leukemia/lymphoma (ATLL), blastic NK-cell lymphoma, enteropathy-type T cell lymphoma, hematosplenic gamma-delta T cell lymphoma, lymphoblastic lymphoma, nasal NK/T cell lymphomas, or treatment-related T cell lymphomas.

A cell sample described herein may comprise a tumor cell line sample. Exemplary tumor cell line sample may include, but are not limited to, cell samples from tumor cell lines such as 600MPE, AU565, BT-20, BT-474, BT-483, BT-549, Evsa-T, Hs578T, MCF-7, MDA-MB-231, SkBr3, T-47D, HeLa, DU145, PC3, LNCaP, A549, H1299, NCI-H460, A2780, SKOV-3/Luc, Neuro2a, RKO, RKO-AS45-1, HT-29, SW1417, SW948, DLD-1, SW480, Capan-1, MC/9, B72.3, B25.2, B6.2, B38.1, DMS 153, SU.86.86, SNU-182, SNU-423, SNU-449, SNU-475, SNU-387, Hs 817.T, LMH, LMH/2A, SNU-398, PLHC-1, HepG2/SF, OCI-Ly1, OCI-Ly2, OCI-Ly3, OCI-Ly4, OCI-Ly6, OCI-Ly7, OCI-Ly10, OCI-Ly18, OCI-Ly19, U2932, DB, HBL-1, RIVA, SUDHL2, TMD8, MEC1, MEC2, 8E5, CCRF-CEM, MOLT-3, TALL-104, AML-193, THP-1, BDCM, HL-60, Jurkat, RPMI 8226, MOLT-4, RS4, K-562, KASUMI-1, Daudi, GA-10, Raji, JeKo-1, NK-92, and Mino.

A cell sample may comprise cells obtained from a biopsy sample, necropsy sample, or autopsy sample.

The cell samples (such as a biopsy sample) may be obtained from an individual by any suitable means of obtaining the sample using well-known and routine clinical methods. Procedures for obtaining tissue samples from an individual are well known. For example, procedures for drawing and processing tissue sample such as from a needle aspiration biopsy are well-known and may be employed to obtain a sample for use in the methods provided. Typically, for collection of such a tissue sample, a thin hollow needle is inserted into a mass such as a tumor mass for sampling of cells that, after being stained, will be examined under a microscope.

A cell may be a live cell. A cell may be a eukaryotic cell. A cell may be a yeast cell. A cell may be a plant cell. A cell may be obtained from an agricultural plant.

A cell may be a transduced cell. A cell may be a transduced immune cell. A cell may be a transduced T cell. In some embodiments, the transduced cells can be sampled for Nano-FISH several days after transduction. In some embodiments, Nano-FISH can be performed at least 1-3 days after transduction. In some embodiments, Nano-FISH can be performed at least β-5 days after transduction. In some embodiments, Nano-FISH can be performed at least 5-7 days after transduction. In some embodiments, Nano-FISH can be performed at least 7-10 days after transduction. In some embodiments, Nano-FISH can be performed 3 days after transduction. In some embodiments, Nano-FISH can be performed 4 days after transduction. In some embodiments, Nano-FISH can be performed 5 days after transduction. In some embodiments, Nano-FISH can be performed 6 days after transduction. In some embodiments, the transduced cells of the present disclosure can be stored prior to Nano-FISH experiments while showing the same results as cells that were not stored prior to Nano-FISH. In some embodiments, the transduced cells of the present disclosure can be stored at temperatures of −196° C. (cryopreserved) for several weeks before conducting Nano-FISH while showing the same results compared to cells that were not frozen and thawed before the Nano-FISH experiment. In some embodiments, the transduced cells of the present disclosure can be stored at temperatures of from −200-190° C. (cryopreserved) for several weeks before conducting Nano-FISH while showing the same results compared to cells that were not frozen and thawed before the Nano-FISH experiment. In some embodiments, the transduced cells can be cryopreserved for at least 1 week. In some embodiments, the transduced cells can be cryopreserved for at least 3 weeks. In some embodiments, the transduced cells can be cryopreserved for at least 5 weeks. In some embodiments, the transduced cells can be cryopreserved for at least 7 week.

For transduction of a cell, a cell, such as an immune cell (e.g., T cell) of the present disclosure, can require 10-300 units (U) of IL-2 per mL medium for stimulation. In some embodiments, an immune cell can require IL-2 in concentrations of at least 10 U/mL. In some embodiments, an immune cell can require IL-2 in concentrations of at least 20 U/mL. In some embodiments, an immune cell can require IL-2 in concentrations of at least 50 U/mL. In some embodiments, an immune cell can require IL-2 in concentrations of at least 100 U/mL. In some embodiments, an immune cell can require IL-2 in concentrations of at least 200 U/mL. In some embodiments, an immune cell can require IL-2 in concentrations of 20-200 U/mL.

In some embodiments, the time of exposure to cytokines (e.g., IL-2) prior to transduction can alter the number of viral integrants per cell. In some embodiments, the number of viral integrants per cell can be increased when the time of exposure to cytokines (e.g., IL-2) prior to transduction is increased. In some embodiments, the time of exposure to cytokines (e.g., IL-2) prior to transduction can range from about 2 hrs to about 100 hrs. In some embodiments, the time of exposure to cytokines (e.g., IL-2) prior to transduction is about 12 hours. In some embodiments, the time of exposure to cytokines (e.g., IL-2) prior to transduction is about 24 hours. In some embodiments, the time of exposure to cytokines (e.g., IL-2) prior to transduction is about 48 hours. In some embodiments, the time of exposure to cytokines (e.g., IL-2) prior to transduction is about 72 hours. In some embodiments, the time of exposure to cytokines (e.g., IL-2) prior to transduction is about 96 hours.

In some embodiments of the present disclosure, cationic molecules can be used in combination with the compositions and methods of the present disclosure for cell transduction. In some embodiments, cationic compounds such as protamine, poly-L-lysine, or cationic liposomes and various salts thereof such as hydrogensulfates, hydrochlorides, hydrobromides, can be used to initiate or improve the transduction efficacy of a viral vector. In some embodiments, various concentrations of protamine sulfate can be used to initiate or improve the transfection efficacy of a viral vector as described herein. In some embodiments, the concentrations of protamine sulfate can range from 0-50 µg/mL. In some embodiments, the concentration of protamine sulfate can be from 0-5 µg/mL. In some embodiments, the concentration of protamine sulfate can be from 5-10 µg/mL. In some embodiments, the concentration of protamine sulfate can be from 10-12 µg/mL. In some embodiments, the concentration of protamine sulfate can be from 10-20 µg/mL. In some embodiments, the concentration of protamine sulfate can be from 20-30 µg/mL. In some embodiments, the concentration of protamine sulfate can be from 30-50 µg/mL. In some embodiments, the concentration of protamine sulfate can be 5 µg/mL. In some embodiments, the concentration of protamine sulfate can be 6 µg/mL. In some embodiments, the concentration of protamine sulfate can be 7 µg/mL. In some embodiments, the concentration of protamine sulfate can be 8 µg/mL. In some embodiments, the concentration of protamine sulfate can be 9 µg/mL. In some embodiments, the concentration of protamine sulfate can be 10 µg/mL.

In some embodiments of the present disclosure, other compounds can be used to enhance the transduction efficacy of a viral vector. For example, compounds that can facilitate colocalization of target cells and virus particles can be used to enhance the transduction efficacy of a viral vector. In some embodiments, the target cells can be suspension cells or adherent cells. In some embodiments, the target cells can be suspension cells such as hematopoietic cells (e.g., CD34+ cells). Compounds that can be used to improve transduction efficiency by facilitating colocalization of target cells and virus particles may include the recombinant human fibronectin fragment retronectin. In some embodiments of the present disclosure, the concentrations of retronectin can range from 0-100 μg/mL. In some embodiments, the concentration of retronectin is from 0-5 μg/mL. In some embodiments, the concentration of retronectin is from 5-15 μg/mL. In some embodiments, the concentration of retronectin is from 10-30 μg/mL. In some embodiments, the concentration of retronectin is from 25-45 μg/mL. In some embodiments, the concentration of retronectin is from 40-50 μg/mL. In some embodiments, the concentration of retronectin is from 50-75 μg/mL. In some embodiments, the concentration of retronectin is from 75-100 μg/mL. In some embodiments, the concentration of retronectin is from 50 μg/mL.

In some embodiments of the present disclosure, the ratio of added viral vectors to the amount of target cells can range from 0-1000 for cell transduction. In other words, the multiplicity of infection (MOI) that can be used in combination with for cell transduction can range from 0-1000. In some embodiments, the MOI can be 0, thus no viral vector is added. In some embodiments, the MOI can be from 1-5. In some embodiments, the MOI can be 5. In some embodiments, the MOI can be from 5-10. In some embodiments, the MOI can be 10. In some embodiments, the MOI can be from 10-20. In some embodiments, the MOI can be from 20-50. In some embodiments, the MOI can be from 25. In some embodiments, the MOI can be from 35. In some embodiments, the MOI can be from 50-100. In some embodiments, the MOI can be 50. In some embodiments, the MOI can be from 100. In some embodiments, the MOI can be at least 100. In some embodiments, the MOI can be at least 500. In some embodiments, the MOI can be at least 1000.

Detection of a Target Nucleic Acid Sequence

FIG. 26 shows a flowchart for a method 200 of detecting a target nucleic acid sequence. The method may comprise an operation 210 of providing one or more probes capable of binding to a target nucleic acid sequence, as described herein. The method may comprise an operation 220 of binding the one or more probes to the target nucleic acid sequence, as described herein. The method may comprise an operation 230 of detecting a signal associated with binding of the one or more probes to the target nucleic acid sequence, as described herein.

The target nucleic acid sequence may be detected in an intact cell. The target nucleic acid sequence may be detected in a fixed cell. The target nucleic acid sequence may be detected in a lysate or chromatin spread.

A probe may be used to detect a nucleic acid sequence in a sample. For example, a probe comprising a probe sequence capable of binding a nucleic acid sequence (such as a target nucleic acid sequence) and a detectable label (such as a detectable agent) may be used to detect the nucleic acid sequence. A method for detecting a nucleic acid sequence may comprise contacting a nucleic acid sequence with a probe comprising a probe sequence configured to bind at least a portion of the nucleic acid sequence and detecting the probe (such as detecting the detectable label of the probe). The detection of a nucleic acid sequence may comprise binding the probe to the nucleic acid sequence. For example, the detection of a nucleic acid sequence may comprise binding the probe sequence, such as the sequence of an oligonucleotide probe, to a target nucleic acid sequence. In some cases, the detection of a nucleic acid sequence may comprise hybridizing the probe sequence (such as the nucleic acid binding region) of a nucleic acid probe to a target nucleic acid sequence. The nucleic acid sequence may be a virus nucleic acid sequence. The nucleic acid sequence may be an agricultural viral nucleic acid sequence. The nucleic acid sequence may be a lentivirus nucleic acid sequence, an adenovirus nucleic acid sequence, an adeno-associated virus nucleic acid sequence, or a retrovirus nucleic acid sequence.

A nucleic acid sequence may be contacted with a plurality of probes. A nucleic acid sequence may be contacted with a number of probes ranging from about 1 to about 108 probes, from about 2 to about 107 probes, from about 10 to about 106 probes, from about 100 to about 105 probes, from about 1,000 to about 104 probes, from about 1,000 to about 5,000 probes, from about 1,000 probes to about 50,000 probes, from about 1,000 to about 105 probes, from about 1,000 to about 500,000 probes, from about 1,000 probes to about 106 probes, from about 1,000 probes to about 50 million probes, or from about 1,000 probes to about 108 probes. The probes of the plurality of probes may be the same. A plurality of probes may have sequences such that the probes are tiled across the nucleic acid sequence. Each probe can bind to a target nucleic acid sequence along the nucleic acid sequence. The probes of a plurality may be different. A first probe of the plurality of probes may be different than a second probe of the plurality of probes. The plurality of probes may bind to the nucleic acid sequence with from 0 to 10 nucleotides separating each probe.

A nucleic acid sequence may be washed after it has been contacted with a probe. Washing a nucleic acid sequence after it has been contacted with a probe may reduce background signal for detection of the detectable label of the probe.

A nucleic acid sequence (such as a target nucleic acid sequence) can be contacted by a plurality of probes. A nucleic acid sequence can be contacted with a plurality of types of probes. That is, a method of detection of a nucleic acid sequence (such as a target nucleic acid sequence) may comprise contacting the target nucleic acid sequence with a plurality of sets of probes (such as a plurality of types of probes). A first probe set (such as a first type of probe) may be different from a second probe set (such a second type of probe) in that the first probe type comprises a first probe sequence which is different than the probe sequence of the second probe type. The probe sequence of a first type of probe may be the same as the probe sequence of a second type of probe. A first probe set may comprise a first detectable label and a first probe sequence and a second probe set may comprise a second detectable label and a second probe sequence, wherein the first and second probe sequences are the same and the first and second detectable labels are different. The first and second probe sequences may be different and the first and second detectable labels of a first and second probe set may be the same. The first and second probe sequences of a first and second probe set may be different and the first and second detectable labels of a first and second probe set may be different. A method of detecting a nucleic acid sequence may comprise contacting a nucleic acid sequence with 1, 2, 3, 4, 5, 6, 7, 8, 9, 10, 11, 12, 13, 14, 15, 16, 17, 18, 19, or 20 types of probes.

A first probe sequence may be configured to specifically recognize (such as to bind to or to hybridize with) a first nucleic acid sequence (such as a first target nucleic acid sequence). A second probe sequence may be configured to specifically recognize (such as to bind to or to hybridize with) a second nucleic acid sequence (such as a second target nucleic acid sequence).

A detectable label may be detected with a detector. A detector may detect the signal intensity of the detectable label. A detector may spatially distinguish between two detectable labels. A detector may also distinguish between a first and second detectable label based on the spectral pattern produced by the first and second detectable labels, wherein the first and second detectable label do not produce an identical spectral intensity pattern. For example, a detector may distinguish between a first and second detectable signal, wherein the wavelength of the signal produced by the first detectable label is not the same as the wavelength of the signal produced by the second detectable label. A detector may resolve (such as by spatially distinguishing or spectrally distinguishing) a first and second detectable label that are less than 1 kb apart, less than kb apart, less than kb apart, less than 2 kb apart, less than 2.5 kb apart, less than 3 kb apart, less than 3.5 kb apart, less than 4 kb apart, less than 4.5 kb apart, less than 5 kb apart, less than 5.5 kb apart, less than 6 kb apart, less than 6.5 kb apart, less than 7 kb apart, less than 7.5 kb apart, less than 8 kb apart, less than 8.5 kb apart, less than 9 kb apart, less than 9.5 kb apart, less than 10 kb apart, less than 10.5 kb apart, less than 11 kb apart, less than 11.5 kb apart, less than 12 kb apart, less than 20 kb apart, less than 50 kb apart, or less than 100 kb apart. The detectable label of the probe may be detected optically. For example, a detectable label of a probe may be detected by light microscopy, fluorescence microscopy, or chromatography. Detection of the detectable label of a probe may comprise stimulating the probe or a portion thereof (such as the detectable label) with a source of radiation (such as a light source, such as a laser). Detection of the detectable label of a probe may also comprise an enzymatic reaction.

Detection of the target nucleic acid sequence may be within a period of not more than 48 hours, not more than 36 hours, not more than 24 hours, not more than 23 hours, not more than 22 hours, not more than 21 hours, not more than 20 hours, not more than 19 hours, not more than 18 hours, not more than 17 hours, 1 not more than 6 hours, not more than 15 hours, not more than 14 hours, not more than 13 hours, or not more than 12 hours.

Determining the presence of a genetic modification in a cell using the Nano-FISH method described herein may be useful is assessing the phenotype of the cell resulting from the genetic modification. A method for assessing a phenotype of an intact genetically modified cell may comprise: a) providing the intact genetically modified cell comprising a target nucleic acid sequence less than 2.5 kilobases in length; b) contacting the intact genetically modified cell with a first plurality of probes, wherein each probe comprises a first detectable label and a probe sequence that binds to a portion of the target nucleic acid sequence; c) detecting a presence of the first detectable label in the intact cell, wherein the presence of the first detectable label indicates the presence of the target nucleic acid sequence; d) determining a phenotype of the intact genetically modified cell; and e) correlating the phenotype of the intact genetically modified cell with the presence of the target nucleic acid sequence. The method may further comprise determining a number or location of genetic modifications in the intact genetically modified cell. The method may further comprise f) selecting a first intact genetically modified cell comprising a phenotype of interest; g) determining a set of conditions used for a genetic modification of the first intact genetically modified cell; and h) preparing a second genetically modified cell using the set of conditions for genetic modification. The intact genetically modified cell may be a eukaryotic cell that was genetically modified. The intact genetically modified cell may be a bacteria cell that was genetically modified. The intact genetically modified cell may be a mammalian cell that was genetically modified. The intact genetically modified cell may be any cell as described herein that was genetically modified. The phenotype may be a product expressed as a result of the genetic modification of the cell. The phenotype may be an increased level or decreased level of the product expressed as a result of the genetic modification of the cell. The phenotype may be an increased quality of the product expressed as a result of the genetic modification of the cell. The expressed product may be protein, such as an enzyme. The expressed product may be a transgene protein, RNA, or a secondary product of the genetic modification. For example, if an enzyme is produced as a result of the genetic modification of the cell, a secondary product of the genetic modification is a product of the enzyme.

Determining the number of target nucleic acid sequences in a cell may be useful in determining the phenotype of the cell. Cells with a specific number of target nucleic acid sequences may be tested for increased cellular activity, decreased cellular activity, or toxicity. Increased cellular activity may be increased expression of a protein or a cellular product. Decreased cellular activity may be decreased expression of a protein or a cellular product. Toxicity may be a result of cellular activity that may be too high or too low, resulting in cell death. For example, the contacting a sample of virally transduced cells with a probe configured to bind to a particular target viral nucleic acid sequence and then determining the number of viral integrants may be an expedient means of determining whether virus has successfully integrated in the cells of the sample in way in which a desired therapeutic effect may result if given to a patient as a therapy.

Determining the presence, absence, identity, spatial position or sequence position of a target nucleic acid sequence in a sample may be useful in determining a condition of a patient. For example, the contacting a sample of cells with a probe configured to bind to a particular target nucleic acid sequence and then determining the number of target nucleic acid sequences in the cell may be an expedient means of determining the number of target nucleic acid sequences may be affecting the cell phenotype or function. For example, contacting a patient sample with a probe configured to bind to a particular nucleic acid sequence may be an expedient means of determining whether the patient has the nucleic acid sequence. As another example, contacting a sample of virally transduced cells with a probe configured to bind to a particular target viral nucleic acid sequence may be an expedient means of determining whether virus has successfully integrated in the cells of the sample. Similarly, contacting a patient sample with a plurality of types of probes, each configured to bind to a different nucleic acid sequence, may be an expedient means of screening patients for various genetic or acquired conditions, such as inherited mutations.

High-Throughput Assay

In some embodiments, the present disclosure provides methods of high-throughput assaying of target nucleic acid cells in multi-well format. For example, the present disclosure provides methods for depositing cells in at least 24 wells, hybridizing oligonucleotide Nano-FISH probes with cells after denaturation, covering cells in each well with a glass coverslip, and imaging the cells with the microscopy techniques disclosed herein. As an example, PLL-coated 24-well glass-bottom plates can be used to hold 24 samples, wherein each sample contains a cell population. The cell population in each well can be the same or the cell population in each well can be different. Thus, at least 24 unique samples can be processed at the same time. Cells can be deposited into the 24-well plate, treated with fixative solution (e.g., 3 parts methanol and 1 part glacial acetic acid), washed, and hybridized to oligonucleotide Nano-FISH probes. The 24-well plate can then be washed and cells can be mounted with glass coverslips containing an anti-fade solution (e.g., Prolong Gold) prior to imaging. In some embodiments, up to 1 to 2 well plates, 2 to 3 well plates, 3 to 4 well plates, 4 to 5 plates, or 5 to 10 plates can be simultaneously processed.

A. Quantification of a Target Nucleic Acid Sequence in a Cell

A method of detecting or determining the presence of a nucleic acid sequence may comprise determining the number of probes associated with the nucleic acid sequence. A method of detecting or determining the presence of a nucleic acid sequence may comprise determining the number of probes hybridized to the nucleic acid sequence.

It may also be possible to determine the quantity of target nucleic acid sequences in this manner. If a viral nucleic acid sequence comprises the target nucleic acid sequence, the number of viral nucleic acid sequences may be quantified using the methods described herein. Quantification of the number of viral nucleic acid sequences in a sample (such as a cell comprising viral integrations) may be useful in determining the multiplicity of infection. This quantification may also be useful for methods of enriching heterogeneous populations of transduced cells to a more homogenous cell population or to a cell population comprising a greater percentage of cells comprising a specific number or a specific range of viral integrations. Quantification of target nucleic acid sequences in a sample using the methods, compositions, and systems described herein may be useful in determining the number of repeated sequences in a nucleic acid of a sample.

In some embodiments, this method can be used for quantifying populations of cells transduced to express chimeric antigen receptors (CARs) in order to determine the average number of viral insertions per cell or the distribution of viral insertions per cell within the cell populations.

For example, a Nano-FISH probe or a Nano-FISH probe set of this disclosure, such as any one or more than one of SEQ ID NO: 1212-SEQ ID NO: 1281, can be used to verify the number of viral insertions in T cells that have been engineered to express CARs, such as BCMA, CD19, CD22, WT1, L1CAM, MUC16, ROR1, or LeY. Thus, the Nano-FISH probe or Nano-FISH probe sets of the present disclosure can be used as a quality control step to verify that engineered CAR T cells have truly been transduced with a vector encoding for a given CAR, prior to administering the CAR T cells to a subject in need thereof. For example, in some embodiments a T cell from a human donor is transduced with the lentivirus vector encoding for a CAR against BCMA. A subset of the engineered CAR T cells can be subject to viral Nano-FISH validation wherein, the CAR T cells are hybridized to a Nano-FISH probe or Nano-FISH probe set of the present disclosure and imaged to detect and quantify spots in the cell nuclei corresponding to viral insertions. The engineered CAR T cells can, thus, be verified for successful transduction of the CAR against BCMA. Furthermore, the engineered CAR T cells can, thus, be characterized for the average number of insertions per cell and/or the distribution of viral insertions per cell. Viral Nano-FISH can provide these valuable metrics characterizing the heterogeneity and quality of the engineered T cells prior to administration to a subject in need thereof. The above described methods can be used to validate CAR T cells engineered to target any of the following: BCMA for therapeutic use in a subject with relapsed/refractory multiple myeloma, CD19 for therapeutic use in a subject with non-Hodgkin lymphoma, CD22 for therapeutic use in a subject with pediatric acute lymphoblastic leukemia (ALL) or non-Hodgkin lymphoma, WT1 for therapeutic use in a subject with acute myeloid leukemia, non-small cell lung cancer (NSCLC) or mesothelioma, L1CAM for therapeutic use in a subject with pediatric neuroblastoma, MUC16 for therapeutic use in a subject with ovarian cancer, ROR1 for therapeutic use in a subject with NSCLC or triple-negative breast cancer, or LeY for therapeutic use in a subject with lung cancer.

In some embodiments, this method can be used for quantifying populations of CD34+ hematopoietic stem cells (HSCs) transduced to express a gene of interest for the purpose of gene therapy, in order to determine the average number of viral insertions per cell or the distribution of viral insertions per cell within the cell populations.

For example, a Nano-FISH probe or a Nano-FISH probe set of this disclosure, such as any one or more than one of SEQ ID NO: 930-SEQ ID NO: 1211, can be used to verify the number of viral insertions in CD34+ cells that have been engineered with any vector, such as a lentivirus vector or an adeno-associated virus vector to express any gene of interest. Thus, the Nano-FISH probe or Nano-FISH probe sets of the present disclosure can be used as a quality control step to verify that engineered CD34+ cells have truly been transduced with a vector encoding for a given gene, prior to administering the engineered CD34+ cells to a subject in need thereof. For example, in some embodiments a CD34+ cell from a human donor is transduced with the lentivirus vector encoding for any gene. A subset of the engineered CD34+ cells can be subject to viral Nano-FISH validation wherein, the CD34+ cells are hybridized to a Nano-FISH probe or Nano-FISH probe set of the present disclosure and imaged to detect and quantify spots in the cell nuclei corresponding to viral insertions. The engineered CD34+ cells can, thus, be verified for successful transduction of any gene. Furthermore, the engineered CD34+ cells can, thus, be characterized for the average number of insertions per cell and/or the distribution of viral insertions per cell. Viral Nano-FISH can provide these valuable metrics characterizing the heterogeneity and quality of the engineered CD34+ cells prior to administration to a subject in need thereof. The above described methods can be used to validate CD34+ cells engineered to in any of the following gene therapies: thalassemia, sickle cell disease, muscular dystrophy, or an immune disorder.

B. Enrichment and Optimization for the Number of Target Nucleic Acid Sequences in a Cell The quantification of a target nucleic acid sequence, such as a viral nucleic acid sequence, may allow for the precise tuning of per-cell viral integrant number among a pool of cells transduced with a virus, such as a retrovirus.

Viral transduction of cells may be heterogeneous, producing cells with no viral integrant, a single copy of a viral integrant, or two or more copies of a viral integrant. Using Nano-FISH, a pool of cells with a consistent number of viral integrants may be produced, wherein cells comprising an undesirable number of viral integrants (e.g., too many or no viral integrants) may be reduced or eliminated. Viral integrants may be detected using the methods as described herein for Nano-FISH, also referred to herein as "viral Nano-FISH." This may use microscopic imaging of fixed cells, and thus the imaged cells may not themselves be collected for subsequent use. However, pairing the Nano-FISH with a statistical approach may allow for (i) inferring the distribution of viral integrants in subpools of cells expanding in culture, and (ii) combining subpools to create a refined pool of cells with uniform viral integrants number. The pool of cells with the uniform number of viral integrants may be a therapeutic used to treat a disease.

In some embodiments, this method may be used for enriching populations of cells transduced to express chimeric antigen receptors (CARs) in order to deliver a cell population with a uniform number of CAR integrations to a patient as a cancer therapy.

The enrichment process may comprise the following steps: a) quantify the number of viral integrants in a sample from a source pool of cells; b) subdivide the remaining cells of the source pool into K subpools, each with approximately N cells (the value of N may be chosen to ensure a high likelihood of subpools having zero or a greatly reduced fraction of cells with more than one viral integrant; c) allow each subpool to undergo multiple cell divisions to create cell clones with identical numbers of viral integrants per cell; d) perform Nano-FISH on a representative sample from each subpool to assess the number of viral integrants in each cell; e) based on the assessment of step d) estimate the distribution of viral integrants for each subpool and eliminate the subpools with the unfavorable distribution of viral integrants; and f) combine the remaining subpools to create a single enriched pool comprising cells with a more homogenous number of viral integrants.

In some instances, the number of cell divisions and fraction of cells drawn for Nano-FISH analysis may be selected to ensure a high likelihood of detecting the presence of a multiple integration event given the random set of cells drawn. In some instances, any subpool may be eliminated if the proportion of cells with more than one viral integrants exceeds a specified threshold (which may be 0). Subpools may also be eliminated if the proportion of cells with no viral integrant is above a specified threshold. This secondary selection criterion may increase the relative abundance of the single viral integrant phenotype.

The above method for enrichment may allow numerous parameters to be specified in order to achieve a given goal. These parameters may include the number of cells per subpool, the number of subpools, the number of cell divisions (i.e., time in culture), and fraction of cells withdrawn for Nano-FISH. In addition, the optimal protocol may depend on the underlying rate of multiple viral insertions and the probability of detecting a spot with Nano-FISH. Finally, the approach may depend on the tolerance for allowing cells with multiple or no viral integrants into the enriched pool.

In some cases, subpools may be enriched so that no cells comprise multiple integrants. To achieve this, for example, a stastical model may be used. For example, the probability of a given pool of N cells containing zero cells with multiple insertions is given by $(1-p)^N$. If there are K subpools, then the total number of cells contained in subpools without any multiple insertions may be $M=KN(1-p)^N$. Therefore, $K=M/[N(1-p)^N]$ subpools may be needed to achieve a total of M progenitor cells without multiple integrations. The optimal value of N may be lip.

In addition to the parameters N and K, the target number of cell division cycles D and fraction of cells F to be withdrawn for Nano-FISH may need to be determined. For this determination, all cells may undergo the same number of cell divisions, resulting in $2^D$ copies of each. Thus, the probability of withdrawing k of the cells with 2 integrants in a fraction F of all cells in the subpool may be given by P(k|N,D,F) a hypergeometric probability distribution with $2^D$ positive items in $N2^D$ total items with $FN2^D$ drawn from the total. In some cases, the likelihood of a Nano-FISH spot being detected may be S, then the overall probability of detection may be given by $$\sum_{k=1}^{2^D} p(k|N, D, F)\left(1 - \left(1 - S^2\right)^k\right)$$

Determining the presence, absence, identity, spatial position or sequence position of a target nucleic acid sequence in a sample may be useful in determining a condition of a patient. For example, contacting a patient sample with a probe configured to bind to a particular nucleic acid sequence may be an expedient means of determining whether the patient has the nucleic acid sequence. Similarly, contacting a patient sample with a plurality of types of probes, each configured to bind to a different nucleic acid sequence, may be an expedient means of screening patients for various genetic or acquired conditions, such as inherited mutations.

C. Determination of the Spatial Position of a Target Nucleic Acid Sequence

FIG. 27 shows a flowchart for a method 300 of determining the spatial position of a nucleic acid sequence. The method may comprise an operation 310 of providing one or more probes capable of binding to a target nucleic acid sequence, as described herein. The method may comprise an operation 320 of binding the one or more probes to the target nucleic acid sequence, as described herein. The method may comprise an operation 330 of imaging a signal associated with binding of the one or more probes to the target nucleic acid sequence, as described herein.

A method of detecting or determining the presence of a nucleic acid sequence may comprise determining the spatial position of a nucleic acid sequence (such as a target nucleic acid sequence). Determining the spatial position of a nucleic acid sequence may comprise contacting a nucleic acid sequence with a probe, which may comprise a detectable label and a probe sequence configured to bind to the nucleic acid sequence, and detecting the detectable label of the probe.

The spatial position of the nucleic acid sequence may be determined relative to features of the sample (such as features of a cell), structures of the sample (such structures or organelles of the cell), or other nucleic acids by using the same or a different imaging modality to detect the reference features, structures, or nucleic acids. For instance, the spatial position of a nucleic acid sequence in a cell relative to the nucleus of a cell by using a plurality of antibodies with a detectable label to counter-label structures of the cell, such as the cell membrane. A cell line expressing a detectable label (such as a fusion protein with a structural protein expressed by the cell) may be used to determine spatial position of a nucleic acid sequence in a cell. If the target nucleic acid sequence comprises a viral nucleic acid sequence, the spatial location of the viral nucleic acid sequence may be determined by the methods as described herein.

Data collected from detection of all or a portion of the detectable labels in a sample may be used to form one or more two-dimensional images or a three-dimensional rendering or to make calculations determining or estimating the spatial position of the target nucleic acid sequence.

A first probe comprising a first detectable label and a first probe sequence configured to bind to a nucleic acid sequence (such as a target nucleic acid sequence) may be used as a reference position for a second probe comprising a second detectable label and a second probe sequence configured to bind to a second nucleic acid sequence (such as a second target nucleic acid sequence). For example, a first probe specific to a first target nucleic acid sequence of a nucleic acid with a known or anchored position on the nucleic acid may be used as a reference to determine the spatial position of a second target nucleic acid sequence bound by a second probe prior to or during imaging.

D. Detection of the Sequence Position of a Target Nucleic Acid Sequence

FIG. 28 shows a flowchart for a method 400 of detecting the sequence position of a nucleic acid sequence. The method may comprise an operation 410 of providing a first set of one or more probes capable of binding to one or more reference nucleic acid sequences with known positions in the genome, as described herein. The method may comprise an operation 420 of binding the first set of one or more probes to the one or more reference nucleic acid sequences, as described herein. The method may comprise an operation 430 of providing a second set of one or more probes capable of binding to a target nucleic acid sequence, as described herein. The method may comprise an operation 440 of binding the second set of one or more probes to the target nucleic acid sequence, as described herein. The method may comprise an operation 450 of detecting a signal associated with binding of the first set of one or more probes to the one or more reference nucleic acid sequences and of the second set of one or more probes to the target nucleic acid sequence, as described herein. The method may comprise an operation 460 of comparing the signals associated with binding of the first set of one or more probes to the reference nucleic acid sequences to the signal associated with binding of the second set of one or more probes to the target nucleic acid sequence.

A method of detecting or determining the presence of a nucleic acid sequence may comprise determining the sequence position of a nucleic acid sequence (such as a target nucleic acid sequence). For example, a probe with a probe sequence configured to recognize a first target sequence with a known position in the sequence of a nucleic acid may be used as reference for calculations or estimations of the sequence position of a second target nucleic acid sequence on the nucleic acid. For example, a first probe having a probe sequence configured to recognize a first target sequence with a first known position in the sequence of a nucleic acid and a second probe having a probe sequence configured to recognize a second target nucleic acid sequence with a second known position in the sequence of the nucleic acid may be used as reference points for a third probe configured to recognize a third target nucleic acid sequence with an unknown position in the nucleic acid. The relative sequence position of the third target nucleic acid sequence may be determined or estimated by comparing it to the positions of the first and second target nucleic acid sequences, as indicated by the signals from the first and second probes.

E. Detection of Target Nucleic Acid Sequences in a Sample Relative to a Control

FIG. 29 shows a flowchart for a method 500 of detecting a nucleic acid in a sample relative to a control. The method may comprise an operation 510 of providing a one or more probes capable of binding to a target nucleic acid sequence in a reference sample and a target nucleic acid sequence in a sample under test, as described herein. The method may comprise an operation 520 of binding the one or more probes to the target nucleic acid sequence in the reference sample and the target nucleic acid sequence in the sample under test, as described herein. The method may comprise an operation 530 of detecting a signal associated with binding of the set of one or more probes to the target nucleic acid sequence in the reference sample and the target nucleic acid sequence in the sample being tested, as described herein. The method may comprise an operation 540 of comparing the signal associated with binding of the one or more probes to the target nucleic acid sequence in the reference sample to the signal associated with binding of the one or more probes to the target nucleic acid sequence in the sample under test, as described herein.

F. Correlation of the Detection of a Target Nucleic Acid Sequence in a Sample with a Target Protein Expression The detection of a target nucleic acid sequence in a cell may be correlated with a target protein expression in the same cell. The method may comprise providing a one or more probes capable of binding to a target nucleic acid sequence in a sample and a target nucleic acid sequence in a sample being tested, as described herein, and further comprise providing one or more detectable labels to detect the target protein expression. The presence, absence, or quantity of the detected target nucleic acid sequence may be correlated to the presence, absence, or quantity of the target protein expression. This information may be used to further investigate the relationship between the target nucleic acid sequence and the target protein, and/or how different treatments may perturb this correlation.

A viral nucleic acid sequence may be introduced into a cell by a viral vector, such as a virus particle, which may be called a virus or a virion. A virus particle may also be introduced to a cell by a bacteriophage. A virus particle may introduce a viral nucleic acid sequence into a cell through a series of steps that may include attachment (such as binding) of the virus particle to the cell membrane of the cell, internalization (such as penetration) of the viral particle into the cell (such as via formation of a vesicle around the virus particle), breakdown of the vesicle containing the virus particle (such as through uncoating, which may comprise breakdown of the portions of the virus such as a the viral coat), expression of the viral nucleic acid sequence or a portion thereof, processing and/or maturation of the viral nucleic acid sequence's expression product, incorporation of the viral nucleic acid sequence or its expression product into a DNA sequence of the host cell, and/or or replication of the viral nucleic acid sequence or a portion thereof. A viral nucleic acid sequence may be targeted to the nucleus of the cell after internalization.

Introduction of a viral nucleic acid sequence into a cell by a virus particle may lead to permanent integration of the viral nucleic acid sequence into a DNA sequence of the cell. For example, a viral nucleic acid sequence introduced into a cell by a retrovirus, such as a lentivirus or adeno-associated virus, may be integrated directly into the DNA sequence of a cell. Introduction of a viral nucleic acid sequence into a cell by a virus particle may not lead to integration into a DNA sequence of the cell.

A viral particle may be a double-stranded DNA (dsDNA) virus, a single-stranded DNA (ssDNA) virus, a double-stranded RNA (dsRNA) virus, a sense single-stranded RNA (+ssRNA) virus, an antisense single-stranded RNA (−ssRNA). Some viral particles may introduce a reverse transcriptase, integrase, and/or protease (such as a reverse transcriptase encoded by a pol gene sequence, which may be a portion of the viral nucleic acid sequence) into the infected cell. Examples of virus particles that introduce reverse transcriptase into an infected cell include single-stranded reverse transcriptase RNA (ssRNA-RT) viruses and double-stranded DNA reverse transcriptase (dsDNA-RT) viruses. Examples of ssRNA-RT viruses include metaviridae, pseudoviridae, and retroviridae. Examples of dsDNA-RT viruses include hepadnaviridae (e.g., Hepatitis B virus) and caulimoviridae. Additional examples of viruses include lentiviruses, adenoviruses, adeno-associated viruses, and retroviruses.

A viral nucleic acid sequence may be introduced into a cell by a non-viral vector, such as a plasmid. A plasmid may be a DNA polynucleotide encoding one or more genes. A plasmid may comprise a viral nucleic acid sequence. A viral nucleic acid sequence of a plasmid may encode a non-coding RNA (such as a transfer RNA, a ribosomal RNA, a microRNA, an siRNA, a snRNA, a shRNA, an exRNA, a piwi RNA, a snoRNA, a scaRNA, or a long non-coding RNA) or a coding RNA (such as a messenger RNA). A coding RNA may be modified (such as by splicing, polyadenylation, or addition of a 5' cap) or translated into a polypeptide sequence (such as a protein) after being transcribed from a DNA nucleic acid sequence of a plasmid.

G. Detection of Infection/Transduction Efficacy of a Virus/Viral Vector

The Nano-FISH compositions and methods of the present disclosure can be used to determine the infection/transduction efficacy of a virus/viral vector for a population of cells and can reveal different patterns of insertion at the same MOI for a population of cells. A population of cells can be variably susceptible to viral infection (e.g., natural viral infection or transduction with a viral vector). Differences in susceptibility of infection/transduction may be driven by biological differences among cells, including their rate of division, and distribution of receptors capable of binding viral envelope proteins such as the lentivirus envelope proteins. For example, a cell population after infection/transduction can be heterogeneous with some cells of the population not being susceptible to infection/transduction as shown by no or a low number of viral integrants, and a small highly-susceptible population of the cell population with a higher number of viral integrants. As another example, this heterogeneity can lead to non-random and unexpectedly high numbers of insertions that can be detected in a small population of cells five days post-transduction or after infection.

Furthermore, Nano-FISH detection of viral integrants can be used to select an optimal viral envelope protein to pseudotype lentivirus for use in cell types for which the most popular lentivirus envelope, Vescicular Stomatitis Virus Gylcoprotein (VSVG), does not result in high transduction efficacy, such as cells which lack the LDLR receptor to which VSVG binds and thus are not highly susceptible to infection. Therefore, Nano-FISH compositions and methods of the present disclosure can be used to test new envelope proteins that have been rationally designed from existing virus envelopes for their transduction efficacy in hard-to-transduce cell types. Current methods for evaluating transduction efficacy for new envelope proteins in hard to transduce cell types use methods, such as qPCR and/or florescent cell sorting of a reporter gene. However, these methods do not reveal the single-cell distribution of insertions and therefore will not reveal unexpected accumulation of viral integrants in some cells or a lack of insertions in other cells. In contrast, Nano-FISH can be used to determine the optimal choice of envelope for different cell types to reveal the true biodistribution (also referred to as population distribution or cellular distribution) and transduction efficacy of each cell type.

Additionally, Nano-FISH detection of viral integrants can be used to tune the growth conditions of cells prior to transduction. For example, by altering growth conditions and length of time exposed to cytokines in the media for human primary CD34+ cells, the viral integrant profile of transduced cells can be altered. In some embodiments, a longer exposure of human primary CD34+ cells to cytokines can correspond with an increase in the number of cells with a number of viral integrants for a specific MOI. Therefore, determining the number of viral integrants in a cell of a cell population can be used as a quality control tool to assess transfection efficacy within a clinically relevant cell population. For example, the clinical management of chimeric antigen receptor (CAR) T cell treatments currently lacks reliable, cost-effective, and easy-to-use quality control tools to assess the number of CAR insertions per cell within the CAR T cell population. Thus, the Nano-FISH compositions and methods of the present disclosure can be used to increase the therapeutic efficacy and safety of cell (e.g., CAR T cell) therapies by providing more accurate and efficient methods for determining the presence of a target nucleic acid sequence in a cell or in a cell population.

Lastly, Nano-FISH detection of viral integrants can be used to detect HIV insertions in patient cells where the virus is latent, integrated in to genome but not currently active, for the evaluation and development of a better understanding of HIV latency. HIV latency poses a barrier for curing the disease because inactive virus can be difficult to target by drug or immunotherapy. Furthermore, the identity and number of T cells (or other cell types) latently infected with HIV is not well characterized and likely varies between patients. However, Nano-FISH using probes to target the HIV genome or universal lentivirus backbone probes in patient cells can be used detect HIV integrations in otherwise healthy cells. Other features of the cell can be used to determine cell type, and frequency of integrations using the Nano-FISH methods described herein can be used to evaluate the size of the viral reservoir, which can further guide patient care and inform antiretroviral treatment outcomes.

Optical Detection of Nucleic Acid Sequences

Described herein is a method of detecting a nucleic acid sequence, such as a viral nucleic acid sequence integrated into the DNA of a cell. The detection may encompass identification of the nucleic acid sequence, determining the presence or absence of the nucleic acid sequence, and/or determining the activity of the nucleic acid sequence. A method of detecting a nucleic acid sequence may include contacting a cell sample with a detection agent, binding the detection agent to the nucleic acid sequence, and analyzing a detection profile from the detection agent to determine the presence, absence, or activity of the nucleic acid sequence.

The method may involve utilizing one or more intrinsic properties associated with a detection agent to aid in detection of the nucleic acid sequence. The intrinsic properties may encompass the size of the detection agent, the intensity of the signal, and the location of the detection agent. The size of the detection agent may include the length of the probe and/or the size of the detectable moiety (such as the size of a fluorescent dye molecule) may modulate the specificity of interaction with a regulatory element. The intensity of the signal from the detection agent may correlate to the sensitivity of detection. For example, a detection agent with a molar extinction coefficient of about $0.5\text{-}5\times10^6$ $M^{-1}$ $cm^{-1}$ may have a higher intensity signal relative to a detection agent with a molar extinction coefficient outside of the $0.5\text{-}5\times10^6$ $M^{-1}$ $cm^{-1}$ range and may have lower attenuation due to scattering and absorption. Further, a detection agent with a longer excited state lifetime and a large Stoke shift (measured by the distance between the excitation and emission peaks) may further improve the sensitivity of detection. The location of the detection agent may, for example, provide the activity state of a nucleic acid sequence. A combination of intrinsic properties of the detection agent may be used to detect a regulatory element of interest.

A detection agent may comprise a detectable moiety that is capable of generating a light, and a probe portion that is capable of hybridizing to a target site on a nucleic acid sequence. As described herein, a detection agent may include a DNA probe portion, an RNA probe portion, a polypeptide probe portion, or a combination thereof. A DNA or RNA probe portion may be between about 10 and about 100 nucleotides in length, between about 15 and about 100 nucleotides in length, between about 20 and about 100 nucleotides in length, between about 20 and about 80 nucleotides in length, between about 20 and about 60 nucleotides in length, between about 25 and about 55 nucleotides in length, between about 30 and about 50 nucleotides in length, between about 15 and about 80 nucleotides in length, between about 15 and about 60 nucleotides in length, between about 20 and about 40 nucleotides in length, or between about 20 and about 30 nucleotides in length. A DNA or RNA probe portion may be about 10, about 15, about 20, about 21, about 22, about 23, about 24, about 25, about 26, about 27, about 28, about 29, about 30, about 31, about 32, about 33, about 34, about 35, about 36, about 37, about 38, about 39, about 40, about 45, about 50, about 55, about 60, about 65, about 70, about 80, about 90, or about 100 nucleotides in length. A DNA or RNA probe portion may be a TALEN probe, ZFN probe, or a CRISPR probe. A DNA or RNA probe portion may be a padlock probe. A polypeptide probe may comprise a DNA-binding protein, a RNA-binding protein, a protein involved in the transcription/translation process or detects the transcription/translation process, a protein that may detect an open or relaxed portion of a chromatin, or a protein interacting partner of a product of a regulatory element (such as an antibody or binding fragment thereof).

In some instances, a detection agent may comprise a DNA or RNA probe portion which may be between about 10 and about 100 nucleotides in length, between about 15 and about 100 nucleotides in length, between about 20 and about 100 nucleotides in length, between about 20 and about 80 nucleotides in length, between about 20 and about 60 nucleotides in length, between about 25 and about 55 nucleotides in length, between about 30 and about 50 nucleotides in length, between about 15 and about 80 nucleotides in length, between about 15 and about 60 nucleotides in length, between about 20 and about 40 nucleotides in length, or between about 20 and about 30 nucleotides in length. A detection agent may comprise a DNA or RNA probe portion which may be about 10, about 15, about 20, about 21, about 22, about 23, about 24, about 25, about 26, about 27, about 28, about 29, about 30, about 31, about 32, about 33, about 34, about 35, about 36, about 37, about 38, about 39, about 40, about 45, about 50, about 55, about 60, about 65, about 70, about 80, about 90, or about 100 nucleotides in length.

A detection agent may comprise a DNA or RNA probe selected from a TALEN probe, a ZFN probe, or a CRISPR probe.

A set of detection agents may be used to detect a nucleic acid sequence. The set of detection agents may comprise about 2, about 3, about 4, about 5, about 6, about 7, about 8, about 9, about 10, about 11, about 12, about 13, about 14, about 15, about 16, about 17, about 18, about 19, about 20, about 25, about 30, about 35, about 40, about 45, about 50, or more detection agents. Each of the detection agents within the set of detection agents may recognize and interact with a distinct region of a nucleic acid sequence. About 1, about 2, about 3, about 4, about 5, about 6, about 7, about 8, about 9, about 10, about 11, about 12, about 13, about 14, about 15, about 16, about 17, about 18, about 19, about 20, or more detection agents may be used for detection of a nucleic acid sequence. About 1 or more detection agents may be used for detection of a nucleic acid sequence. About 2 or more detection agents may be used for detection of a nucleic acid sequence. About 3 or more detection agents may be used for detection of a nucleic acid sequence. About 4 or more detection agents may be used for detection of a nucleic acid sequence. About 5 or more detection agents may be used for detection of a nucleic acid sequence. About 6 or more detection agents may be used for detection of a nucleic acid sequence. About 7 or more detection agents may be used for detection of a nucleic acid sequence. About 8 or more detection agents may be used for detection of a nucleic acid sequence. About 9 or more detection agents may be used for detection of a nucleic acid sequence. About 10 or more detection agents may be used for detection of a nucleic acid sequence. About 11 or more detection agents may be used for detection of a nucleic acid sequence. About 12 or more detection agents may be used for detection of a nucleic acid sequence. About 13 or more detection agents may be used for detection of a nucleic acid sequence. About 14 or more detection agents may be used for detection of a nucleic acid sequence. About 15 or more detection agents may be used for detection of a nucleic acid sequence. About 20 or more detection agents may be used for detection of a nucleic acid sequence.

A detection agent may comprise a polypeptide probe selected from a DNA-binding protein, a RNA-binding protein, a protein involved in the transcription/translation process or detects the transcription/translation process, a protein that may detect an open or relaxed portion of a chromatin, or a protein interacting partner of a product of a regulatory element (such as an antibody or binding fragment thereof).

A detectable moiety that is capable of generating a light may be directly conjugated or bound to a probe portion. A detectable moiety may indirectly conjugated or bound to a probe portion by a conjugating moiety. As described herein, a detectable moiety may be a small molecule (such as a dye) which may be directly conjugated or bound to a probe portion. A detectable moiety may be a fluorescently labeled protein or molecule which may be attached to a conjugating moiety (such as a hapten group, an azido group, an alkyne group) of a probe.

A profile or a detection profile or signature may include the signal intensity, signal location, and/or size of the signal of the detection agent. The profile or the detection profile may comprise about 100 image frames, about 500 frames, about 1000 frames, about 2000 frames, about 5000 frames, about 10,000 frames, about 20,000 frames, about 30,000 frames, about 40,000 frames, about 50,000 frames, or more image frames. Analysis of the profile or the detection profile may determine the activity of the regulatory element. The degree of activation may also be determined from the analysis of the profile or detection profile. Analysis of the profile or the detection profile may further determine the optical isolation and localization of the detection agents, which may correlate to the localization of the nucleic acid sequence.

FIG. 30 shows a flowchart for a method 600 of fluorescently detecting a target nucleic acid sequence. The method may comprise an operation 610 of providing a one or more probes capable of binding to a target nucleic acid sequence, as described herein. The method may comprise an operation 620 of binding the one or more probes to the target nucleic acid sequence, as described herein. The method may comprise an operation 630 of photobleaching the one or more probes at one or more wavelengths, as described herein. The method may comprise an operation 640 of detecting a profile of optical emissions associated with the photobleaching, as described herein. The method may comprise an operation 650 of analyzing the detection profile to determine the localization of the target nucleic acid sequence, as described herein.

The localization of a nucleic acid sequence may include contacting a nucleic acid sequence with a first set of detection agents, photobleaching the first set of detection agents for a first time point at a first wavelength to generate a second set of detection agents capable of generating a light at a second wavelength, detecting at least one burst generated by the second set of detection agents to generate a detection profile of the second set of detection agents, and analyzing the detection profile to determine the localization of the nucleic acid sequence.

A detection agent may comprise a detectable moiety that is capable of generating a light, and a probe portion that is capable of hybridizing to a target site on a nucleic acid sequence. Each detection agent within the first set of detection agents may have the same or a different detectable moiety. Each detection agent within the first set of detection agents may have the same detectable moiety. A detectable moiety may comprise a small molecule (such as a fluorescent dye). A detectable moiety may comprise a fluorescently labeled polypeptide, a fluorescently labeled nucleic acid probe, and/or a fluorescently labeled polypeptide complex.

Upon photobleaching, a second set of detection agents may be generated from the first set of detection agents, in which the second set may include detection agents that are capable of generating a burst of light detectable at a second wavelength. For example, bleaching of the set of detection agents may lead to about 50%, about 60%, about 70%, about 80%, about 90%, or more detection agents within the set to enter into an "OFF-state". An "OFF-state" may be a dark state in which the detectable moiety crosses from the singlet excited electronic or ON state to the triplet electronic state or OFF-state in which detection of light (such as fluorescence) may be low (for instance, less than 10%, less than 5%, less than 1%, or less than 0.5% of light may be detected). The remainder of the detection agents that have not entered into the OFF-state may generate bursts of lights, or to cycle between a singlet excited electronic state (or ON-state) and a singlet ground electronic state. As such, bleaching of the set of detection agents may generate about 40%, about 30%, about 20%, about 10%, about 5%, or less detection agents within the set that may generate bursts of lights. The bursts of lights may be detected stochastically, at a single burst level in which each burst of light correlates to a single detection agent.

A single wavelength may be used for photobleaching a set of detection agents. At least two wavelengths may be used for photobleaching a set of detection agents. A wavelength at 491 nm may be used. A wavelength at 405 nm may be used in combination with the wavelength at 491 nm. The two wavelengths may be applied simultaneously to photobleach a set of detection agents. The two wavelengths may be applied sequentially to photobleach a set of detection agents.

The time for photobleaching a set of detection agents may be from about 10 seconds to about 4 hours. The time may be from about 30 seconds to about 3.5 hours, from about one minute to about 3 hours, from about 5 minutes to about 2 hours, from about 10 minutes to about 1 hours, from about one minutes to about 1 hour, from about 5 minutes to about 1 hour, or from about 30 minutes to about 2 hours. The time may be at least 10 seconds, 20 seconds, 30 seconds, 40 seconds, 50 seconds, 1 minute, 2 minutes, 3 minutes, 4 minutes, 5 minutes, 10 minutes, 15 minutes, 20 minutes, 30 minutes, 45 minutes, 1 hour, 1.5 hours, 2 hours, 2.5 hours, 3 hours, 3.5 hours, 4 hours, or more.

The concentration of the detection agents may be from about 5 nM to about 1 μM. The concentration of the detection agent may be from about 5 nM to about 900 nM, from about 10 nM to about 800 nM, from about 15 nM to about 700 nM, from about 20 nM to about 50 0 nM, from about 10 nM to about 500 nM, from about 10 nM to about 400 nM, from about 10 nM to about 300 nM, from about 10 nM to about 200 nM, from about 10 nM to about 100 nM, from about 50 nM to about 500 nM, from about 50 nM to about 400 nM, from about 50 nM to about 300 nM, from about 50 nM to about 200 nM, from about 100 nM to about 500 nM, from about 100 nM to about 300 nM, or from about 100 nM to about 200 nM. The concentration of the detection agents may be about 10 nM, 15 nM, 20 nM, 30 nM, 40 nM, 50 nM, 60 nM, 70 nM, 80 nM, 90 nM, 100 nM, 150 nM, 200 nM, 250 nM, 300 nM, 400 nM, 500 nM, 600 nM, 700 nM, 800 nM, 900 nM, or more.

The burst of lights from the set of detection agents may generate a detection profile. The detection profile may comprise about 100 image frames, about 500 frames, about 1000 frames, about 2000 frames, about 5000 frames, about 10,000 frames, about 20,000 frames, about 30,000 frames, about 40,000 frames, about 50,000 frames, or more image frames. The detection profile may also include the signal intensity, signal location, or size of the signal. Analysis of the detection profile may determine the optical isolation and localization of the detection agents, which may correlate to the localization of the nucleic acid sequence.

The detection profile may comprise a chromatic aberration correction. The detection profile may comprise less than 5%, 4%, 3%, 2%, 1%, 0.5%, 0.1%, or 0% chromatic aberration. The detection profile may comprise less than 5% chromatic aberration. The detection profile may comprise less than 4% chromatic aberration. The detection profile may comprise less than 3% chromatic aberration. The detection profile may comprise less than 2% chromatic aberration. The detection profile may comprise less than 1% chromatic aberration. The detection profile may comprise less than 0.5% chromatic aberration. The detection profile may comprise less than 0.1% chromatic aberration. The detection profile may comprise 0% chromatic aberration.

More than one nucleic acid sequence may be detected at the same time. Sometimes, at least 2, at least 3, at least 4, at least 5, at least 6, at least 7, at least 8, at least 9, at least 10, at least 15, at least 20, or more nucleic acid sequence may be detected at the same time. Each of the nucleic acid sequences may be detected by a set of detection agents. The detectable moiety between the different set of detection agents may be the same. For example, two different sets of detection agents may be used to detect two different nucleic acid sequences and the detectable moieties from the two sets of detection agents may be the same. As such, at least 2, at least 3, at least 4, at least 5, at least 6, at least 7, at least 8, at least 9, at least 10, at least 15, at least 20, or more nucleic acid sequences may be detected at the same time at the same wavelength. The detectable moiety between the different set of detection agents may also be different. For example, two different sets of detection agents may be used to detect two different nucleic acid sequences and the detectable moiety from one set of detection agents may be detected at a different wavelength from the detectable moiety of the second set of detection agents. As such, at least 2, at least 3, at least 4, at least 5, at least 6, at least 7, at least 8, at least 9, at least 10, at least 15, at least 20, or more nucleic acid sequences may be detected at the same time in which each of the nucleic acid sequences may be detected at a different wavelength. The nucleic acid sequence may comprise DNA, RNA, polypeptides, or a combination thereof.

The activity of a target nucleic acid sequence may be measuring utilizing the methods described herein. The methods may include detection of a nucleic acid sequence and one or more products of the nucleic acid sequence. One or more products of the nucleic acid sequence may also include intermediate products or elements. The method may comprise contacting a cell sample with a first set and a second set of detection agents, in which the first set of detection agents interact with a target nucleic acid sequence within the cell and the second set of detection agents interact with at least one product of the target nucleic acid sequence, and analyze a detection profile from the first set and the second set of detection agents, in which the presence or the absence of the at least one product indicates the activity of the target nucleic acid sequence.

As described herein, a detection agent may comprise a detectable moiety that is capable of generating a light, and a probe portion that is capable of hybridizing to a target site on a nucleic acid sequence. Each detection agent within the first set of detection agents may have the same or a different detectable moiety. Each detection agent within the first set of detection agents may have the same detectable moiety. A detectable moiety may comprise a small molecule (such as a fluorescent dye). A detectable moiety may comprise a fluorescently labeled polypeptide, a fluorescently labeled nucleic acid probe, and/or a fluorescently labeled polypeptide complex.

The method may also allow photobleaching of the first set and the second set of detection agents, whereby generating a subset of detection agents capable of generating a burst of light. A detection profile may be generated from the detection of a set of light bursts, in which the presence or the absence of the at least one product may indicate the activity of the target nucleic acid sequence.

The nucleic acid sequence may comprise DNA, RNA, polypeptides, or a combination thereof. The nucleic acid sequence may be DNA. The nucleic acid sequence may be RNA. The nucleic acid sequence may be an enhancer RNA (eRNA). The presence of an eRNA may correlate with target gene transcription that is downstream of eRNA. The nucleic acid sequence may be a DNaseI hypersensitive site (DHS). The DHS may be an activated DHS. The pattern of the DHS on a chromatin may correlate to the activity of the chromatin. The nucleic acid sequence may be a polypeptide, such as a transcription factor, a DNA or RNA-binding protein or binding fragment thereof, or a polypeptide that is involved in chemical modification. The nucleic acid sequence may be chromatin.

A. Epifluorescence Imaging

One or more far-field or near-field fluorescence techniques may be utilized for the detection, localization, activity determination, and mapping of one or more nucleic acid sequences described herein. A microscopy method may be an air or an oil immersion microscopy method used in a conventional microscope or an imaging flow cytometer instrument. In such a method, imaging flow cytometers such as the ImageStream (EMD Millipore), conventional microscopes or commercial high-content imagers (such as the Operetta (Perkin Elmer), IN Cell (GE), etc.) deploying wide-field and/or confocal imaging modes microscopes may achieve sub-cellular resolution to detect signals of interest. For example, DAPI (4',6-diamidino-2-phenylindole) stain may be used to identify cell nuclei and another stain may be used to identify cells containing a nuclease protein.

B. Super-Resolution Imaging

A variety of microscopy and imaging modalities can be used in combination with the compositions and methods of the present disclosure. In some embodiments, a microscopy method may utilize super-resolution microscopy, which allows images to be taken with a higher resolution than the diffraction limit. A super-resolution microscopy method may utilize a deterministic super-resolution microscopy method, which utilizes a fluorophore's nonlinear response to excitation to enhance resolution. Exemplary deterministic super-resolution methods may include stimulated emission depletion (STED), ground state depletion (GSD), reversible saturable optical linear fluorescence transitions (RESOLFT), and/or saturated structured illumination microscopy (SSIM). A super-resolution microscopy method may also include a stochastic super-resolution microscopy method, which utilizes a complex temporal behavior of a fluorophore, to enhance resolution. Exemplary stochastic super-resolution method may include super-resolution optical fluctuation imaging (SOFI), all single-molecular localization method (SMLM) such as spectral precision determination microscopy (SPDM), SPDMphymod, photoactivated localization microscopy (PALM), fluorescence photo-activated localization microscopy (FPALM), stochastic optical reconstruction microscopy (STORM), and dSTROM.

A microscopy method may be a single-molecular localization method (SMLM). A microscopy method may be a spectral precision determination microscopy (SPDM) method. A SPDM method may rely on stochastic burst or blinking of fluorophores and subsequent temporal integration of signals to achieve lateral resolution at, for example, between about 10 nm and about 100 nm.

A microscopy method may be a spatially modulated illumination (SMI) method. A SMI method may utilize phased lasers and interference patterns to illuminate specimens and increase resolution by measuring the signal in fringes of the resulting Moire patterns.

A microscopy method may be a synthetic aperture optics (SAO) method. A SAO method may utilize a low magnification, low numerical aperture (NA) lens to achieve large field of view (FOV) and depth of field, without sacrificing spatial resolution. For example, an SAO method may comprise illuminating the detection agent-labeled target (such as a target nucleic acid sequence) with a predetermined number (N) of selective excitation patterns, where the number (N) of selective excitation patterns is determined based upon the detection agent's physical characteristics corresponding to spatial frequency content (such as the size, shape, and/or spacing of the detection agents on the imaging target) from the illuminated target, optically imaging the illuminated target at a resolution insufficient to resolve the objects on the target, and processing optical images of the illuminated target using information on the selective excitation patterns to obtain a final image of the illuminated target at a resolution sufficient to resolve the objects on the target. The number (N) of selective excitation patterns may correspond to the number of k-space sampling points in a k-space sampling space in a frequency domain, with the extent of the k-space sampling space being substantially proportional to an inverse of a minimum distance (4×) between the objects that is to be resolved by SAO, and with the inverse of the k-space sampling interval between the k-space sampling points being less than a width (w) of a detected area captured by a pixel of a system for said optical imaging. The number (N) may include a function of various parameters of the imaging system (such as a magnification of the objective lens, numerical aperture of the objective lens, wavelength of the light emitted from the imaging target, and/or effective pixel size of the pixel sensitive area of the image detector, etc.).

A SAO method may analyze a set of detection agent profiles from at least 100, at least 200, at least 250, at least 500, at least 1000, or more cells imaged simultaneously within one field of view utilizing an imaging instrument. The one field of view may be a single wide field of view (FOV) allowing image capture of at least 10, at least 50, at least 100, at least 200, at least 250, at least 500, at least 1000, or more cells. The single wide field of view may be about 0.70 mm by about 0.70 mm field of view. The SAO imaging instrument may enable a resolution of about 0.25 μm with a 20×/0.45NA lens. The SAO imaging instrument may enable a depth of field of about 2.72 μm with a 20×/0.45NA lens. The imaging instrument may enable a working distance of about 7 mm with a 20×/0.45NA lens. The imaging instrument may enable a z-stack of 1 with a 20×/0.45NA lens. The SAO method may further integrate and interpolate β-dimensional images from 2-dimensional images. The SAO method may enable the image acquisition of cell images at high spatial resolution and FOV. For example, for a given cell type, the SAO method may provide a FOV that is at least about 1.5×, at least about 2×, at least about 3×, at least about 4×, at least about 5×, at least about 6×, at least about 7×, at least about 8×, at least about 9×, at least about 10×, at least about 15×, at least about 20×, or more as compared to a FOV provided by a method of microscope imaging using a 40× or 60× objective. For example, the SAO method may provide a FOV corresponding to a 20× microscope lens with a spatial resolution corresponding to a 100× microscope lens.

The SAO imaging instrument may be, for example, an SAO instrument as described in U.S. Patent Publication No. 2011/0228073 (Lee et al.). The SAO imaging instrument may be, for example, a StellarVision™ imaging platform supplied by Optical Biosystems, Inc. (Santa Clara, Calif.).

Analysis of Fluorescence Images

Fluorescence images may be processed by a method of analysis of, e.g., cell nuclei, and/or target nucleic acid sequences. The method may comprise obtaining a fluorescence image of one or more probes bound to one or more target nucleic acid sequences, as described herein. The method may comprise deconvolving the image one or more times, as described herein. The method may comprise generating a region of interest (ROI) from the deconvolved image, as described herein. The method may comprise analyzing the ROI to determine the locations of all target nucleic acid sequences, as described herein.

FIG. 31 shows a flowchart for a method 700 of analyzing a fluorescence image of one or more target nucleic acid sequences. The method may comprise an operation 710 of obtaining a fluorescence image of one or more probes bound to one or more target nucleic acid sequences, as described herein. The method may comprise an operation 720 of deconvolving the image one or more times, as described herein. The method may comprise an operation 730 of generating a two-dimensional region of interest (ROI) mask from the deconvolved image, as described herein. The method may comprise an operation 740 of generating a three-dimensional ROI mask from the two-dimensional ROI mask, as described herein. The method may comprise an operation 750 of refining the three-dimensional ROI mask, as described herein. The method may comprise an operation 760 of analyzing the three-dimensional ROI mask to determine the locations of all target nucleic acid sequences, as described herein.

Images obtained using the systems and methods described herein may be subjected to an image analysis method. The images may be obtained using the epifluorescence imaging systems and methods described herein. The image may be obtained using the super-resolution imaging systems and methods described herein. The image analysis method may allow a quantitative morphometric analysis to be conducted on regions of interest (ROIs) within the images. The image analysis method may be implemented using Matlab, Octave, Python, Java, Perl, Visual Studio, C, or ImageJ. The image analysis method may be adapted from methods for processing fluorescence microscopy images of cells for segmentation of cell nuclei and/or nucleic acid sequence localization. The image analysis method may be fully automated and/or tunable by the user. The image analysis method may be configurable to identify nucleic acid sequence foci regardless of the shapes of the foci. The image analysis method may be configurable to process two-dimensional and/or three-dimensional images. The image analysis method may allow high throughput of estimation of cell count and boundaries in cell populations, which may be obtained with a speed-up of at least about 2 times, at least about 5 times, at least about 10 times, at least about 15 times, at least about 20 times, at least about 25 times, at least about 30 times, at least about 35 times, at least about 40 times, at least about 45 times, at least about 50 times, at least about 100 times, or more, as compared to manual identification and counting of cell populations.

The image analysis method may comprise a deconvolution of the image. The deconvolution process may improve the contrast and resolution of cell images for further analysis. The image analysis method may comprise an iterative deconvolution of the image. The image analysis method may comprise 1, 2, 3, 4, 5, 6, 7, 8, 9, or 10 iterations of deconvolving the image. The image analysis method may comprise more than 1, more than 2, more than 3, more than 4, more than 5, more than 6, more than 7, more than 8, more than 9, or more than 10 iterations of deconvolving the image. The deconvolution procedure may remove or reduce out-of-focus blur or other sources of noise in the epifluorescence images or super-resolution images, enhancing the signal-to-noise ratio (SNR) within ROIs.

The image analysis method may further comprise an identification of the ROIs (e.g., candidate cells). The ROIs may be identified using an automated detection method.

The ROIs may be identified by processing the raw images by applying a segmentation algorithm. This may allow the rapid delineation of ROIs within the epifluorescence or super-resolution images, thereby allowing scalability of processing images. The segmentation of ROIs may comprise planarization of three-dimensional images (e.g., generated by z-stacking to obtain three-dimensional cell volumes) by utilizing a maximum intensity projection image to generate a two-dimensional ROI mask. For rapid segmentation, the two-dimensional ROI mask may act as a template for an initial three-dimensional mask. For instance, the initial three-dimensional mask may be generated by projecting the two-dimensional ROI mask into a third spatial dimension. The projection may be a weighted projection. The initial three-dimensional mask may be further refined to obtain a refined three-dimensional ROI mask. Refinement of the initial three-dimensional mask may be achieved utilizing adaptive thresholding and/or region growing methods. Refinement of the initial three-dimensional mask may be achieved by iteratively applying adaptive thresholding and/or region growing methods. The iterative procedure may result in a final three-dimensional ROI mask. The final three-dimensional ROI mask may comprise information regarding the locations of all FISH-labeled nucleic acid sequences within each cell in a sample.

The segmentation may detect ROIs using two-dimensional or three-dimensional computer vision methods such as edge detection and morphology. The ROIs may include cell nuclei, sites of nucleic acid sequence or vector sequence localization, or a combination thereof within each cell in a cell population within a field of view (FOV).

The image analysis method may further comprise feature extraction/computation from the segmented ROIs (e.g., detected candidate cells). Such sets of features may be selected to enable high performance (e.g., accuracy, throughput, sensitivity, specificity, etc.) of identifying/counting cells of interest or ROIs. Morphological features/parameters may be extracted from the segmented ROIs, such as count, spatial location, size (area/volume), shape (circularity/sphericity, eccentricity, irregularity (concavity/convexity)), diameter, perimeter/surface area, etc. In addition, other image parameters may also be extracted from the segmented ROIs, such as quantitative measures of image texture that may be pixel-based or region based over a tunable length scale (e.g., nuclear diameter, nuclear area, nuclear volume, perimeter, surface area, DNA content, DNA texture measures), or contrast, correlation, entropy, energy, and homogeneity/uniformity. Sets of extracted features may include nuclear size (diameter, area, or volume), perimeter or surface area, shape (e.g., circularity, irregularity, eccentricity, etc.), DNA content, DNA texture measures, characteristics of a nucleic acid sequence of interest (e.g., number, size, shape, etc.), amount of nucleic acid sequence of interest per cell, or spatial location and localization pattern of a nucleic acid sequence of interest.

After the image analysis method has analyzed the cell nuclei, further informatics and analysis may be performed based on the image analysis results. For example, specificity analysis may be performed by analyzing locations and number of nucleic acid sequences of interest.

The image analysis method may analyze acquired image data comprising a cell population to generate an output of estimating a count and/or boundaries (e.g., segmented ROIs) of the cell population. For example, the image analysis method may apply a prediction algorithm (e.g., a predictive analytics algorithm) to the acquired data to generate output of estimating a count and/or boundaries (e.g., segmented ROIs) of the cell population. The prediction algorithm may comprise an artificial intelligence based predictor, such as a machine learning based predictor, configured to process the acquired image data comprising a cell population to generate the output of estimating a count and/or boundaries (e.g., segmented ROIs) of the cell population. The machine learning predictor may be trained using datasets from one or more sets of images of known cell populations as inputs and known counts and/or boundaries (e.g., segmented ROIs) of the cell populations as outputs to the machine learning predictor.

The machine learning predictor may comprise one or more machine learning algorithms. Examples of machine learning algorithms may include a support vector machine (SVM), a naïve Bayes classification, a random forest, a neural network, deep learning, or other supervised learning algorithm or unsupervised learning algorithm for classification and regression. The machine learning predictor may be trained using one or more training datasets corresponding to image data comprising cell populations.

Training datasets may be generated from, for example, one or more sets of image data having common characteristics (features) and outcomes (labels). Training datasets may comprise a set of features and labels corresponding to the features. Features may comprise characteristics such as, for example, certain ranges or categories of cell measurements, such as morphological features/parameters (count, size, diameter, area, volume, perimeter length, circularity, irregularity, eccentricity, etc.), other image parameters (contrast, correlation, entropy, energy, and homogeneity/uniformity, etc.), nuclear size (diameter, area, or volume), perimeter or surface area, shape (e.g., circularity, irregularity, eccentricity, etc.), DNA content, DNA texture measures, characteristics of a nucleic acid sequence of interest (e.g., number, size, shape, etc.), amount of nucleic acid sequence of interest per cell, or spatial location and localization pattern of nucleic acid sequences of interest. Labels may comprise outcomes such as, for example, estimated or actual counts and boundaries of cells in a cell population.

Training sets (e.g., training datasets) may be selected by random sampling of a set of data corresponding to one or more sets of image data. Alternatively, training sets (e.g., training datasets) may be selected by proportionate sampling of a set of data corresponding to one or more sets of image data. The machine learning predictor may be trained until certain predetermined conditions for accuracy or performance are satisfied, such as having minimum desired values corresponding to cell identification accuracy measures. For example, the cell identification accuracy measure may correspond to estimated or actual counts and boundaries (e.g., segmented ROIs) of cells in a cell population. Examples of cell identification accuracy measures may include sensitivity, specificity, positive predictive value (PPV), negative predictive value (NPV), accuracy, and area under the curve (AUC) of a Receiver Operating Characteristic (ROC) curve corresponding to the accuracy of generating estimated or actual counts and boundaries (e.g., segmented ROIs) of cells in a cell population.

For example, such a predetermined condition may be that the sensitivity of identifying a cell of interest comprises a value of, for example, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99%.

As another example, such a predetermined condition may be that the specificity of identifying a cell of interest comprises a value of, for example, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99%.

As another example, such a predetermined condition may be that the positive predictive value (PPV) of identifying a cell of interest comprises a value of, for example, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99%.

As another example, such a predetermined condition may be that the negative predictive value (NPV) of identifying a cell of interest comprises a value of, for example, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99%.

As another example, such a predetermined condition may be that the area under the curve (AUC) of a Receiver Operating Characteristic (ROC) curve of identifying a cell of interest comprises a value of at least about 0.50, at least about 0.55, at least about 0.60, at least about 0.65, at least about 0.70, at least about 0.75, at least about 0.80, at least about 0.85, at least about 0.90, at least about 0.95, at least about 0.96, at least about 0.97, at least about 0.98, or at least about 0.99.

In some embodiments, image analysis can also be carried out as shown in FIG. 49, which illustrates a flow chart depicting the image analysis steps of the present disclosure including data/image capture, autonomous pre-processing, and interactive data selection, quality control, and visualization. Images of 100-500 cells can be captured on a digital microscope. FIG. 50 shows an example quality control browser panel that can be generated by the image analysis software of the present disclosure where images can be analyzed for spots indicating viral insertions as detected using viral Nano-FISH probes or viral Nano-FISH probe sets. FIG. 51 illustrates an example experiment summary report with performance metrics that can be generated by the image analysis software of the present disclosure. The performance metrics displayed by the image analysis software of the present disclosure can give a user useful metrics to describe the viral insertion data and can further give a user a measure of the quality of the data. As shown in FIG. 49 autonomous pre-processing of the images can be carried out by the accompanying software including any of the following: image enhancement (e.g., deconvolution), nucleus segmentation, Nano-FISH spot detection, and protein expression measurements. Data can then be visualized on an interactive software platform, as shown in FIG. 50 and FIG. 51, that allows for thresholding, sorting, data compilation, data plotting, and calculation of performance metrics including any of the following: total cells (number of nuclei analyzed), mitotic index (fraction of cells undergoing cell division), insertion rate (expected number of insertion events per nucleus, based on fitting a Poisson distribution to the histogram of insertions per cell), insertion rate $R^2$ (Pearson correlation of actual versus Poisson prediction of histogram of insertions per cell), and expression enhancement (average change in protein expression (mean nuclear intensity) per insertion).

The image analysis method may be implemented in an automated manner, such as using the digital processing devices described herein.

A. Digital Processing Device

The systems, apparatus, and methods described herein may include a digital processing device, or use of the same. The digital processing device may include one or more hardware central processing units (CPU) that carry out the device's functions. The digital processing device may further comprise an operating system configured to perform executable instructions. In some instances, the digital processing device is optionally connected to a computer network, is optionally connected to the Internet such that it accesses the World Wide Web, or is optionally connected to a cloud computing infrastructure. In other instances, the digital processing device is optionally connected to an intranet. In other instances, the digital processing device is optionally connected to a data storage device.

In accordance with the description herein, suitable digital processing devices may include, by way of non-limiting examples, server computers, desktop computers, laptop computers, notebook computers, sub-notebook computers, netbook computers, netpad computers, set-top computers, media streaming devices, handheld computers, Internet appliances, mobile smartphones, tablet computers, personal digital assistants, video game consoles, and vehicles. Those of skill in the art will recognize that many smartphones are suitable for use in the system described herein. Those of skill in the art will also recognize that select televisions, video players, and digital music players with optional computer network connectivity are suitable for use in the system described herein. Suitable tablet computers may include those with booklet, slate, and convertible configurations, known to those of skill in the art.

The digital processing device may include an operating system configured to perform executable instructions. The operating system may be, for example, software, including programs and data, which may manage the device's hardware and provides services for execution of applications. Those of skill in the art will recognize that suitable server operating systems may include, by way of non-limiting examples, FreeBSD, OpenBSD, NetBSD®, Linux, Apple® Mac OS X Server®, Oracle® Solaris®, Windows Server®, and Novell® NetWare®. Those of skill in the art will recognize that suitable personal computer operating systems include, by way of non-limiting examples, Microsoft® Windows®, Apple® Mac OS X®, UNIX®, and UNIX-like operating systems such as GNU/Linux®. In some cases, the operating system is provided by cloud computing. Those of skill in the art will also recognize that suitable mobile smart phone operating systems include, by way of non-limiting examples, Nokia® Symbian® OS, Apple® iOS®, Research In Motion® BlackBerry OS®, Google® Android®, Microsoft® Windows Phone® OS, Microsoft® Windows Mobile® OS, Linux®, and Palm® WebOS®. Those of skill in the art will also recognize that suitable media streaming device operating systems include, by way of non-limiting examples, Apple TV®, Roku®, Boxee®, GoogleTV®, GoogleChromecast®, AmazonFire®, and Samsung® HomeSync®. Those of skill in the art will also recognize that suitable video game console operating systems include, by way of non-limiting examples, Sony® PS3®, Sony® PS4®, Microsoft® Xbox 360®, Microsoft Xbox One, Nintendo® Wii®, Nintendo® Wii U®, and Ouya®.

In some instances, the device may include a storage and/or memory device. The storage and/or memory device may be one or more physical apparatuses used to store data or programs on a temporary or permanent basis. In some instances, the device is volatile memory and requires power to maintain stored information. In other instances, the device is non-volatile memory and retains stored information when the digital processing device is not powered. In still other instances, the non-volatile memory comprises flash memory. The non-volatile memory may comprise dynamic random-access memory (DRAM). The non-volatile memory may comprise ferroelectric random access memory (FRAM). The non-volatile memory may comprise phase-change random access memory (PRAM). The device may be a storage device including, by way of non-limiting examples, CD- ROMs, DVDs, flash memory devices, magnetic disk drives, magnetic tapes drives, optical disk drives, and cloud computing based storage. The storage and/or memory device may also be a combination of devices such as those disclosed herein.

The digital processing device may include a display to send visual information to a user. The display may be a cathode ray tube (CRT). The display may be a liquid crystal display (LCD). Alternatively, the display may be a thin film transistor liquid crystal display (TFT-LCD). The display may further be an organic light emitting diode (OLED) display. In various cases, on OLED display is a passive-matrix OLED (PMOLED) or active-matrix OLED (AMO-LED) display. The display may be a plasma display. The display may be a video projector. The display may be a combination of devices such as those disclosed herein.

The digital processing device may also include an input device to receive information from a user. For example, the input device may be a keyboard. The input device may be a pointing device including, by way of non-limiting examples, a mouse, trackball, track pad, joystick, game controller, or stylus. The input device may be a touch screen or a multi-touch screen. The input device may be a microphone to capture voice or other sound input. The input device may be a video camera or other sensor to capture motion or visual input. Alternatively, the input device may be a Kinect™, Leap Motion™, or the like. In further aspects, the input device may be a combination of devices such as those disclosed herein.

B. Non-Transitory Computer Readable Storage Medium

In some instances, the systems, apparatus, and methods disclosed herein may include one or more non-transitory computer readable storage media encoded with a program including instructions executable by the operating system of an optionally networked digital processing device. In further instances, a computer readable storage medium is a tangible component of a digital processing device. In still further instances, a computer readable storage medium is optionally removable from a digital processing device. A computer readable storage medium may include, by way of non-limiting examples, CD-ROMs, DVDs, flash memory devices, solid state memory, magnetic disk drives, magnetic tape drives, optical disk drives, cloud computing systems and services, and the like. In some cases, the program and instructions are permanently, substantially permanently, semi-permanently, or non-transitorily encoded on the media.

C. Computer Program

The systems, apparatus, and methods disclosed herein may include at least one computer program, or use of the same. A computer program includes a sequence of instructions, executable in the digital processing device's CPU, written to perform a specified task. In some embodiments, computer readable instructions are implemented as program modules, such as functions, objects, Application Programming Interfaces (APIs), data structures, and the like, that perform particular tasks or implement particular abstract data types. In light of the disclosure provided herein, those of skill in the art will recognize that a computer program, in certain embodiments, is written in various versions of various languages.

The functionality of the computer readable instructions may be combined or distributed as desired in various environments. A computer program may comprise one sequence of instructions. A computer program may comprise a plurality of sequences of instructions. In some instances, a computer program is provided from one location. In other instances, a computer program is provided from a plurality of locations. In additional cases, a computer program includes one or more software modules. Sometimes, a computer program may include, in part or in whole, one or more web applications, one or more mobile applications, one or more standalone applications, one or more web browser plug-ins, extensions, add-ins, or add-ons, or combinations thereof.

D. Web Application

A computer program may include a web application. In light of the disclosure provided herein, those of skill in the art will recognize that a web application, in various aspects, utilizes one or more software frameworks and one or more database systems. In some cases, a web application is created upon a software framework such as Microsoft® .NET or Ruby on Rails (RoR). In some cases, a web application utilizes one or more database systems including, by way of non-limiting examples, relational, non-relational, object oriented, associative, and XML database systems. Sometimes, suitable relational database systems may include, by way of non-limiting examples, Microsoft® SQL Server, mySQL™ and Oracle®. Those of skill in the art will also recognize that a web application, in various instances, is written in one or more versions of one or more languages. A web application may be written in one or more markup languages, presentation definition languages, client-side scripting languages, server-side coding languages, database query languages, or combinations thereof. A web application may be written to some extent in a markup language such as Hypertext Markup Language (HTML), Extensible Hypertext Markup Language (XHTML), or eXtensible Markup Language (XML). In some embodiments, a web application is written to some extent in a presentation definition language such as Cascading Style Sheets (CSS). A web application may be written to some extent in a client-side scripting language such as Asynchronous Javascript and XML (AJAX), Flash® Actionscript, Javascript, or Silverlight®. A web application may be written to some extent in a server-side coding language such as Active Server Pages (ASP), ColdFusion®, Perl, Java™, JavaServer Pages (JSP), Hypertext Preprocessor (PHP), Python™, Ruby, Tcl, Smalltalk, WebDNA®, or Groovy. Sometimes, a web application may be written to some extent in a database query language such as Structured Query Language (SQL). Other times, a web application may integrate enterprise server products such as IBM® Lotus Domino®. In some instances, a web application includes a media player element. In various further instances, a media player element utilizes one or more of many suitable multimedia technologies including, by way of non-limiting examples, Adobe® Flash®, HTML 5, Apple® QuickTime®, Microsoft® Silverlight®, Java™, and Unity®.

E. Mobile Application

A computer program may include a mobile application provided to a mobile digital processing device. In some cases, the mobile application is provided to a mobile digital processing device at the time it is manufactured. In other cases, the mobile application is provided to a mobile digital processing device via the computer network described herein.

In view of the disclosure provided herein, a mobile application is created by techniques known to those of skill in the art using hardware, languages, and development environments known to the art. Those of skill in the art will recognize that mobile applications are written in several languages. Suitable programming languages include, by way of non-limiting examples, C, C++, C#, Objective-C, Java™, Javascript, Pascal, Object Pascal, Python™, Ruby, VB.NET, WML, and XHTML/HTML with or without CSS, or combinations thereof.

Suitable mobile application development environments are available from several sources. Commercially available development environments include, by way of non-limiting examples, AirplaySDK, alcheMo, Appcelerator®, Celsius, Bedrock, Flash Lite, .NET Compact Framework, Rhomobile, and WorkLight Mobile Platform. Other development environments are available without cost including, by way of non-limiting examples, Lazarus, MobiFlex, MoSync, and Phonegap. Also, mobile device manufacturers distribute software developer kits including, by way of non-limiting examples, iPhone and iPad (iOS) SDK, Android™ SDK, BlackBerry® SDK, BREW SDK, Palm® OS SDK, Symbian SDK, webOS SDK, and Windows® Mobile SDK.

Those of skill in the art will recognize that several commercial forums are available for distribution of mobile applications including, by way of non-limiting examples, Apple® App Store, Android™ Market, BlackBerry® App World, App Store for Palm devices, App Catalog for webOS, Windows® Marketplace for Mobile, Ovi Store for Nokia® devices, Samsung® Apps, and Nintendo® DSi Shop.

F. Standalone Application

A computer program may include a standalone application, which is a program that is run as an independent computer process, not an add-on to an existing process, e.g., not a plug-in. Those of skill in the art will recognize that standalone applications are often compiled. A compiler is a computer program(s) that transforms source code written in a programming language into binary object code such as assembly language or machine code. Suitable compiled programming languages include, by way of non-limiting examples, C, C++, Objective-C, COBOL, Delphi, Eiffel, Java™, Lisp, Python™, Visual Basic, and VB .NET, or combinations thereof. Compilation is often performed, at least in part, to create an executable program. A computer program may include one or more executable complied applications.

Web Browser Plug-in

The computer program may include a web browser plug-in. In computing, a plug-in is one or more software components that add specific functionality to a larger software application. Makers of software applications support plug-ins to enable third-party developers to create abilities which extend an application, to support easily adding new features, and to reduce the size of an application. When supported, plug-ins enable customizing the functionality of a software application. For example, plug-ins are commonly used in web browsers to play video, generate interactivity, scan for viruses, and display particular file types. Those of skill in the art will be familiar with several web browser plug-ins including, Adobe® Flash® Player, Microsoft® Silverlight®, and Apple® QuickTime®. In some embodiments, the toolbar comprises one or more web browser extensions, add-ins, or add-ons. In some embodiments, the toolbar comprises one or more explorer bars, tool bands, or desk bands.

In view of the disclosure provided herein, those of skill in the art will recognize that several plug-in frameworks are available that enable development of plug-ins in various programming languages, including, by way of non-limiting examples, C++, Delphi, Java™ PHP, Python™, and VB .NET, or combinations thereof.

Web browsers (also called Internet browsers) may be software applications, designed for use with network-connected digital processing devices, for retrieving, presenting, and traversing information resources on the World Wide Web. Suitable web browsers include, by way of non-limiting examples, Microsoft® Internet Explorer®, Mozilla® Firefox®, Google® Chrome, Apple® Safari®, Opera Software® Opera®, and KDE Konqueror. In some embodiments, the web browser is a mobile web browser. Mobile web browsers (also called mircrobrowsers, mini-browsers, and wireless browsers) are designed for use on mobile digital processing devices including, by way of non-limiting examples, handheld computers, tablet computers, netbook computers, subnotebook computers, smartphones, music players, personal digital assistants (PDAs), and handheld video game systems. Suitable mobile web browsers include, by way of non-limiting examples, Google® Android® browser, RIM BlackBerry® Browser, Apple® Safari®, Palm® Blazer, Palm® WebOS® Browser, Mozilla® Firefox® for mobile, Microsoft® Internet Explorer® Mobile, Amazon® Kindle® Basic Web, Nokia® Browser, Opera Software® Opera® Mobile, and Sony® PSP™ browser.

A. Software Modules

The systems and methods disclosed herein may include software, server, and/or database modules, or use of the same. In view of the disclosure provided herein, software modules may be created by techniques known to those of skill in the art using machines, software, and languages known to the art. The software modules disclosed herein may be implemented in a multitude of ways. A software module may comprise a file, a section of code, a programming object, a programming structure, or combinations thereof. A software module may comprise a plurality of files, a plurality of sections of code, a plurality of programming objects, a plurality of programming structures, or combinations thereof. In various aspects, the one or more software modules comprise, by way of non-limiting examples, a web application, a mobile application, and a standalone application. In some instances, software modules are in one computer program or application. In other instances, software modules are in more than one computer program or application. In some cases, software modules are hosted on one machine. In other cases, software modules are hosted on more than one machine. Sometimes, software modules may be hosted on cloud computing platforms. Other times, software modules may be hosted on one or more machines in one location. In additional cases, software modules are hosted on one or more machines in more than one location.

B. Databases

The methods, apparatus, and systems disclosed herein may include one or more databases, or use of the same. In view of the disclosure provided herein, those of skill in the art will recognize that many databases are suitable for storage and retrieval of analytical information described elsewhere herein. In various aspects described herein, suitable databases may include, by way of non-limiting examples, relational databases, non-relational databases, object oriented databases, object databases, entity-relationship model databases, associative databases, and XML databases. A database may be internet-based. A database may be web-based. A database may be cloud computing-based. Alternatively, a database may be based on one or more local computer storage devices.

C. Services

Methods and systems described herein may further be performed as a service. For example, a service provider may obtain a sample that a customer wishes to analyze. The service provider may then encode the sample to be analyzed by any of the methods described herein, performs the analysis and provides a report to the customer. The customer may also perform the analysis and provides the results to the service provider for decoding. In some instances, the service provider then provides the decoded results to the customer. In other instances, the customer may receive encoded analysis of the samples from the provider and decodes the results by interacting with softwares installed locally (at the customer's location) or remotely (e.g. on a server reachable through a network). Sometimes, the softwares may generate a report and transmit the report to the costumer. Exemplary customers include clinical laboratories, hospitals, industrial manufacturers and the like. Sometimes, a customer or party may be any suitable customer or party with a need or desire to use the methods provided herein.

D. Server

The methods provided herein may be processed on a server or a computer server, as shown in FIG. 32). The server 801 may include a central processing unit (CPU, also "processor") 805 which may be a single core processor, a multi core processor, or plurality of processors for parallel processing. A processor used as part of a control assembly may be a microprocessor. The server 801 may also include memory 810 (e.g. random access memory, read-only memory, flash memory); electronic storage unit 815 (e.g. hard disk); communications interface 820 (e.g. network adaptor) for communicating with one or more other systems; and peripheral devices 825 which includes cache, other memory, data storage, and/or electronic display adaptors. The memory 810, storage unit 815, interface 820, and peripheral devices 825 may be in communication with the processor 805 through a communications bus (solid lines), such as a motherboard. The storage unit 815 may be a data storage unit for storing data. The server 801 may be operatively coupled to a computer network ("network") 830 with the aid of the communications interface 820. A processor with the aid of additional hardware may also be operatively coupled to a network. The network 830 may be the Internet, an intranet and/or an extranet, an intranet and/or extranet that is in communication with the Internet, a telecommunication or data network. The network 830 with the aid of the server 801, may implement a peer-to-peer network, which may enable devices coupled to the server 801 to behave as a client or a server. The server may be capable of transmitting and receiving computer-readable instructions (e.g., device/system operation protocols or parameters) or data (e.g., sensor measurements, raw data obtained from detecting metabolites, analysis of raw data obtained from detecting metabolites, interpretation of raw data obtained from detecting metabolites, etc.) via electronic signals transported through the network 830. Moreover, a network may be used, for example, to transmit or receive data across an international border.

The server 801 may be in communication with one or more output devices 835 such as a display or printer, and/or with one or more input devices 840 such as, for example, a keyboard, mouse, or joystick. The display may be a touch screen display, in which case it functions as both a display device and an input device. Different and/or additional input devices may be present such an enunciator, a speaker, or a microphone. The server may use any one of a variety of operating systems, such as for example, any one of several versions of Windows®, or of MacOS®, or of Unix®, or of Linux®.

The storage unit 815 may store files or data associated with the operation of a device, systems or methods described herein.

The server may communicate with one or more remote computer systems through the network 830. The one or more remote computer systems may include, for example, personal computers, laptops, tablets, telephones, Smart phones, or personal digital assistants.

A control assembly may include a single server 801. In other situations, the system may include multiple servers in communication with one another through an intranet, extranet and/or the Internet.

The server 801 may be adapted to store device operation parameters, protocols, methods described herein, and other information of potential relevance. Such information may be stored on the storage unit 815 or the server 801 and such data is transmitted through a network.

Kits

A composition described herein may be supplied in the form of a kit. A composition may be a probe set designed for a target nucleic acid sequence. The kits of the present disclosure may further comprise instructions regarding the method of using the probe set to detect the target nucleic acid sequence.

In some embodiments, a kit comprises the compositions and methods for detecting a target nucleic acid sequence (to perform a Nano-FISH assay). The compositions and methods may be for fast detection of the target nucleic acid sequence, e.g., in about 24 hours or less, or in about 48 hours or less. The compositions and methods may be for detection of the target nucleic acid sequence, wherein the target nucleic acid sequence is a short nucleic acid sequence, e.g., less than 2 kb, less than 1.5 kb, or less than 0.5 kb. The compositions and methods may be for detecting and quantifying the target nucleic acid sequence in a cell or in a population of cells. In some embodiments, a kit may further comprise components useful in using the kit components and instructions on how to prepare the components for detection of a target nucleic acid sequence. In some embodiments, the kit may further comprise software needed for detection of the target nucleic acid sequence.

The components of the kit may be in dry or liquid form. If they are in dry form, the kit may include a solution to solubilize the dried material. The kit may also include transfer factor in liquid or dry form. In some embodiments, if the transfer factor is in dry form, the kit includes a solution to solubilize the transfer factor. The kit may also include containers for mixing and preparing the components. The kits as described herein also may include a means for containing compositions of the present disclosure in close confinement for commercial sale and distribution.

Unless defined otherwise, all technical and scientific terms used herein have the same meaning as is commonly understood by one of skill in the art to which the claimed subject matter belongs. It is to be understood that the foregoing general description and the following detailed description are exemplary and explanatory only and are not restrictive of any subject matter claimed. In this application, the use of the singular includes the plural unless specifically stated otherwise. It must be noted that, as used in the specification and the appended claims, the singular forms "a," "an" and "the" include plural referents unless the context clearly dictates otherwise. In this application, the use of "or" means "and/or" unless stated otherwise. Furthermore, use of the term "including" as well as other forms, such as "include", "includes," and "included," is not limiting.

As used herein, ranges and amounts may be expressed as "about" a particular value or range. About also includes the exact amount. Hence "about 5 µL" means "about 5 µL" and also "5 µL." Generally, the term "about" includes an amount that would be expected to be within experimental error.

The section headings used herein are for organizational purposes only and are not to be construed as limiting the subject matter described.

In various aspects, the present disclosure provide a method of detecting an exogenous nucleic acid sequence, the method comprising: a) providing a plurality of probes, wherein a first probe of the plurality of probes has at least one or more of the following characteristics: (i) less than 300 matches to a 16-mer database of human genomic sequences; (ii) less than 3 hits of the first probe to a genomic sequence, wherein the hit comprises at least 50% of contiguous homology to a genomic sequence; (iii) the first probe is capable of binding to the plus strand of the exogenous nucleic acid sequence and a second probe is capable of binding to the minus strand of the exogenous nucleic acid sequence; (iv) 5 nucleotides at a 3' end of the first probe, which are complementary to 5 nucleotides at a 5' end of a second probe of the plurality of probes; (v) 5 nucleotides at a 5' end of the first probe, which are complementary to 5 nucleotides at a 3' end of a second probe of the plurality of probes; and (vi) a linear structure comprising 30-60 nucleotides and a single detectable agent coupled to a first nucleotide at a 3' end of the probe; and wherein the first probe comprises a detectable label and a probe sequence that binds to a portion of the exogenous nucleic acid sequence; b) contacting the plurality of probes with a cell; and c) detecting a presence of the detectable label in the cell, wherein the presence of the detectable label indicates the presence of the exogenous nucleic acid sequence.

In some aspects, the first probe of the plurality of probes has two or more of the characteristics (i) through (vi). In other aspects, the first probe of the plurality of probes has three or more of the characteristics (i) through (vi). In some aspects, the first probe of the plurality of probes has four or more of the characteristics (i) through (vi). In other aspects, the first probe of the plurality of probes has five or more of the characteristics (i) through (vi). In some aspects, the first probe of the plurality of probes has all of the characteristics (i) through (vi).

In some aspects, the first probe is an oligonucleotide probe. In further aspects, the first probe comprises 40 nucleotides.

In various aspects, the present disclosure provides a method of detecting an exogenous nucleic acid sequence, the method comprising: a) contacting a plurality of probes with a cell, wherein a first probe of the plurality of probes comprises an oligonucleotide probe comprising 30 to 60 nucleotides that bind to a portion of the exogenous nucleic acid sequence and a detectable label directly incorporated at a first nucleotide at a 3' end of the oligonucleotide probe; b) detecting a presence of the detectable label in the cell, wherein the presence of the detectable label indicates the presence of the exogenous nucleic acid sequence.

In some aspects, the oligonucleotide probe comprises 40 nucleotides. In some aspects, the first probe has less than 300 matches to a 16-mer database of human genomic sequences, exhibits less than 3 hits of the oligonucleotide probe to a genomic sequence, wherein the hit comprises at least 50% of contiguous homology to a genomic sequence, is capable of binding to the plus strand of the exogenous nucleic acid sequence and a second probe is capable of binding to the minus strand of the exogenous nucleic acid sequence, 5 nucleotides at a 3' end of the first probe, which are complementary to 5 nucleotides at a 5' end of a second probe of the plurality of probes, 5 nucleotides at a 5' end of the first probe, which are complementary to 5 nucleotides at a 3' end of a second probe of the plurality of probes, and a linear structure comprising 30-60 nucleotides and a single detectable agent coupled to a first nucleotide at a 3' end of the probe.

In some aspects, the exogenous nucleic acid sequence comprises a viral nucleic acid sequence. In some aspects, the detectable label is a fluorescent dye molecule. In some aspects, the plurality of probes is not blocked with a blocking agent prior to the contacting the plurality of probes with the cell.

In further aspects, the blocking agent is Cot-1 DNA, salmon sperm DNA, yeast tRNA, or any combination thereof. In some aspects, the cell is an intact cell. In some aspects, the detecting of the exogenous nucleic acid sequence comprises less than 48 hours or less than 24 hours. In some aspects, the exogenous nucleic acid sequence is a non-amplified nucleic acid sequence. In some aspects, the exogenous nucleic acid sequence is not more than 12 kilobases in length, 10 kilobases in length, not more than 8 kilobases in length, not more than 6 kilobases in length, not more than 4 kilobases in length, not more than 3 kilobases, not more than 2 kilobases, not more than 1.5 kilobases in length, or not more than 1 kilobases in length.

In some aspects, the plurality of probes is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes. In further aspects, the method further comprises denaturing a DNA of the cell prior to contacting the plurality of probes with the cell. In some aspects, the denaturing the DNA of the cell comprises incubating the cell for 4.5 minutes in 70% formamide at a temperature of 78° C.

In further aspects, the method further comprises binding at least a portion of the first plurality of probes to the exogenous nucleic acid sequence. In some aspects, the method further comprises washing the cell after contacting the exogenous nucleic acid sequence with the first plurality of probes. In some aspects, the exogenous nucleic acid sequence is introduced into the cell. In further aspects, introducing comprises electroporation, lipofection, transfection, microinjection, viral transduction, or use of a gene gun.

In some aspects, the exogenous nucleic acid sequence is integrated into the genome of the cell. In some aspects, the method further comprises contacting the cell with a second detectable label that binds to a portion of a cellular structure; and detecting a position of the detectable label in the cell relative to the second detectable label, wherein the position is used to determine a spatial position of the exogenous nucleic acid sequence.

In further aspects, the method further comprises providing the cell further comprising a secondary nucleic acid sequence; contacting the cell with a second plurality of probes comprising a secondary probe comprising a second detectable label and a probe sequence that binds to a portion of the second nucleic acid sequence; and detecting a position of the detectable label in the cell relative to the second detectable label, wherein the position is used to determine the spatial position of the exogenous nucleic acid sequence.

In some aspects, the method further comprises determining a number of the exogenous nucleic acid sequences present in the cell. In some aspects, the method further comprises enriching for a cell population with a certain number of exogenous nucleic acid sequences in each cell based on the number of exogenous nucleic acid sequences as determined above. In some aspects, the method further comprises correlating an expression level of a cell surface protein with the number of exogenous nucleic acid sequences present in the cell, wherein the exogenous nucleic acid sequence encodes for the cell surface protein.

In some aspects, the method further comprises optically detecting the detectable label. In further aspects, the method comprises optically detecting the second detectable label. In some aspects, the exogenous nucleic acid sequence comprises: a viral nucleic acid sequence from a vector or fragment thereof; and a transgene nucleic acid sequence of an insert from the vector or fragment thereof. In some aspects, the exogenous nucleic acid sequence is from a lentivirus, adenovirus, adeno-associated virus, retrovirus, or any combination thereof.

In further aspects, the exogenous nucleic acid sequence is integrated into the genome of the cell. In some aspects, the cell is obtained from a tissue. In further aspects, the cell is a live cell. In some aspects, the cell is a mammalian cell or eukaryotic cell.

In further aspects, the cell is a hematopoietic progenitor cell, a monocyte, a macrophage, a microglia, a neuron, or a T-cell. In some aspects, the cell is an engineered cell or a progenitor cell thereof. In further aspects, the engineered cell is a CD34+ cell or a T cell. In some aspects, the CD34+ cell is transduced with the exogenous nucleic acid sequence to introduce a gene. In some aspects, the T cell is transduced with the exogenous nucleic acid sequence to introduce a chimeric antigen receptor (CAR). In further aspects, the gene comprises any therapeutic gene. In still further aspects, the CAR comprises BCMA, CD19, CD22, WT1, L1CAM, MUC16, ROR1, or LeY.

In some aspects, the second plurality of probes bound to the exogenous nucleic acid sequence is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes. In some aspects, the method further comprises binding at least a portion of the second plurality of probes to the exogenous nucleic acid sequence.

In further aspects, the method further comprises washing the cell after contacting the exogenous nucleic acid sequence with the second plurality of probes. In some aspects, the probe sequence of at least one probe of the second plurality of probes comprises an oligonucleotide sequence. In some aspects, the plurality of probes comprises at least one of SEQ ID NO: 930-SEQ ID NO: 1281 or SEQ ID NO: 1388-SEQ ID NO: 1403. In some aspects, the exogenous nucleic acid sequence has at least 60%, at least 65%, at least 70%, at least 75%, at least 80%, at least 85%, at least 90%, at least 92%, at least 95%, at least 97%, or at least 99% sequence identity with SEQ ID NO: 1282-SEQ ID NO: 1285.

In some aspects, the first probe comprises less than 1 repetitive element, wherein the repetitive element comprises a short interspersed nuclear elements (SINE), an ALUs, a long interspersed nuclear elements (LINE), a long terminal repeat elements (LTR) including retroposons, a DNA repeat elements, a simple repeats (micro-satellites), a low complexity repeats, a satellite repeats, a RNA repeat, or a class RC.

In some aspects, the exogenous nucleic acid sequence comprises DNA. In other aspects, the exogenous nucleic acid sequence comprises RNA. In some aspects, the first probe comprises a GC content of from 25-70%. In further aspects, the GC content of each probe within the plurality of probes varies by less than 5 to 10%. In some aspects, the single detectable agent is located at the 5' end of the first probe or at any nucleotide of the first probe. In some aspects, a signal to noise ratio of about 1.2-1.5 to 1, 1.5:1, 4-8 to 1, or 5-10:1 is observed. In some aspects, the plurality of probes binds endogenous and exogenous genes. In some aspects, the exogenous nucleic acid sequence is double stranded.

In further aspects, the cell is fixed with a fixation buffer prior to the contacting the plurality of probes with the cell. In some aspects, the fixation buffer comprises a 3 to 1 ratio of methanol to acetic acid. In some aspects, the first probe has less than 1 hit to a genomic sequence, wherein the hit comprises at least 75% of contiguous homology to a genomic sequence.

In some aspects, the contacting the plurality of probes with the cell comprises simultaneously contacting a plurality of cell populations with the plurality of probes. In some aspects, each of the plurality of cell populations is deposited in an individual well in a well plate. In further aspects, the well plate comprises at least 24 wells. In some aspects, each of the plurality of cell populations is from a unique sample. In other aspects, each of the plurality of cell populations is from an identical sample. In further aspects, each of the plurality of cell populations is deposited in an individual well in up to 1 to 2 well plates, 2 to 3 well plates, 3 to 4 well plates, 4 to 5 plates, or 5 to 10 plates. In some aspects, a probe set comprises the plurality of probes. In further aspects, the method further comprises providing a plurality of probe sets. In still further aspects, each probe set of the plurality of probe sets comprises a unique fluorophore and detects a unique exogenous nucleic acid sequence.

In various aspects, the present disclosure provides a composition comprising a plurality of probes, wherein a first probe of the plurality of probes comprises an oligonucleotide probe comprising a detectable label and a probe sequence that binds to an exogenous nucleic acid sequence in a cell and wherein the oligonucleotide probe has at least one or more of the following characteristics: (i) less than 300 matches to a 16-mer database of human genomic sequences; (ii) less than 3 hits of the first probe to a genomic sequence, wherein the hit comprises at least 50% of contiguous homology to a genomic sequence; (iii) the first probe is capable of binding to the plus strand of the exogenous nucleic acid sequence and a second probe is capable of binding to the minus strand of the exogenous nucleic acid sequence; (iv) 5 nucleotides at a 3' end of the first probe, which are complementary to 5 nucleotides at a 5' end of a second probe of the plurality of probes; (v) 5 nucleotides at a 5' end of the first probe, which are complementary to 5 nucleotides at a 3' end of a second probe of the plurality of probes; and (vi) a linear structure comprising 30-60 nucleotides and a single detectable agent coupled to a first nucleotide at a 3' end of the probe.

In some aspects, the first probe has at least two or more of characteristics (i) through (vi). In other aspects, the first probe has three or more of the characteristics (i) through (vi). In some aspects, the first probe has four or more of the characteristics (i) through (vi). In other aspects, the first probe has four or more of the characteristics (i) through (vi). In some aspects, the first probe has five or more of the characteristics (i) through (vi). In other aspects, the first probe has all of the characteristics (i) through (vi).

In some aspects, the detectable label is directly incorporated on a first nucleotide at a 3' end of the first probe. In some aspects, the first probe comprises 30-60 nucleotides.

In various aspects, the present disclosure provides a composition comprising a plurality of probes, wherein a first probe of the plurality of probes comprises an oligonucleotide probe comprising a detectable label directly incorporated on a first nucleotide at a 3' end of the oligonucleotide probe and a probe sequence comprising 30 to 60 nucleotides that binds to a portion of an exogenous nucleic acid in a cell sequence.

In some aspects, the first probe has less than 300 matches to a 16-mer database of human genomic sequences, exhibits less than 3 hits of the oligonucleotide probe to a genomic sequence, wherein the hit comprises at least 50% of contiguous homology to a genomic sequence, is capable of binding to the plus strand of the exogenous nucleic acid sequence and a second probe is capable of binding to the minus strand of the exogenous nucleic acid sequence, 5 nucleotides at a 3' end of the first probe, which are complementary to 5 nucleotides at a 5' end of a second probe of the plurality of probes, 5 nucleotides at a 5' end of the first probe, which are complementary to 5 nucleotides at a 3' end of a second probe of the plurality of probes, and a linear structure comprising 30-60 nucleotides and a single detectable agent coupled to a first nucleotide at a 3' end of the probe.

In some aspects, the oligonucleotide probe comprises 40 nucleotides. In some aspects, the exogenous nucleic acid sequence comprises a viral nucleic acid sequence. In some aspects, the oligonucleotide probe is capable of binding to a plus strand or a minus strand of the exogenous nucleic acid sequence.

In further aspects, the detectable label is a fluorescent dye molecule. In some aspects, the cell is an intact cell. In some aspects, the exogenous nucleic acid sequence is a non-amplified nucleic acid sequence. In some aspects, the exogenous nucleic acid sequence is not more than 12 kilobases in length, 10 kilobases in length, not more than 8 kilobases in length, not more than 6 kilobases in length, not more than 4 kilobases in length, not more than 3 kilobases, not more than 2 kilobases, not more than 1.5 kilobases in length, or not more than 1 kilobases in length. In some aspects, the plurality of probes is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes.

In some aspects, the exogenous nucleic acid sequence comprises: a viral nucleic acid sequence from a vector or fragment thereof; and a transgene nucleic acid sequence of an insert from the vector or fragment thereof. In some aspects, the exogenous nucleic acid sequence is from a lentivirus, adenovirus, adeno-associated virus, retrovirus, or a fragment thereof. In some aspects, the exogenous nucleic acid sequence is integrated into the genome of the cell.

In further aspects, the cell is obtained from a tissue. In some aspects, the cell is a live cell. In some aspects, the cell is a mammalian cell or eukaryotic cell. In some aspects, the cell is a hematopoietic progenitor cell, a monocyte, a macrophage, a microglia, a neuron, or a T-cell. In some aspects, the cell is an engineered cell or a progenitor cell thereof. In further aspects, the engineered cell is a CD34+ cell or a T cell. In some aspects, the CD34+ cell is transduced with the exogenous nucleic acid sequence to introduce a gene. In further aspects, the T cell is transduced with the exogenous nucleic acid sequence to introduce a chimeric antigen receptor (CAR).

In further aspects, the CAR comprises BCMA, CD19, CD22, WT1, L1CAM, MUC16, ROR1, or LeY. In some aspects, the plurality of probes comprises at least one of SEQ ID NO: 930-SEQ ID NO: 1281 or SEQ ID NO: 1388-SEQ ID NO: 1403. In some aspects, probe comprises less than 1 repetitive element, wherein the repetitive element comprises a short interspersed nuclear elements (SINE), an ALUs, a long interspersed nuclear elements (LINE), a long terminal repeat elements (LTR) including retroposons, a DNA repeat elements, a simple repeats (micro-satellites), a low complexity repeats, a satellite repeats, a RNA repeat, or a class RC.

In some aspects, the exogenous nucleic acid sequence comprises DNA. In other aspects, the exogenous nucleic acid sequence comprises RNA. In some aspects, the first probe comprises a GC content of from 25-70%. In some aspects, the GC content of each probe within the plurality of probes varies by less than 5 to 10%. In some aspects, the single detectable agent is located at the 5' end of the first probe or at any nucleotide of the first probe. In some aspects, a signal to noise ratio of about 1.2-1.5 to 1, 1.5:1, 4-8 to 1, or 5-10:1 is observed. In some aspects, the plurality of probes binds endogenous and exogenous genes. In some aspects, the exogenous nucleic acid sequence is double stranded. In some aspects, the first probe has less than 1 hit to a genomic sequence, wherein the hit comprises at least 75% of contiguous homology to a genomic sequence.

In various aspects, the present disclosure provides a method of detecting a viral nucleic acid sequence in an intact cell within a period of not more than 48 hours. In some aspects, the method further comprises contacting the intact cell with a first plurality of probes, wherein each probe comprises a first detectable label and a probe sequence that binds to a portion of the viral nucleic acid sequence. In some aspects, the method further comprises detecting a presence of the first detectable label in the intact cell, wherein the presence of the first detectable label indicates the presence of the viral nucleic acid sequence.

In various aspects, the present disclosure provides a method of detecting a viral nucleic acid sequence within a period of not more than 48 hours, wherein the viral nucleic acid sequence is a non-amplified viral nucleic acid sequence. In some aspects, the method further comprises contacting the viral nucleic acid sequence with a first plurality of probes, wherein each probe comprises a first detectable label and a probe sequence that binds to a portion of the viral nucleic acid sequence. In some aspects, the method further comprises detecting a presence of the first detectable label on the viral nucleic acid sequence, wherein the presence of the first detectable label indicates the presence of the viral nucleic acid sequence. In some aspects, the viral nucleic acid sequence is not more than 12 kilobases in length, 10 kilobases in length, not more than 8 kilobases in length, not more than 6 kilobases in length, not more than 4 kilobases in length, not more than 3 kilobases, not more than 2 kilobases, not more than 1.5 kilobases in length, or not more than 1 kilobases in length. In some aspects, the plurality of probes bound to the viral nucleic acid sequence is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes. In some aspects, the method further comprises binding at least a portion of the plurality of probes to the viral nucleic acid sequence. In some aspects, the method further comprises washing the intact cell after contacting the viral nucleic acid sequence with the first plurality of probes. In some aspects, the method further comprises introducing the viral nucleic acid sequence into the intact cell. In some aspects, the viral nucleic acid sequence is integrated into the genome of the intact cell. In some aspects, the method further comprises introducing the viral nucleic acid sequence into an intact cell. In some aspects, the viral nucleic acid sequence is integrated into the genome of an intact cell. In some aspects, introducing comprises electroporation, lipofection, transfection, microinjection, viral transduction, or use of a gene gun.

In some aspects, the contacting the viral nucleic acid sequences with the first plurality of probes comprises simultaneously contacting a plurality of cell populations with the first plurality of probes. In some aspects, each of the plurality of cell populations is deposited in an individual well in a well plate. In further aspects, the well plate comprises at least 24 wells. In some aspects, each of the plurality of cell populations is from a unique sample. In other aspects, each of the plurality of cell populations is from an identical sample. In further aspects, each of the plurality of cell populations is deposited in an individual well in up to 1 to 2 well plates, 2 to 3 well plates, 3 to 4 well plates, 4 to 5 plates, or 5 to 10 plates.

In some aspects, a probe set comprises the plurality of probes. In further aspects, the method further comprises providing a plurality of probe sets. In still further aspects, each probe set of the plurality of probe sets comprises a unique fluorophore and detects a unique exogenous nucleic acid sequence.

In various aspects, the present disclosure provides a method for detecting a presence of an exogenous nucleic acid sequence in an intact cell, the method comprising: providing the intact cell comprising the exogenous nucleic acid sequence, wherein the exogenous nucleic acid sequence is not more than 12 kilobases in length; contacting the intact cell with a first plurality of probes, wherein each probe comprises a first detectable label and a probe sequence that binds to a portion of the exogenous nucleic acid sequence; and detecting a presence of the first detectable label in the intact cell, wherein the presence of the first detectable label indicates the presence of the exogenous nucleic acid sequence. In some aspects, the method further comprises: contacting the intact cell with a second detectable label that binds to a portion of a cellular structure, and detecting a position of the first detectable label in the intact cell relative to the second detectable label, wherein the position is used to determine a spatial position of the exogenous nucleic acid sequence. In some aspects, the method further comprises: providing the intact cell further comprising a second nucleic acid sequence; contacting the intact cell with a second plurality of probes, wherein each probe comprises a second detectable label and a probe sequence that binds to a portion of the second nucleic acid sequence, and detecting a position of the first detectable label in the intact cell relative to the second detectable label, wherein the position is used to determine the spatial position of the exogenous nucleic acid sequence. In some aspects, contacting the intact cell with the first plurality of probes comprises simultaneously contacting a plurality of cell populations with the first plurality of probes. In some aspects, each of the plurality of cell populations is deposited in an individual well in a well plate. In further aspects, the well plate comprises at least 24 wells. In some aspects, each of the plurality of cell populations is from a unique sample. In other aspects, each of the plurality of cell populations is from an identical sample. In further aspects, each of the plurality of cell populations is deposited in an individual well in up to 1 to 2 well plates, 2 to 3 well plates, 3 to 4 well plates, 4 to 5 plates, or 5 to 10 plates. In some aspects, a probe set comprises the plurality of probes. In further aspects, the method further comprises providing a plurality of probe sets. In still further aspects, each probe set of the plurality of probe sets comprises a unique fluorophore and detects a unique exogenous nucleic acid sequence.

In various aspects, the present disclosure provides a method for quantifying an exogenous nucleic acid sequence in an intact cell, the method comprising: providing the intact cell comprising the exogenous nucleic acid sequence, wherein the exogenous nucleic acid sequence is not more than 12 kilobases in length; contacting the intact cell with a first plurality of probes, wherein each probe comprises a first detectable label and a probe sequence that binds to a portion of the exogenous nucleic acid sequence; and determining a number of the exogenous nucleic acid sequences present in the intact cell within a period of not more than 48 hours. In some aspects, the method further comprises enriching for a cell population with a certain number of exogenous nucleic acid sequences in each cell based on the number of exogenous nucleic acid sequences as determined above. In some aspects, the method further comprises correlating an expression level of a cell surface reporter gene with the number of exogenous nucleic acid sequences present in the intact cell, wherein the exogenous nucleic acid sequence comprises the cell surface reporter gene. In some aspects, the detecting is within a period of not more than 48 hours. In some aspects, the period is of not more than 24 hours. In some aspects, the intact cell comprises an exogenous nucleic acid sequence of not more than 10 kilobases in length, not more than 8 kilobases in length, not more than 6 kilobases in length, not more than 4 kilobases in length, not more than 3 kilobases, not more than 2 kilobases, not more than 1.5 kilobases in length, or not more than 1 kilobases in length. In some aspects, the exogenous nucleic acid sequence comprises a viral nucleic acid sequence. In some aspects, the exogenous nucleic acid sequence comprises: a viral nucleic acid sequence from a vector or fragment thereof; and a transgene nucleic acid sequence of an insert from the vector or fragment thereof. In some aspects, the viral nucleic acid sequence is from a lentivirus, adenovirus, adeno-associated virus, or retrovirus. In some aspects, the exogenous nucleic acid sequence of the transgene nucleic acid sequence comprises a chimeric antigen receptor T cell nucleic acid sequence or fragment thereof. In some aspects, the first plurality of probes bound to the exogenous nucleic acid sequence is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes. In some aspects, the method further comprises binding at least a portion of the first plurality of probes to the exogenous nucleic acid sequence. In some aspects, the method further comprises washing the intact cell after contacting the exogenous nucleic acid sequence with the first plurality of probes. In some aspects, the method further comprises optically detecting the first detectable label. In some aspects, the method further comprises optically detecting the second detectable label. In some aspects, the intact cell is obtained from a tissue. In some aspects, the intact cell is a live cell. In some aspects, the intact cell is a mammalian cell or eukaryotic cell. In some aspects, the intact cell is a hematopoietic progenitor cell, a monocyte, a macrophage, a microglia, a neuron, or a T-cell. In some aspects, the method further comprises introducing the exogenous nucleic acid sequence into the intact cell. In some aspects, the exogenous nucleic acid sequence is integrated into the genome of the intact cell. In some aspects, the probe sequence of at least one probe of the first plurality of probes comprises an oligonucleotide sequence. In some aspects, the probe sequence of at least one probe of the first plurality of probes comprises an amino acid sequence. In some aspects, the second plurality of probes bound to the exogenous nucleic acid sequence is less than 250 probes, less than 200 probes, less than 150 probes, less than 100 probes, less than 80 probes, less than 60 probes, less than 50 probes, less than 40 probes, less than 30 probes, less than 20 probes, less than 15 probes, less than 10 probes, or less than 8 probes. In some aspects, the method further comprises binding at least a portion of the second plurality of probes to the nucleic acid sequence In some aspects, the method further comprises washing the intact cell after contacting the nucleic acid sequence with the second plurality of probes. In some aspects, the probe sequence of at least one probe of the second plurality of probes comprises an oligonucleotide sequence. In some aspects, the probe sequence of at least one probe of the second plurality of probes comprises an amino acid sequence.

In some aspects, the probe comprises 30 to 60 nucleotides. In further aspects, the probe comprises 40 nucleotides. In some aspects, the probe comprises a GC content of from 25-70%, exhibits less than 3 hits of the probe to a genomic sequence, wherein the hit comprises at least 50% of contiguous homology to a genomic sequence, and less than 300 matches to a 16-mer database of human genomic sequences. In some aspects, the probe can bind to a top strand or a bottom strand of the viral nucleic acid sequence. In some aspects, the probe can bind to a plus strand or a minus strand of the exogenous nucleic acid sequence. In some aspects, the first detectable label is a fluorescent dye molecule. In further aspects, the second detectable label is a fluorescent dye molecule.

In some aspects, the plurality of probes is not blocked with a blocking agent prior to contacting the plurality of probes with the intact cell. In further aspects, the blocking agent is Cot-1 DNA, salmon sperm DNA, yeast tRNA, or any combination thereof. In some aspects, the probe comprises less than 1 repetitive element, wherein the repetitive comprises a short interspersed nuclear elements (SINE), an ALUs, a long interspersed nuclear elements (LINE), a long terminal repeat elements (LTR) including retroposons, a DNA repeat elements, a simple repeats (micro-satellites), a low complexity repeats, a satellite repeats, a RNA repeat, or a class RC. In some aspects, the viral nucleic acid sequence comprises DNA.

In other aspects, the viral nucleic acid sequence comprises RNA. In some aspects, the probe comprises a GC content of from 25-70%. In some aspects, the GC content of each probe within the plurality of probes varies by less than 5 to 10%. In other aspects, the single detectable agent is located at the 5' end of the first probe or at any nucleotide of the first probe. In some aspects, a signal to noise ratio of about 1.2-1.5 to 1, 1.5:1, 4-8 to 1, or 5-10:1 is observed. In some aspects, the plurality of probes binds endogenous and exogenous genes. In some aspects, the viral nucleic acid sequence is double stranded. In some aspects, the probe has less than 300 matches to a 16-mer database of human genomic sequences, exhibits less than 3 hits of the oligonucleotide probe to a genomic sequence, wherein the hit comprises at least 50% of contiguous homology to a genomic sequence, is capable of binding to the plus strand of the exogenous nucleic acid sequence and a second probe is capable of binding to the minus strand of the exogenous nucleic acid sequence, 5 nucleotides at a 3' end of the first probe, which are complementary to 5 nucleotides at a 5' end of a second probe of the plurality of probes, 5 nucleotides at a 5' end of the first probe, which are complementary to 5 nucleotides at a 3' end of a second probe of the plurality of probes, and a linear structure comprising 30-60 nucleotides and a single detectable agent coupled to a first nucleotide at a 3' end of the probe. In some aspects, the method further comprises denaturing a DNA of the cell prior to contacting the plurality of probes with the cell. In some aspects, the denaturing the DNA of the cell comprises incubating the cell for 4.5 minutes in 70% formamide at a temperature of 78° C. In some aspects, the probe has less than 1 hit to a genomic sequence, wherein the hit comprises at least 75% of contiguous homology to a genomic sequence.

In various aspects, the present disclosure provides a probe set comprising a plurality of unique probes, wherein: each probe comprises a detectable label and a probe sequence that binds to a portion of a target viral nucleic acid sequence in an intact cell; and the target viral nucleic acid sequence comprises at least 90%, at least 95%, at least 98%, at least 99%, or at least 100% sequence identity to SEQ ID NO: 1282, SEQ ID NO: 1283, SEQ ID NO: 1284, SEQ ID NO: 1285, or a fragment thereof. In some aspects, the target viral nucleic acid sequence is at least 200 nucleotides in length, 250 nucleotides in length, 300 nucleotides in length, 350 nucleotides in length, 400 nucleotides in length, 450 nucleotides in length, 500 nucleotides in length, 550 nucleotides in length, or 600 nucleotides in length. In some aspects, the target comprises a length of not more than 10 kilobases, not more than 8 kilobases, not more than 6 kilobases, not more than 4 kilobases, or not more than 3 kilobases, not more than 2 kilobases, not more than 1.5 kilobases, or not more than 1 kilobases. In some aspects, the detectable label is optically detected when the probe is bound to a portion of the target viral nucleic acid sequence in the intact cell.

In some aspects, each probe sequence comprises between 20 and 80 nucleotides. In some aspects, the probe set comprises at least 8 and not more than 145 unique probes.

In some aspects, the intact cell is a hematopoietic progenitor cell, a monocyte, a macrophage, a microglia, a neuron, or a T-cell. In some aspects, the target viral nucleic acid sequence is integrated into the genome of the intact cell. In various aspects, the present disclosure provides a kit comprising a probe set and a set of instructions for the method of any one the methods disclosed herein. In some aspects, the probe set comprises the probe set of any one the probes sets disclosed herein.

In various aspects, the present disclosure provides a method for assessing a phenotype of an intact genetically modified cell, the method comprising: a) providing the intact genetically modified cell comprising a target nucleic acid sequence less than 2.5 kilobases in length; b) contacting the intact genetically modified cell with a first plurality of probes, wherein each probe comprises a first detectable label and a probe sequence that binds to a portion of the target nucleic acid sequence; c) detecting a presence of the first detectable label in the intact cell, wherein the presence of the first detectable label indicates the presence of the target nucleic acid sequence; d) determining a phenotype of the intact genetically modified cell; and e) correlating the phenotype of the intact genetically modified cell with the presence of the target nucleic acid sequence. In some aspects, the intact genetically modified cell is a eukaryotic intact genetically modified cell. In some aspects, the phenotype is a product expressed due to a genetic modification in the intact genetically modified cell, a quality of the product expressed due to the genetic modification in the intact genetically modified cell, or a combination thereof. In some aspects, the phenotype is an increased or decreased expression of the product, an increase or a decrease in the quality of the product, or a combination thereof. In some aspects, the method further comprises determining a number or location of genetic modifications in the intact genetically modified cell. In some aspects, the product expressed is a transgene protein, RNA, or a secondary product of the genetic modification. In some aspects, the method further comprises: f) selecting a first intact genetically modified cell comprising a phenotype of interest; g) determining a set of conditions used for a genetic modification of the first intact genetically modified cell; and h) preparing a second genetically modified cell using the set of conditions for genetic modification.

In some aspects, the methods disclosed herein further comprise determining a transduction efficacy of a vector by calculating the number of exogenous nucleic acid sequences in the cell.

In various aspects, the present disclosure provides for a method for determining transduction efficacy of a vector in a cell, the method comprising: a) contacting the cell with any composition disclosed herein; b) detecting a presence of a first detectable label in the cell population, wherein the presence of the first detectable label indicates the presence of the exogenous nucleic acid sequence; and c) determining the transduction efficacy of the vector by calculating the number of exogenous nucleic acid sequences in the cell.

In some aspects, the method further comprises determining the transduction efficacy of the vector by calculating the number of exogenous nucleic acid sequences in the intact cell.

EXAMPLES

These examples are provided for illustrative purposes only and not to limit the scope of the claims provided herein.

Example 1

DNase Treatment and TUNEL Assay

A TUNEL assay as described below may be used to label DNaseI cut sites on a global cell. For example, all of the DNaseI cut sites within a cell's nucleus may be labeled.

Cells were prepared for a 2-color SPDM for DNA density and DNase I sensitivity (TUNEL) assay.

An adherent cell line, A549 (lung adenocarcinoma), was used for these experiments. They were plated overnight on uncoated 18 mm (#1 thickness) coverslips. Cells were deliberately plated sparsely to be ~20% confluent on the day of the assay.

For all coverslips, cells were fixed with 4% formaldehyde in PBS for 10 minutes at room temperature, and then equilibrated in buffer A at room temperature for 15 minutes. The cells were permeabilized with 0.1% NP-40 in buffer A for 10 minutes at room temperature.

The DNaseI assay was performed with 80 Um' DNaseI for 3 minutes at 37° C. Cells were then post fixed in 4% formaldehyde in buffer A for 10 minutes at room temperature. The coverslips were permeabilized for 20 minutes with buffer A with 0.25% TX-100, and washed twice with distilled water and were equilibrated with 100 µl of TdT reaction buffer for 10 minutes at room temperature. The terminal deoxynucleotide transferase (TdT) reaction with EdUTP-alkyne (100 µl per coverslip) was performed for 1 hour at 37° C. At the end of the TdT reaction, the coverslips were washed twice with 3% BSA/PBS. The ClickIT reaction was then performed for 2 coverslips to add Alexafluor647 to incorporated EdUTP-alkyne. This reaction was performed for 30 minutes at room temperature, in the dark. The other coverslips were kept in 3% BSA/PBS at room temperature. The coverslips were washed once with 3% BSA/PBS before being stained with Vybrant Violet staining and imaged by a SMLM method.

Figure 3A:
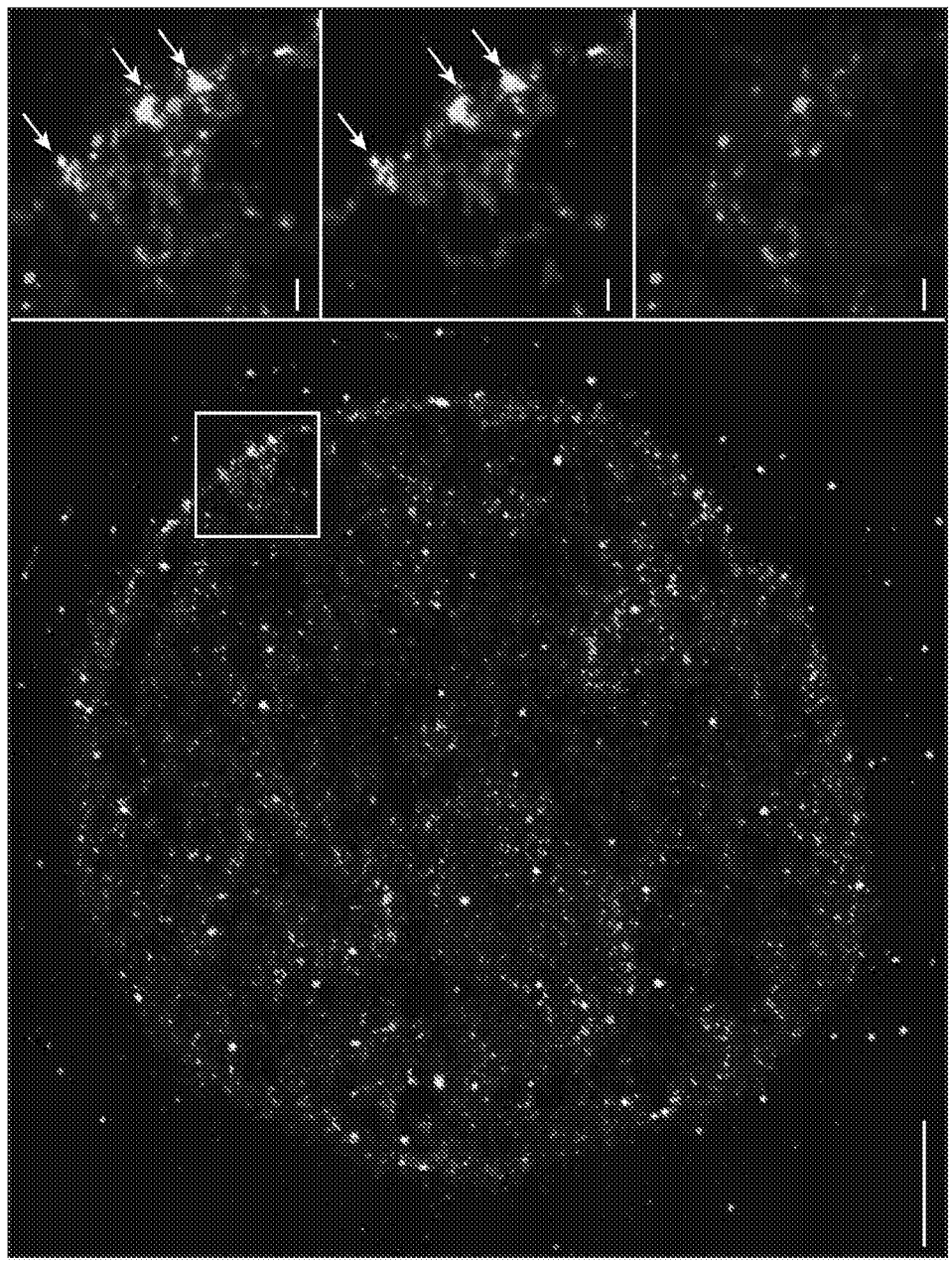
FIG. 3A shows a two color SPDM image (experimental) of chromatin (blue) with DNA sensitive element sites (red), showing anti-colocalization of the DNA sensitive element sites with chromatin. Scale bars: 1000 nm, inserts: 100 nm. The bottom right panel shows chromatin (blue), the middle right panel shows DNA sensitive element sites (red), and the top right panel shows the overlay and the anti-colocalization of the DNA sensitive element with chromatin.
Figure 3B:
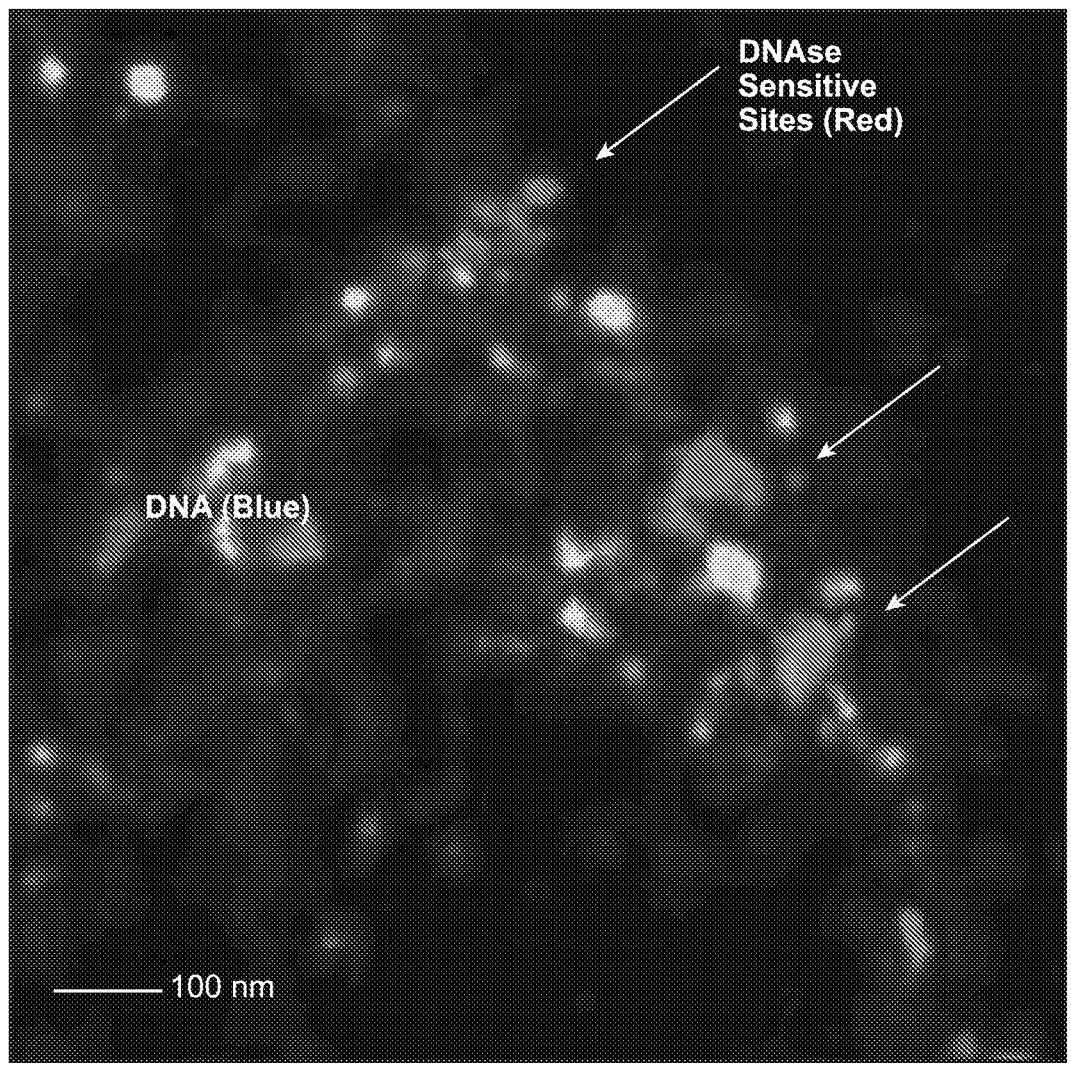
FIG. 3B is the inset of FIG. 3A.

FIG. 3A shows a two color SPDM image (experimental) of chromatin (blue) with a DNA sensitive element (red), showing anti-colocalization of the DNA sensitive element with chromatin. Scale bars: 1000 nm, inserts: 100 nm. FIG. 3B is the inset of FIG. 3A.

Figure 4A:
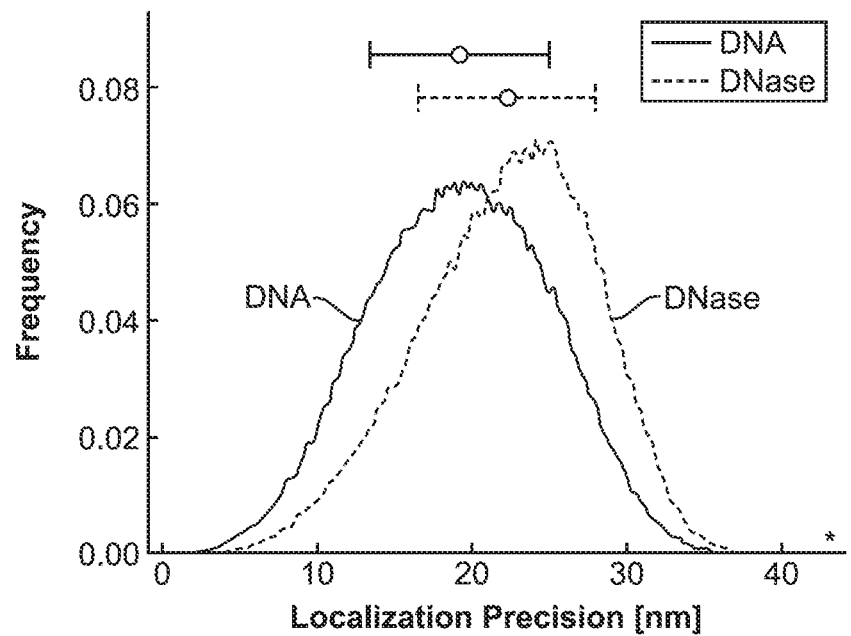
FIG. 4A and FIG. 4B illustrate the localization precision and nearest neighbor distances for DNA and DNase sensitive elements.
Figure 4B:
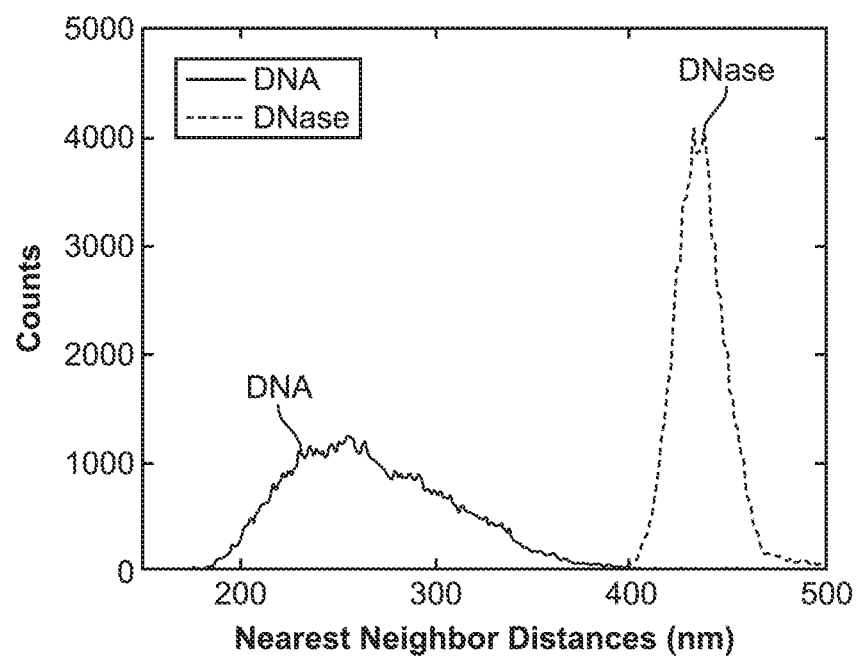

FIG. 4A and FIG. 4B illustrate the localization precision and nearest neighbor distances for DNA and DNase sensitive elements.

Example 2

DNA Encoding of Molecular Targets on a Multi-Omics Imaging Platform

Integration of imaging data across different molecular target types may provide in-depth insights into cell physiology and pathology. A multi-omics imaging platform is utilized which enables simultaneous visualization of multiple molecular targets irrespective of target type and imaging probes used. The multi-omics imaging platform comprises (i) decoupling of target binding and labeling steps, (ii) translation of heterogeneous molecular information into an intermediate standardized molecular code amenable to readout via imaging probes, and (iii) employing encoding capacity and self-assembly capabilities of DNA bonding. Specifically, molecular targets of interest are first encoded with unique ssDNA tags via binding by ssDNA-conjugated target-recognition moieties under optimized conditions favoring specific target binding. Individual ssDNA tags are then converted into detectable signals via sequence-specific hybridization with complementary ssDNA'-conjugated imaging probes under probe-optimized conditions. As such, molecular target uniqueness, localization, abundance, and specimen morphology information are preserved through all steps of labeling procedure, producing comprehensive molecular signatures of a physiological or pathological process.

Methods

Oligonucleotide probe design. Sequences for 6 ssDNA/ssDNA' encoding pairs were selected from a random pool. Selection criteria were: continuous 16 bp complementarity, balanced nucleotide composition, lack of stable secondary structures at room temperature, lack of substantial cross-hybridization between mismatch pairs. See TABLE 9 for a complete list of ssDNA/ssDNA' encoding pairs.

Sequences for human GAPDH mRNA (NM_002046.5) and HSP90-alpha mRNA (NM_001271969.1) were obtained from NCBI. Sets of mRNA in situ hybridization (ISH) probes were designed using Stellaris RNA FISH Probe Designer (Biosearch Technologies). Probe sets contained 36 unique probes for GAPDH mRNA and 48 probes for HSP90-alpha mRNA. Each probe featured 5' terminal 20 nt-long region complementary to mRNA, a spacer (either AAAAA for smaller 41 nt probes or AAAA-dsSpacer-AAAA for longer 60 nt probes), and a 16 nt-long QDot binding tag. The ISH probe strand of the dsSpacer was 5'-TTCCCAAGCGTCATCT-3' (SEQ ID NO: 1286), prehybridized with a complementary 5'-AGATGACGCTTGG-GAA-3' ssDNA (SEQ ID NO: 1287) at a 1:1 molar ratio to form a 16 bp dsDNA spacer prior to specimen labeling. See TABLE 10 and TABLE 11 for a complete list of ISH probes. All oligonucleotides were purchased from IDT DNA.

Antibody-ssDNA conjugation. Purified primary and secondary antibodies in PBS were purchased from Sigma-Aldrich. Amine-terminated HPLC purified ssDNA tags were purchased from IDT DNA (see TABLE 9, Tag IDs 1B-6B). Covalent antibody-ssDNA bioconjugation was achieved either a) via maleimide-mediated amine-sulfhydryl crosslinking or b) using Thunder-Link oligo conjugation system (Innova Biosciences).

For maleimide-mediated crosslinking, IgG was partially reduced by TCEP to expose free sulfhydryl groups, while 5' amine-terminated ssDNA oligonucleotides were activated by sulfo-SMCC (Thermo Scientific). IgG was diluted to 1 mg/mL in 100 μL PBS with 10 mM EDTA, mixed with 0.5 mM TCEP, and incubated for 30 min at 37° C. At the same time, ssDNA was diluted to 40 μM in 100 μL PBS, mixed with 10 mM sulfo-SMCC, and incubated for 30 min at RT. Reduced IgG and activated ssDNA were then purified by 3 rounds of desalting in Zeba desalting spin columns (Thermo Scientific) pre-washed with PBS/10 mM EDTA, mixed, and reacted for 4 hrs at room temperature (RT). Finally, unreacted sulfhydryl groups were capped by addition of 1 mM sulfo-SMCC pre-quenched by excess glycine. Antibody-ssDNA bioconjugates were purified by ultrafiltration for at least 6 times with Amicon Ultra 50 KDa MWCO centrifugal filter (Millipore) and stored in PBS solution at 4° C.

For antibody-ssDNA conjugation with Thunder-Link oligo conjugation system, IgG was diluted to 1 mg/mL in 100 μL PBS, activated by the Antibody Activation Reagent for 1 hr at RT, and purified using desalting column. At the same time, 5' amine-terminated ssDNA oligonucleotides were diluted to 80 μM in 100 μL PBS, activated by the Oligo Activation Reagent for 1 Hr at RT, and desalted. Activated IgG and ssDNA were mixed at a volume ratio of 2:1 (200 μL IgG+100 μL ssDNA+100 μL wash buffer), reacted overnight at RT, and stored at 4° C. For optimization studies, following IgG:ssDNA volume ratios were tested: 50+50, 50+30, 50+20, and 50+10.

QDot-ssDNA conjugation. Amine-functionalized PEG-coated QDots (Qdot ITK amino (PEG) quantum dots, Invitrogen) with emission peaks centered at 525, 545, 565, 585, 605, and 655 nm were used for the preparation of QDot-ssDNA probes. Amine-terminated HPLC purified 16 nt-long ssDNA tags were purchased from IDT DNA (see TABLE 10, Tag IDs 1A-6A). Oligonucleotides were activated with bifunctional cross-linker BS3 (Bis[sulfosuccinimidyl] suberate, Thermo Scientific), followed by covalent conjugation with QDots. 100 μL 40 μM ssDNA solution in PBS was mixed with 500 molar excess of BS3 and incubated for 30 minutes at room temperature. Excess crosslinker was removed by 3 rounds of desalting in Zeba desalting spin columns (Thermo Scientific) pre-washed with PBS. Activated ssDNA was then mixed with 25 μL 8 μM stock QDot solution. The reaction was incubated overnight at room temperature and purified by ultrafiltration for at least 6 times with Amicon Ultra 100 KDa MWCO centrifugal filter (Millipore). Purified QDot-ssDNA probes were stored in PBS solution at 4° C.

Agarose gel electrophoresis was used for characterization of QDot-ssDNA probes. Procedure was performed on a 2% agarose gel in 1×TBE at 90V for 2 hrs.

Cell culture and processing. Human cervical cancer cell line HeLa (ATCC) was used as a model specimen for evaluation of the multi-omics imaging via DNA encoding. Cells were grown in glass-bottom 24-well plates (Greiner Bio-One) in a humidified atmosphere at 37° C. with 5% $CO_2$ to a density of 80-90% using MEM culture medium with L-glutamine (Gibco) supplemented with 10% fetal bovine serum (Gibco). Prior to labeling, cells were rinsed with PBS, fixed with 4% formaldehyde in PBS for 5 min at room temperature followed by 15 min at 4° C., permeabilized with ice-cold 0.5% TritonX-100 (Thermo Scientific) in PBS for 15 min at 4° C., and washed with PBS. For mRNA imaging, cells were immediately processed for in situ hybridization to minimize degradation of mRNA prior to labeling. For protein imaging only, fixed cells could be stored in PBS with 0.03% sodium azide at 4° C. for several days.

Encoding via immunorecognition. Encoding of protein targets in formalin-fixed cells was performed via incubation with antibody-ssDNA bioconjugates. Prior to labeling, cells were blocked by 2% BSA (from 10% BSA/PBS solution, Thermo Scientific), 0.5% Western blot blocking reagent (from 10% solution, Roche), 0.1% low MW dextran sulfate (9-20 kDa MW, Sigma-Aldrich), 0.1 mg/mL shredded salmon sperm DNA (Invitrogen), and 1×PBS for 30 min at RT. Antibodies were used at a final concentration of 5 μg/mL diluted in 2% BSA, 0.1% dextran sulfate, 0.1 mg/mL shredded salmon sperm DNA, and 1×PBS and incubated with cells for 1-2 hrs at RT. Following labeling, cells were washed with PBS.

For reference studies, cell labeling with unmodified antibodies was performed in a similar fashion.

Encoding via in situ hybridization (ISH). Encoding of mRNA targets was performed via hybridization with ssDNA-tagged mRNA ISH probes. Cells were equilibrated with 10% formamide (Thermo Scientific), 2 mM RVC (New England BioLabs), 2×SSC (Invitrogen) buffer for 30 min at RT and then incubated with 400 μL/well 250 nM mix of mRNA ISH probes in 1% dextran sulfate (>500 kDa MW, Sigma-Aldrich), 1 mg/mL tRNA (from *E. coli*, Roche), 10% formamide, 2 mM RVC, 2×SSC hybridization buffer for 4 hrs (or overnight) at 37° C. Following hybridization, cells were washed with warm 10% formamide, 2×SSC buffer for 30 min at 37° C., two changes of 1×PBS for 10 min at RT, and blocked by 2% BSA, 0.5% Western blot blocking reagent, 0.1% low MW dextran sulfate, 0.1 mg/mL shredded salmon sperm DNA, 1×PBS for 30 min at RT.

Encoding for multi-omics studies. Encoding of protein and mRNA targets on the same specimen was performed by combining immunorecognition and in situ hybridization procedures. First, cells were hybridized with ssDNA-tagged mRNA ISH probes as described above. Following hybridization and washing, cells were blocked, incubated with antibody-ssDNA bioconjugates for 1-2 hrs at RT, and washed with PBS.

Specimen labeling with QDot probes. Following encoding of targets with ssDNA tags, cells were simultaneously labeled with complementary QDot-ssDNA' probes. QDots were used at a final concentration of 5 nM in 2% BSA, 0.1% low MW dextran sulfate, 0.1 mg/mL shredded salmon sperm DNA, 1×PBS and incubated with cells for 2-4 hrs at RT. Following staining cells were washed with PBS. Optionally, nuclei could be counter-stained by a 5-min incubation with DAPI.

For reference immunofluorescence studies, cell staining with QDots functionalized with secondary Ab fragments (Qdot goat F(ab')2 anti-mouse or anti-rabbit IgG conjugates (H+L), Invitrogen) was performed in a similar fashion.

RNAi. Knock-down of GAPDH expression was done via cell transfection with GAPDH siRNA (Ambion). For forward transfection, cells were grown in a glass-bottom 24-well plate overnight and then treated with 500 μl/well culture medium containing 25 nM GAPDH siRNA and 0.5 μl/well DharmaFECT-2 transfection reagent (Dharmacon) for 24 hrs. For reverse transfection, cells were grown in a 10 cm TC-treated dish, trypsinized, mixed in suspension with culture medium containing 25 nM GAPDH siRNA and 0.5 μl/well DharmaFECT-2 transfection reagent, seeded into a glass-bottom 24-well plate at 500 μl/well cell suspension, and incubated for 24 hrs or 48 hrs. Following transfection, cells were processed for staining. Triplicate samples were also prepared for RT-PCR analysis.

RT-PCR analysis. Total RNA was isolated from cell pellets using TRIzol reagent (Invitrogen) according to the manufacturer's protocol. Two hundred nanograms of RNA was converted to cDNA using random hexamer primer and MultiScribe Reverse Transcriptase Reagent (Applied Biosystems). One hundred nanograms of cDNA was amplified by the Real-Time PCR using SensiFAST™ Real-Time PCR Kits (Bioline, UK) on Chromo4 Real-Time PCR detection system (Bio-Rad). The primers used for GAPDH amplification were 5'-TCGCTCTCTGCTCCTCCTGTTC-3' (forward primer; SEQ ID NO: 1288) and 5'-CGCC-CAATACGACCAAATCC-3' (reverse primer; SEQ ID NO: 1289). Cyclophilin A (PPIA) was used as an internal control, and the primers were 5'-GTCAACCCCACCGTGTTCTTC-3' (forward primer; SEQ ID NO: 1290) and 5'-TTTCTGCTGTCTTTGGGACCTTG-3' (reverse primer SEQ ID NO: 1291). To confirm the PCR specificity, PCR products were subjected to a melting-curve analysis. The comparative threshold ($C_t$) method was used to calculate the relative mRNA amount of the treated sample in comparison to control samples. Mean value from triplicate samples was reported.

Imaging and signal analysis. IX-71 inverted fluorescence microscope (Olympus) equipped with a true-color CCD (QColor5, Olympus) and a hyperspectral imaging camera (Nuance, 420-720 nm spectral range, CRI, now PerkinElmer) was used for cell imaging. Low-magnification images were obtained with ×20 dry objective (NA 0.75, Olympus) and high-magnification with ×40 (NA 1.30, Olympus) and ×100 (NA 1.40, Olympus) oil-immersion objectives. Wide UV filter cube (330-385 nm band-pass excitation, 420 nm long-pass emission, Olympus) was used for imaging of all QDot probes, while Rhodamine LP cube (530-560 nm band-pass excitation, 572 nm long-pass emission, Chroma) was used for Alexa Fluor 555 detection. All images were acquired with cells attached to the coverslip bottom of the well and immersed in PBS without use of anti-fading reagents.

Nuance image analysis software was used to unmix the obtained multispectral images based on the reference spectra of each QDot component along with an extra channel for background fluorescence. In a false-color composite image, brightness and contrast of each channel was automatically adjusted for best visual representation and clear depiction of relative target distribution, unless noted otherwise. For direct comparison of QDot staining intensity individual QDot channels were normalized.

Figure 5A:
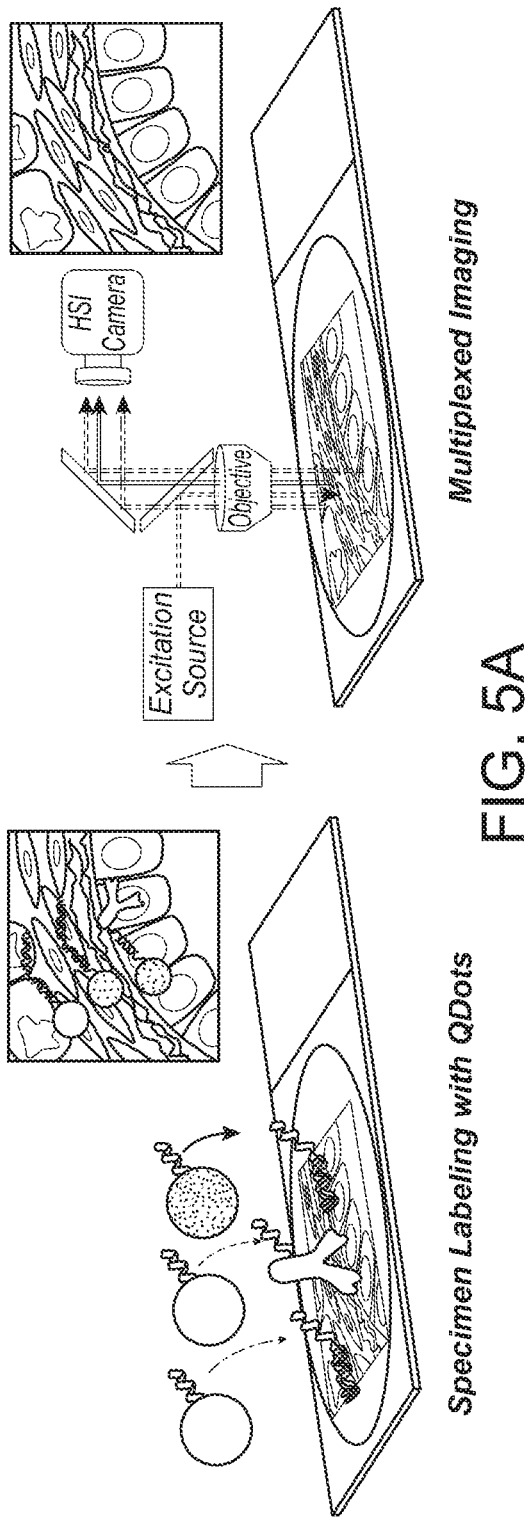
FIG. 5A and FIG. 5B illustrate multi-omics imaging via encoding of molecular information with ssDNA tags.
Figure 5B:
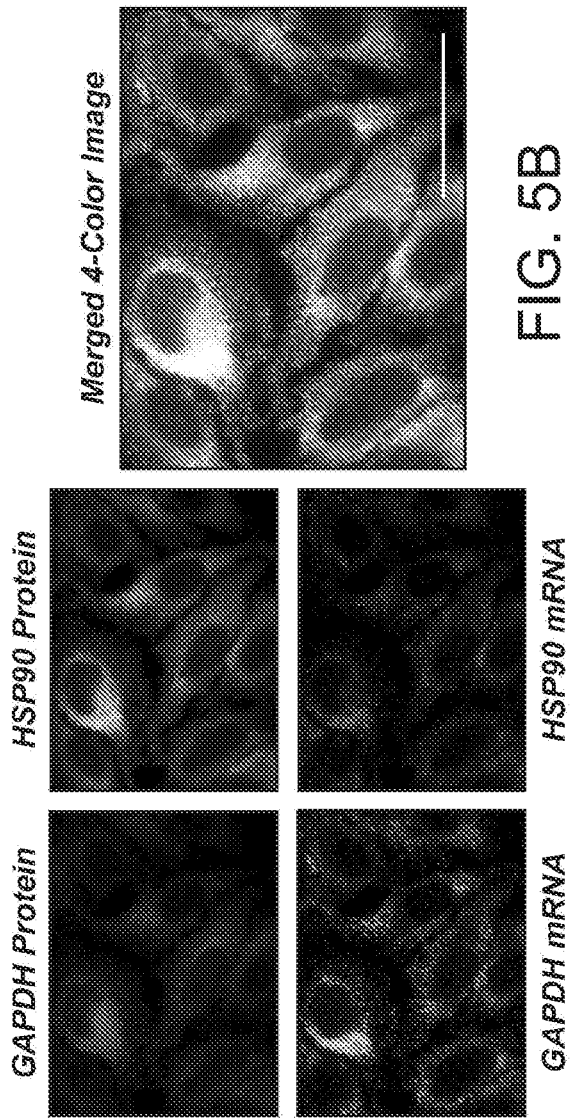
Figure 6:
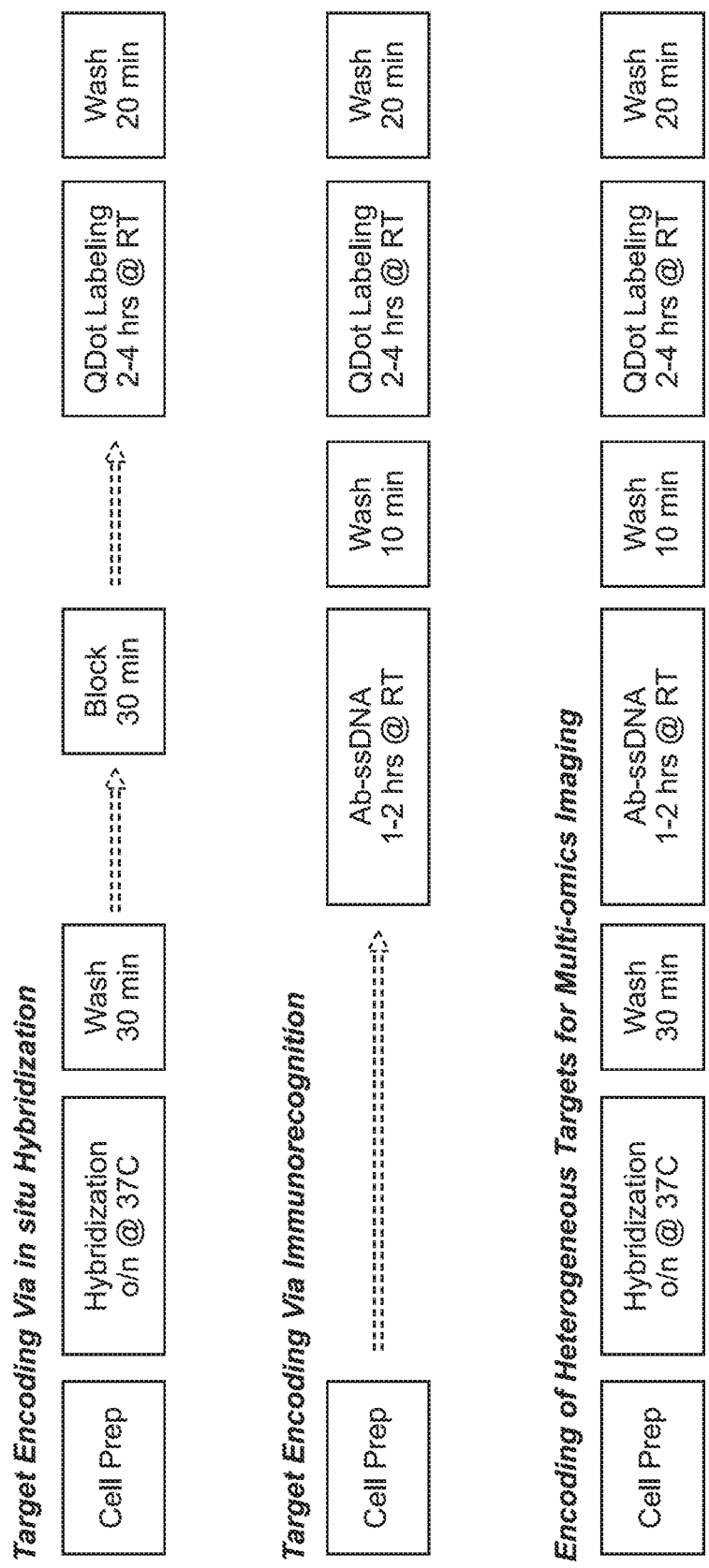
FIG. 6 shows a workflow for target encoding and labeling via in situ hybridization, immunorecognition, and multiomics procedures. DNA encoding methodology allows for labeling of different types of targets (mRNA and proteins in this proof-of-concept study) under conditions optimized for selective target binding in separate steps. As a result, all targets are converted into a uniform array of intermediate ssDNA tags, which are then simultaneously labeled by complementary QDot-ssDNA' probes for multiplexed imaging.

DNA Encoding for Multi-Omic Imaging Studies. To demonstrate the DNA encoding for multi-omics imaging studies concurrent analysis of single-cell molecular expression profiles at mRNA and protein levels were performed. Fluorescent quantum dot probes (QDots) in combination with fluorescence microscopy and hyperspectral imaging (HSI) were employed for simultaneous visualization of all ssDNA tags following separate encoding of mRNA and protein targets (FIG. 5A). For example, GAPDH and HSP90-alpha mRNA molecules and their respective product proteins can be readily labeled by 4-color QDots to highlight relative intracellular distribution and abundance of the two target types at a single-cell level (FIG. 5B). Unlike direct labeling procedures performed at a single incubation condition fixed for all targets and probes, DNA encoding enables tuning of conditions to favor recognition of individual target types and hybridization with detection probes in separate steps, offering great flexibility in choice of specimens, targets, and imaging systems (FIG. 6).

Figure 7A:
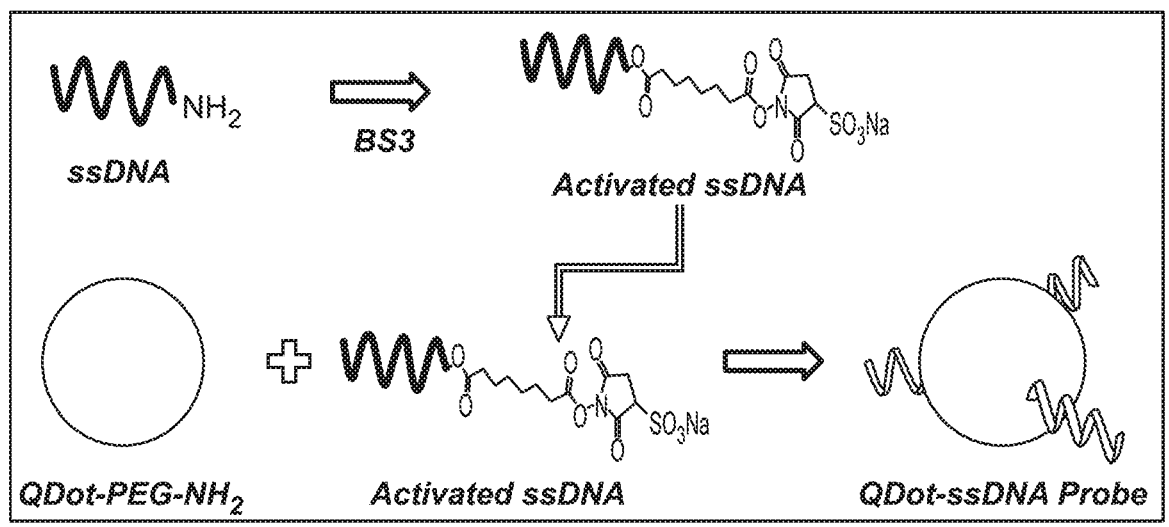
FIG. 7A and FIG. 7B illustrate a schematic and characterization of QDot-ssDNA probe preparation.
Figure 7B:
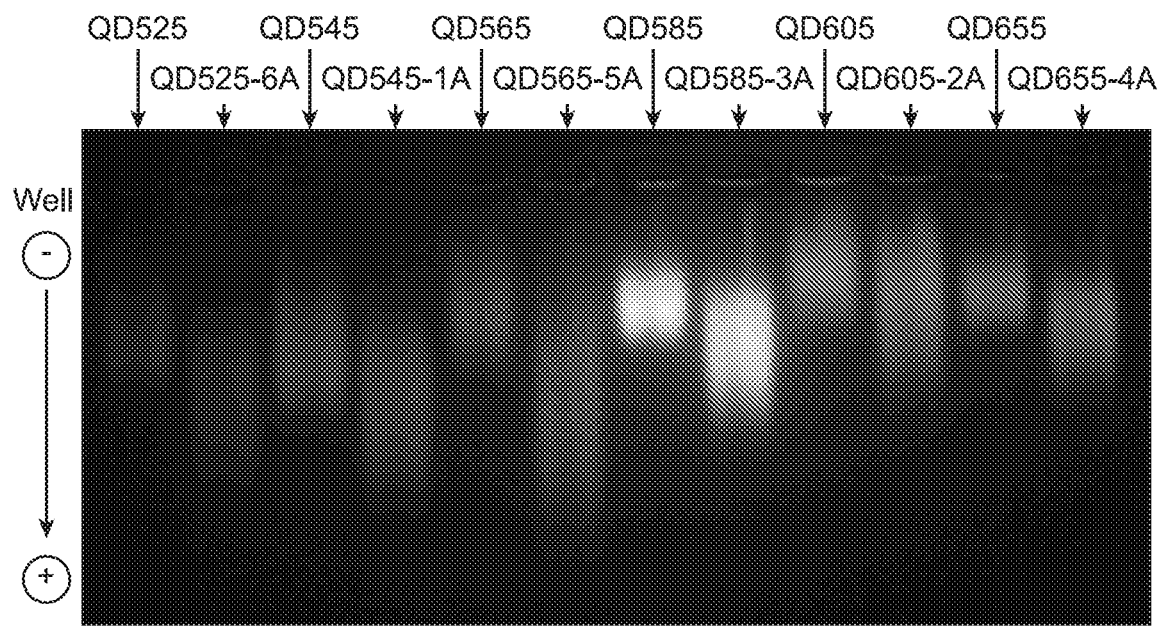
Figure 8A:
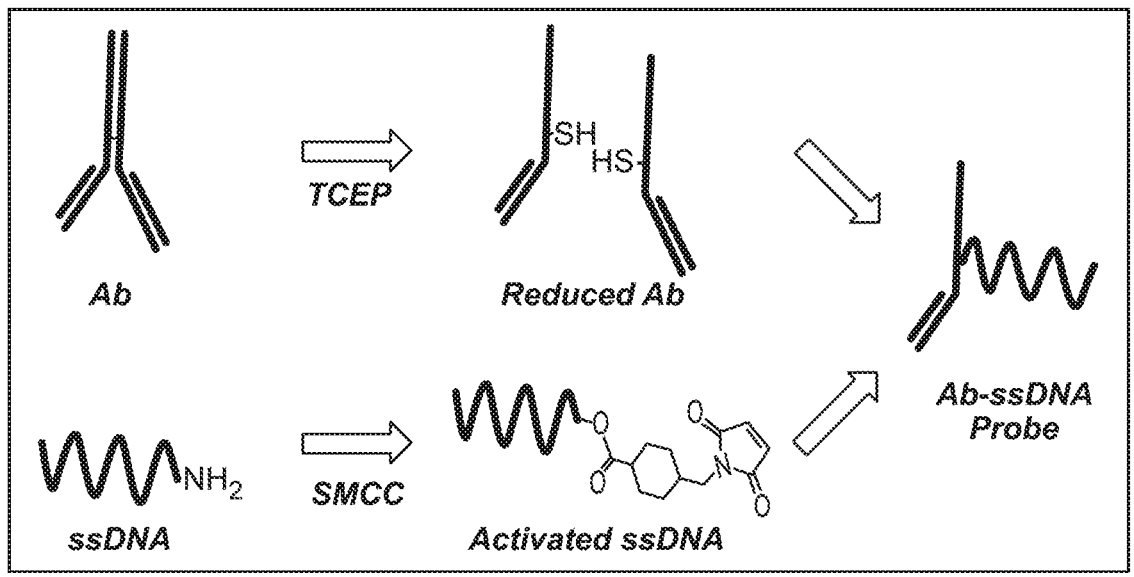
FIG. 8A and FIG. 8B show a schematic and characterization of antibody-ssDNA bioconjugate preparation via maleimide-mediated crosslinking.
Figure 8B:
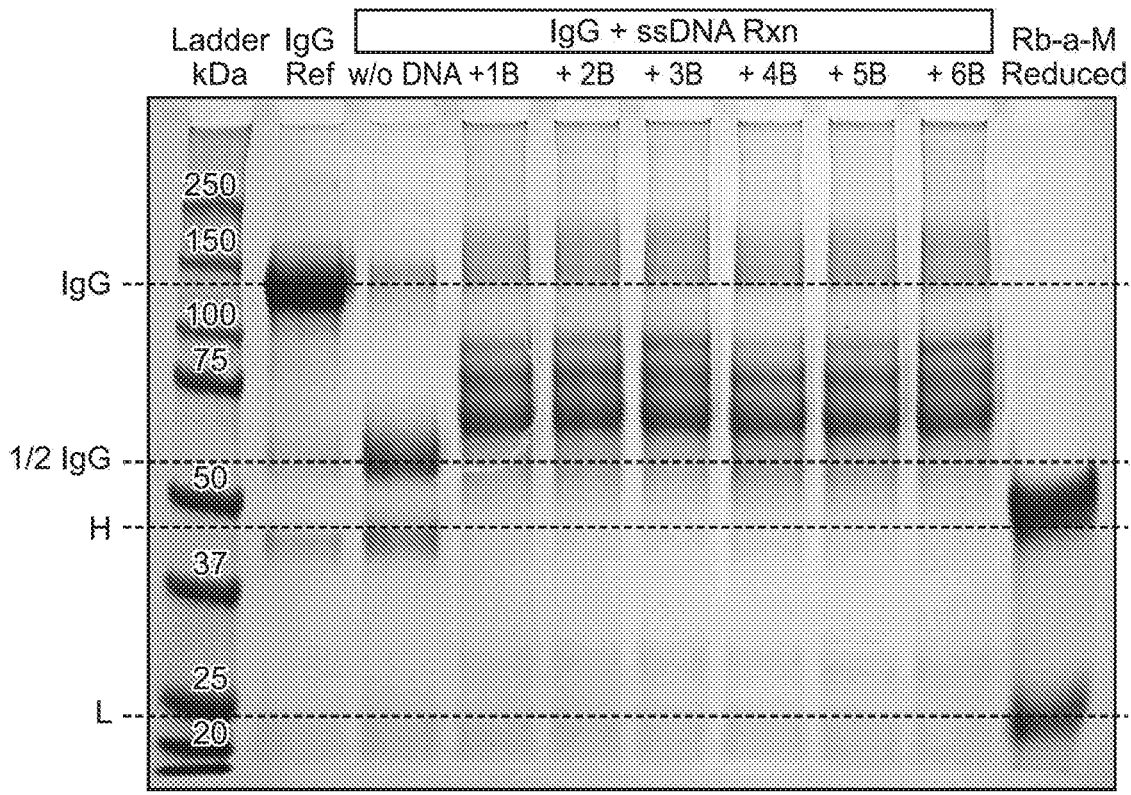

QDot-based Multi-Omics Imaging Platform. To implement and systematically characterize the model QDot-based multi-omics imaging platform, a set of 6 unique 16 bp ssDNA/ssDNA' linkers was developed for encoding of up to 6 different molecular targets (TABLE 9) along with a library of complementary 6-color QDot-ssDNA probes (FIG. 7A and FIG. 7B) and a control set of 6 secondary antibody-ssDNA (2'Ab-ssDNA) bioconjugates (FIG. 8A and FIG. 8B). Indirect labeling of β-tubulin in HeLa cells via a β-step procedure involving incubation with unmodified primary antibodies, 2'Ab-ssDNA bioconjugates, and complementary QDot-ssDNA' probes demonstrated preserved antigen-recognition functionality of ssDNA-modified antibodies and high specificity of QDot staining via DNA hybridization (FIG. 9).

Figure 10A:
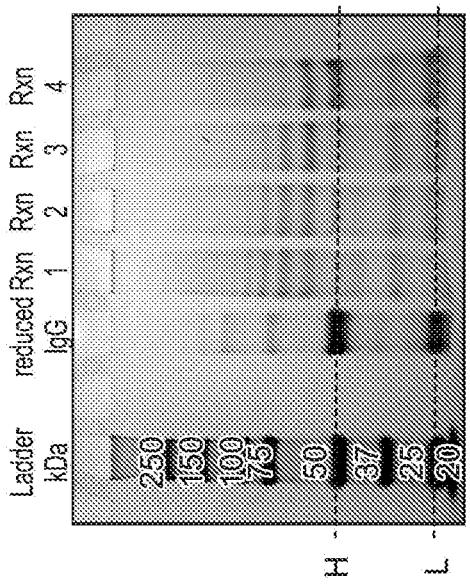
FIG. 10A, FIG. 10B, and FIG. 10C show a schematic and characterization of antibody-ssDNA bioconjugate preparation using the Thunder-Link oligo conjugation system. A 2-step amine crosslinking strategy as illustrated in FIG. 10A was employed for preparation of covalent antibody-ssDNA bioconjugates with intact IgG. Antibody and 5' amine-terminated ssDNA were simultaneously activated by respective activation reagents, purified via desalting, and reacted overnight, producing IgG with varying number of attached ssDNA tags. The reducing PAGE analysis of FIG. 10B highlights the presence of multiple higher-MW bands corresponding to heavy and light chains conjugated to varying number of ssDNA tags. In the four reaction conditions performed with goat anti-rabbit secondary antibodies, the relative volume ratios of activated IgG to ssDNA were 1) 50+50, 2) 50+30, 3) 50+20, and 4) 50+10. As expected, increasing amount of ssDNA in the reaction leads to more ssDNA tags being conjugated to each IgG molecule.
Figure 10B:
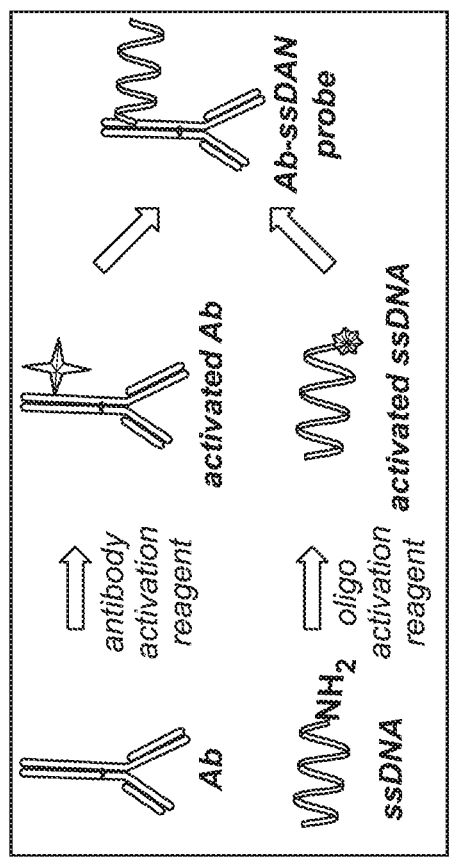
Figure 10C:
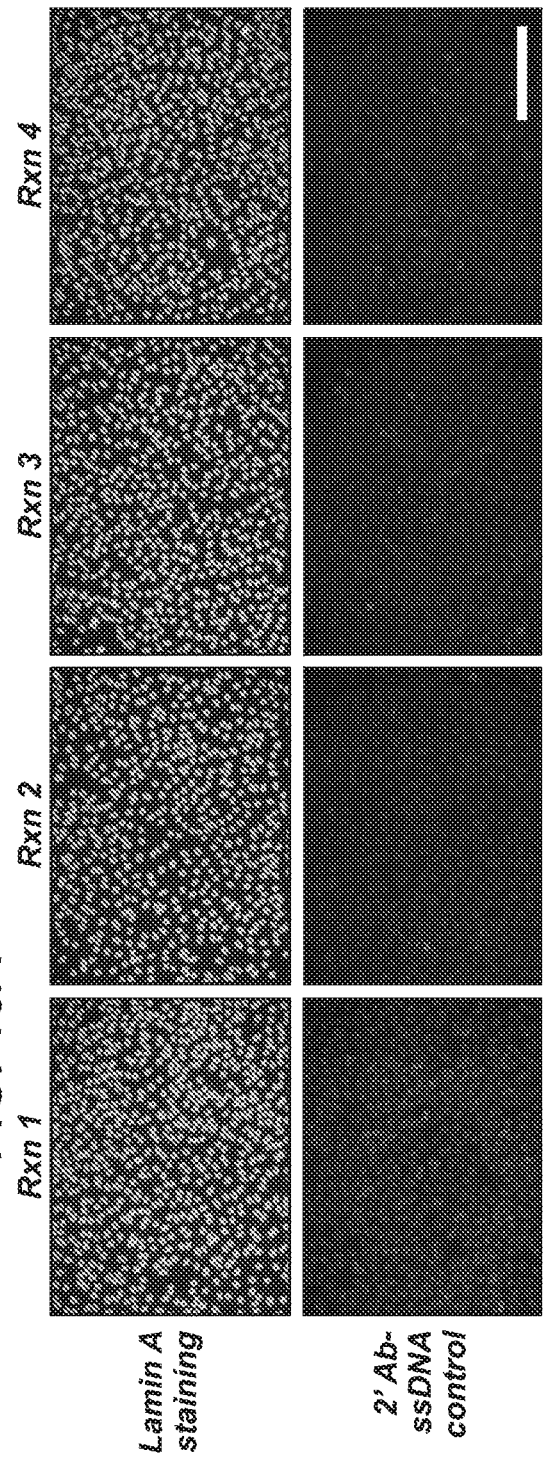
Figures 11A, 11B, 11C, 11D, 11E:
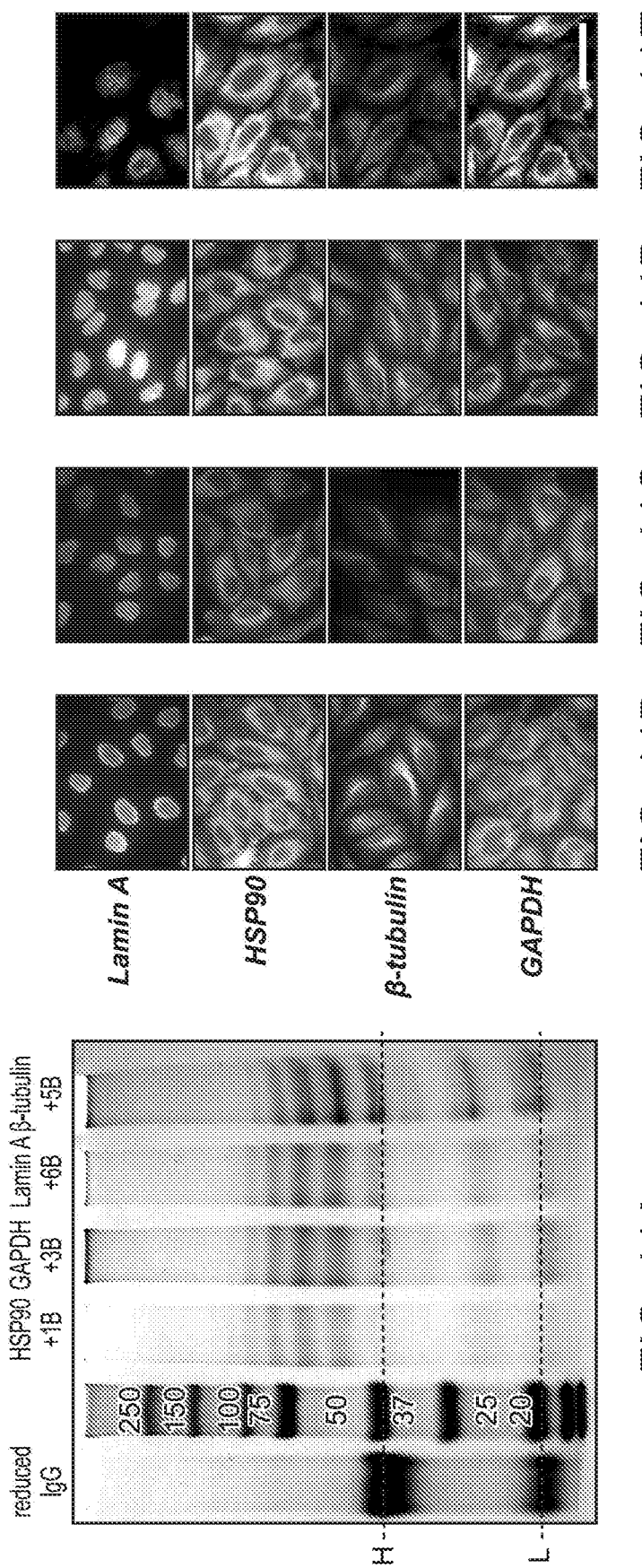
FIG. 11A, FIG. 11B, FIG. 11C, FIG. 11D, and FIG. 11E show multiplexed protein labeling via DNA encoding with a panel of 1' antibody-ssDNA bioconjugates. Primary antibodies against HSP90-alpha, GAPDH, Lamin A, and β-tubulin were conjugated to ssDNA tags using Thunder-Link oligo conjugation system. Reducing PAGE shows consistent formation of IgG-ssDNA bioconjugates for all antibodies (FIG. 11A). Conventional 2-step immunofluorescence with unmodified antibodies and QDot565-2'Ab probes shows characteristic staining pattern for the 4 proteins of interest (FIG. 11B). Protein labeling in FIG. 11C with 1'Ab-ssDNA bioconjugates and QDot565-2'Ab probes yielded staining patterns consistent with the unmodified antibodies of FIG. 11B, confirming the preservation of antigen-binding functionality of 1'Ab-ssDNA. Single-color staining with 1'Ab-ssDNA bioconjugates and complementary QDot-ssDNA' probes further corroborates successful ssDNA conjugation and preparation of an antibody-ssDNA panel suitable for protein labeling via DNA encoding (FIG. 11D). Multiplexed staining via DNA encoding yielded consistent staining patterns for all four proteins in respective spectral channels of the same hyperspectral image (HSI) (FIG. 11E). Individual grayscale channels were false-colored for clarity. Scale bar, 50 μm.

Mutiplex Protein Immuno-labeling. Multiplexed protein immuno-labeling was realized through preparation of a library of primary antibody-ssDNA (1'Ab-ssDNA) bioconjugates (FIG. 10A, FIG. 10B, and FIG. 10C; and FIG. 11A, FIG. 11B, FIG. 11C, FIG. 11D, and FIG. 11E). Characterization of such bioconjugates with PAGE and cell staining confirmed preserved stability and antigen-binding functionality of antibodies, specificity of target staining with QDots in a 2-step procedure, and consistent target identification with different QDot colors in a multiplexed imaging format (FIG. 11A, FIG. 11B, FIG. 11C, FIG. 11D, and FIG. 11E). Nuclear envelope protein Lamin A, microtubule β-tubulin, and cytoplasmic proteins HSP90-alpha and GAPDH were labeled as model target molecules with distinct characteristic intracellular localization.

Figure 12:
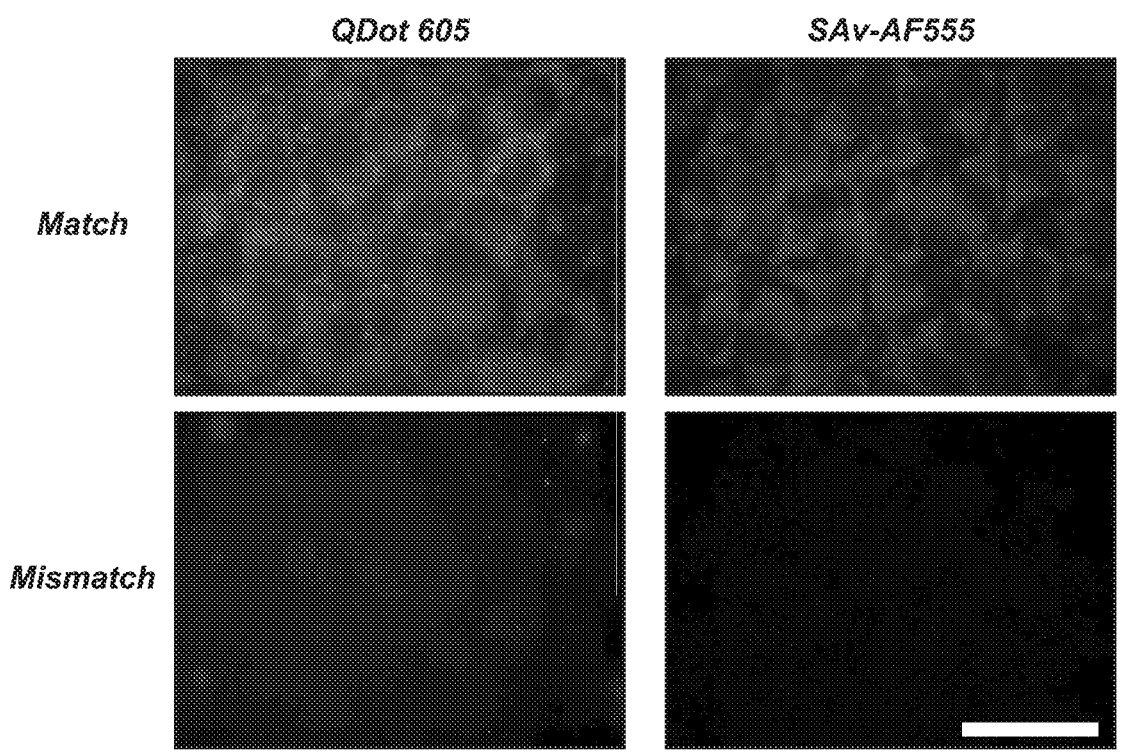
FIG. 12 shows characterization of mRNA labeling intensity and specificity via DNA encoding. GAPDH mRNA was labeled via indirect FISH procedure with 41 nt FISH probe set (see TABLE 10) followed by staining with QDot605-ssDNA probes (left panels) or AlexaFluor555-labeled streptavidin-ssDNA probes (right panels). Consistent characteristic punctuate staining pattern was observed with both complementary imaging probes (top row). At the same time, non-complementary probes (bottom row) failed to hybridize to mRNA in situ hybridization (ISH) probes, confirming staining specificity of the DNA encoding methodology. "Match" and "mismatch" true-color images were obtained at consistent exposure for direct comparison of staining intensity. Scale bar, 50 μm.
Figure 13A:
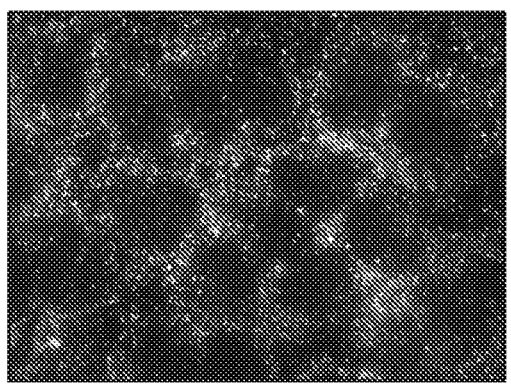
FIG. 13A, FIG. 13B, FIG. 13C, and FIG. 13D illustrates the effect of a dsDNA spacer in an in situ hybridization (ISH) probe on mRNA labeling intensity. Physical separation of mRNA-recognition and QDot-binding portions of 41 nt ssDNA ISH probes with a 16 bp dsDNA spacer prevents formation of secondary structures, promotes hybridization to target mRNA, and reduces steric hindrance to QDot binding. As a result, a substantial increase in mRNA staining intensity was realized with such probes (FIG. 13A) in comparison to 41 nt ssDNA FISH probes (FIG. 13B). At the same time, longer 60 nt ssDNA probes without pre-hybridized dsDNA spacers experienced greater degree of secondary structure formation, which interfered with mRNA and QDot binding and failed to produce robust mRNA staining (FIG. 13C) above non-specific QDot binding levels (FIG. 13D). All images were obtained with HSI and normalized for direct comparison of signal intensity. Scale bar, 50 µm.
Figure 13B:
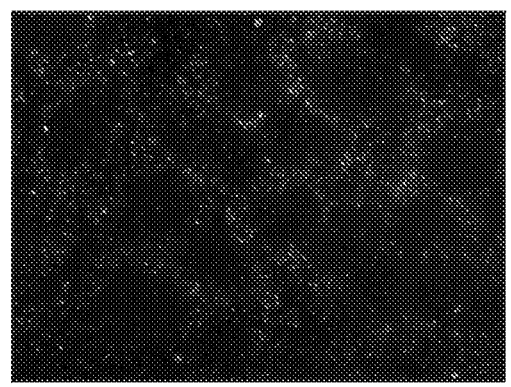
Figure 13C:
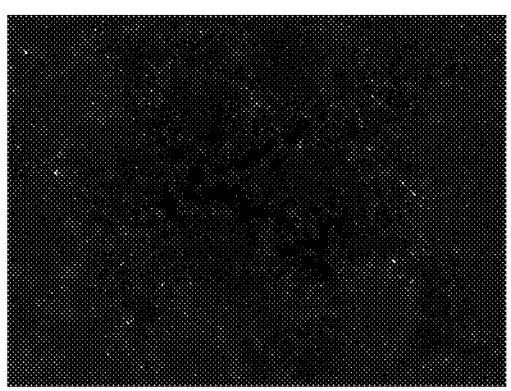
Figure 13D:
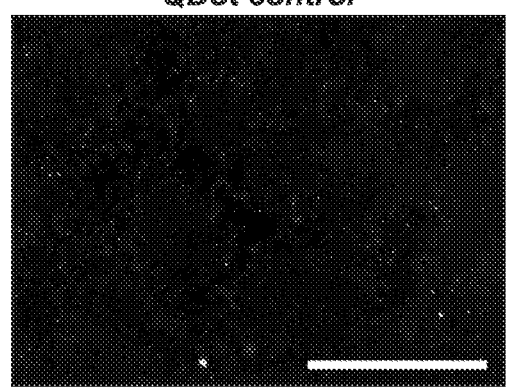

Labeling of model GAPDH and HSP90-alpha mRNA molecules via an indirect in situ hybridization (ISH) procedure was done with modified mRNA ISH oligonucleotide probes featuring 5' 20 nt mRNA-recognition portion and a 3' 16 nt QDot-binding tag separated by a single-stranded AAAAA spacer (TABLE 10 and TABLE 11). Hybridization of oligonucleotide probes under optimized ISH conditions yielded labeling of each mRNA molecule with multiple ssDNA tags (up to 36 for GAPDH and 48 for HSP90-alpha), producing distinct spots upon staining with complementary QDot-ssDNA probes consistent with results achieved with conventional mRNA ISH protocols (FIG. 12). In some instances, non-complementary QDot-ssDNA probes failed to hybridize to exposed ssDNA tags, producing minimal non-specific staining background. To explore effects of potential secondary structure formation in 41 nt ssDNA oligonucleotides as well as steric hindrance experienced by QDots approaching tightly spaced ssDNA tags, an alternative mRNA ISH probe set was designed with each probe containing a 16 bp dsDNA spacer between 5' mRNA-recognition and 3' QDot-binding portions. Indeed, physical separation of functional ssDNA portions improved mRNA staining intensity in comparison to linear 41 nt ssDNA oligonucleotides (FIG. 13A, FIG. 13B, FIG. 13C, and FIG. 13D), offering one strategy for enhancing per-spot signal intensity and improving signal-to-noise ratio.

Separation of target-recognition and QDot-labeling events via an intermediate DNA encoding enabled straight-forward implementation of a model multi-omics imaging protocol, with both mRNA and protein targets being robustly labeled by respective QDot probes and accurately identified through hyperspectral imaging and analysis (FIG. 14), corroborating broad applicability of the DNA encoding strategy for simultaneous detection and imaging of various types of targets within the same specimen.

Multi-omics imaging platform was then applied to study gene knock-down via RNAi at a single-cell level. HeLa cells were transfected with GAPDH-targeting siRNA (as well as non-targeting siRNA for control) for 24 hrs, and GAPDH mRNA abundance was assessed with RT-PCR and QDot-based imaging. In some cases, bulk GAPDH mRNA measurement by RT-PCR indicated silencing efficiency of 78% with forward transfection and 95% with reverse transfection. At the same time, imaging revealed heterogeneity in RNAi, likely resulting from heterogeneous cell transfection with siRNA throughout different regions of cell culture. For example, forward transfection failed to achieve efficient GAPDH mRNA degradation in dense cell populations, yielding areas of completely silenced cells along with patches of cells with normal GAPDH mRNA expression levels (FIG. 15). In contrast, reverse transfection achieved a more uniform cell transfection in suspension, producing a greater proportion of silenced cells with only a few wild-type clones (FIG. 16). Direct comparison of mRNA imaging results obtained from forward vs. reverse transfection further corroborated complete mRNA degradation upon successful transfection with either method along with unperturbed GAPDH mRNA levels in non-transfected cells (FIG. 17), suggesting an all-on/all-off mode of GAPDH RNAi and attributing incomplete silencing observed with bulk RT-PCR analysis to heterogeneity in siRNA transfection.

Selectivity of GAPDH RNAi was confirmed by performing dual-target imaging of GAPDH mRNA and HSP90-alpha mRNA. Target-selective siRNA should trigger degradation of only its complementary target mRNA, having no immediate effect on non-targeted mRNA molecules. This was indeed observed with GAPDH RNAi studies (FIG. 18). Indirect dual-target ISH produced robust staining of both mRNA species in reference HeLa cells grown in culture medium. Similarly, cell transfection with non-targeting control siRNA failed to produce any effect on mRNA expression. Transfection with GAPDH-targeting siRNA, however, triggered rapid degradation of GAPDH mRNA within 24 hrs post-transfection, while leaving non-targeted HSP90-alpha mRNA intact. A single non-transfected cell within the field of view features intact expression of both GAPDH and HSP90 mRNA, consistent with discussion above.

Imaging of mRNA unambiguously demonstrated heterogeneity in RNAi stemming from incomplete cell transfection with siRNA. However, such heterogeneity could not be detected at the protein level, as GAPDH protein remained unperturbed 24 Hrs post-transfection in both transfected and non-transfected cells, as was evident from dual labeling of GAPDH mRNA and protein (FIG. 19). To further investigate the disparity between RNAi effect at mRNA and protein levels, HeLa cells were reverse transfected with GAPDH-targeting siRNA for 24 and 48 Hrs and processed for multiplexed imaging of GAPDH and HSP90-alpha mRNA and their respective protein products. Consistent with studies discussed earlier, 24 hrs post-transfection a complete degradation of GAPDH mRNA was observed, whereas GAPDH protein level remained unperturbed (FIG. 20A). In contrast, 48 hrs post-transfection a substantial reduction of GAPDH protein level could be observed, with GAPDH mRNA remaining below the detection limit (FIG. 20B). HSP90 mRNA and protein levels remained unperturbed through 48 hours, confirming selectivity of GAPDH silencing. Further, all molecular targets exhibited consistent unperturbed levels in reference non-transfected cells (FIG. 21A and FIG. 21B) and cells transfected with non-targeting siRNA (FIG. 22A and FIG. 22B) throughout the study, corroborating that the observed GAPDH knock-down indeed resulted from RNAi mechanism. Multiplexed analysis was fully confirmed by a series of single-plex studies to mitigate any artifacts that could potentially be introduced from the multi-omics labeling methodology, HSI, and image analysis (FIG. 23A and FIG. 23B).

In some cases, delay in RNAi effect at the protein level is present, as proteins are typically degraded and cleared slower in comparison to siRNA-mediated mRNA degradation. In other cases, heterogeneity in cell transfection can modulate assessing RNAi efficiency with bulk RT-PCR measurement and downstream phenotypic and molecular signaling analysis. Non-transfected cells might gain growth advantage and achieve substantial clonal expansion during the time it takes for higher-level manifestations of RNAi to occur, thus distorting observed RNAi effect at a population level. Imaging-based analysis at a single-cell level can by-pass this ambiguity and can offer a more accurate insight into molecular processes.

TABLE 9

List of ssDNA/ssDNA' tag pairs for encoding of molecular targets

| Tag ID | | Sequence* | SEQ ID NO: |
|---|---|---|---|
| QDot-coupled | 1A | 5'-/5AmMC6/iSp18/CGTCGCACCAAGAAAT-3' | SEQ ID NO: 1292 |
| | 2A | 5'-/5AmMC6/iSp18/TAGACTTGCCATACGT-3' | SEQ ID NO: 1293 |
| | 3A | 5'-/5AmMC6/iSp18/AATTCTTGAGACCAGG-3' | SEQ ID NO: 1294 |
| | 4A | 5'-/5AmMC6/iSp18/ATCTGCCCAAACTCCA-3' | SEQ ID NO: 1295 |
| | 5A | 5'-/5AmMC6/iSp18/TTCCCAAGCGTCATCT-3' | SEQ ID NO: 1296 |
| | 6A | 5'-/5AmMC6/iSp18/TCTATCGGACGCTGTA-3' | SEQ ID NO: 1297 |
| IgG-coupled | 1B | 5'-/5AmMC6/AAAAAAAAAAATTTCTTGGTGCGACG-3' | SEQ ID NO: 1298 |
| | 2B | 5'-/5AmMC6/AAAAAAAAAAACGTATGGCAAGTCTA-3' | SEQ ID NO: 1299 |
| | 3B | 5'-/5AmMC6/AAAAAAAAAACCTGGTCTCAAGAATT-3' | SEQ ID NO: 1300 |
| | 4B | 5'-/5AmMC6/AAAAAAAAAATGGAGTTTGGGCAGAT-3' | SEQ ID NO: 1301 |
| | 5B | 5'-/5AmMC6/AAAAAAAAAAAGATGACGCTTGGGAA-3' | SEQ ID NO: 1302 |
| | 6B | 5'-/5AmMC6/AAAAAAAAAATACAGCGTCCGATAGA-3' | SEQ ID NO: 1303 |

*all ssDNA tags have 5' terminal amine group (/5AmMC6/) for bioconjugation separated from the pairing sequence by either a hexa-ethyleneglycol spacer (/iSp18/) for QDot-coupled tags or 10A oligonucleotide spacer (AAAAAAAAAA; SEQ ID NO: 1404) for IgG-coupled tags.

TABLE 10

Sequences of GAPDH mRNA ISH probes (with 2B encoding tag)

| # | mRNA-recognition region    encoding tag 2B | SEQ ID NO: |
|---|---|---|
| 1 | 5'-ATTTATAGAAACCGGGGCGAAAAAACGTATGGCAAGTCTA-3' | SEQ ID NO: 1304 |
| 2 | 5'-CGAACAGGAGGAGCAGAGAGAAAAAACGTATGGCAAGTCTA-3' | SEQ ID NO: 1305 |
| 3 | 5'-GCTGGCGACGCAAAAGAAGAAAAAACGTATGGCAAGTCTA-3' | SEQ ID NO: 1306 |
| 4 | 5'-CATGGTGTCTGAGCGATGTGAAAAAACGTATGGCAAGTCTA-3' | SEQ ID NO: 1307 |
| 5 | 5'-TACGACCAAATCCGTTGACTAAAAAACGTATGGCAAGTCTA-3' | SEQ ID NO: 1308 |
| 6 | 5'-CAGAGTTAAAAGCAGCCCTGAAAAAACGTATGGCAAGTCTA-3' | SEQ ID NO: 1309 |
| 7 | 5'-GGGTCATTGATGGCAACAATAAAAAACGTATGGCAAGTCTA-3 | SEQ ID NO: 1310 |
| 8 | 5'-AACCATGTAGTTGAGGTCAAAAAAACGTATGGCAAGTCTA-3' | SEQ ID NO: 1311 |
| 9 | 5'-GGGTGGAATCATATTGGAACAAAAAACGTATGGCAAGTCTA-3' | SEQ ID NO: 1312 |
| 10 | 05'-TTGACGGTGCCATGGAATTTAAAAAACGTATGGCAAGTCTA-3' | SEQ ID NO: 1313 |
| 11 | 5'-CATTGATGACAAGCTTCCCGAAAAAACGTATGGCAAGTCTA-3' | SEQ ID NO: 1314 |
| 12 | 5'-TCCTGGAAGATGGTGATGGGAAAAAACGTATGGCAAGTCTA-3' | SEQ ID NO: 1315 |
| 13 | 5'-CCACTTGATTTTGGAGGGATAAAAAACGTATGGCAAGTCTA-3 | SEQ ID NO: 1316 |
| 14 | 5'-GGACTCCACGACGTACTCAGAAAAAACGTATGGCAAGTCTA-3' | SEQ ID NO: 1317 |
| 15 | 5'-TTCTCCATGGTGGTGAAGACAAAAAACGTATGGCAAGTCTA-3' | SEQ ID NO: 1318 |
| 16 | 5'-AGAGATGATGACCCTTTTGGAAAAAACGTATGGCAAGTCTA-3' | SEQ ID NO: 1319 |
| 17 | 5'-GACGAACATGGGGGCATCAGAAAAAACGTATGGCAAGTCTA-3' | SEQ ID NO: 1320 |
| 18 | 5'-CATACTTCTCATGGTTCACAAAAAACGTATGGCAAGTCTA-3' | SEQ ID NO: 1321 |
| 19 | 5'-ATTGCTGATGATCTTGAGGCAAAAAACGTATGGCAAGTCTA-3' | SEQ ID NO: 1322 |
| 20 | 5'-CTAAGCAGTTGGTGGTGCAGAAAAAACGTATGGCAAGTCTA-3' | SEQ ID NO: 1323 |
| 21 | 5'-CCACGATACCAAAGTTGTCAAAAAACGTATGGCAAGTCTA-3' | SEQ ID NO: 1324 |
| 22 | 5'-TCTTCTGGGTGGCAGTGATGAAAAAACGTATGGCAAGTCTA-3' | SEQ ID NO: 1325 |
| 23 | 5'-TAGAGGCAGGGATGATGTTCAAAAAACGTATGGCAAGTCTA-3' | SEQ ID NO: 1326 |
| 24 | 5'-TCAGCTCAGGGATGACCTTGAAAAAACGTATGGCAAGTCTA-3' | SEQ ID NO: 1327 |
| 25 | 5'-CACTGACACGTTGGCAGTGGAAAAAACGTATGGCAAGTCTA-3' | SEQ ID NO: 1328 |
| 26 | 5'-CAGGTTTTTCTAGACGGCAGAAAAAACGTATGGCAAGTCTA-3' | SEQ ID NO: 1329 |

TABLE 10-continued

Sequences of GAPDH mRNA ISH probes (with 2B encoding tag)

| # | mRNA-recognition region     encoding tag 2B | SEQ ID NO: |
|---|---|---|
| 27 | 5'-CACCTTCTTGATGTCATCATAAAAAACGTATGGCAAGTCTA-3' | SEQ ID NO: 1330 |
| 28 | 5'-GCTGTTGAAGTCAGAGGAGAAAAAACGTATGGCAAGTCTA-3' | SEQ ID NO: 1331 |
| 29 | 5'-CGTCAAAGGTGGAGGAGTGGAAAAAACGTATGGCAAGTCTA-3' | SEQ ID NO: 1332 |
| 30 | 5'-AGTGGTCGTTGAGGGCAATGAAAAAACGTATGGCAAGTCTA- | SEQ ID NO: 1333 |
| 31 | 5'-TCATACCAGGAAATGAGCTTAAAAAACGTATGGCAAGTCTA-3' | SEQ ID NO: 1334 |
| 32 | 5'-CCTGTTGCTGTAGCCAAATTAAAAAACGTATGGCAAGTCTA-3' | SEQ ID NO: 1335 |
| 33 | 5'-TGAGGAGGGGAGATTCAGTGAAAAAACGTATGGCAAGTCTA-3' | SEQ ID NO: 1336 |
| 34 | 5'-CTCTTCAAGGGGTCTACATGAAAAAACGTATGGCAAGTCTA-3' | SEQ ID NO: 1337 |
| 35 | 5'-TACATGACAAGGTGCGGCTCAAAAAACGTATGGCAAGTCTA-3' | SEQ ID NO: 1338 |
| 36 | 5'-TGAGCACAGGGTACTTTATTAAAAAACGTATGGCAAGTCTA-3' | SEQ ID NO: 1339 |

Note: mRNA-recognition region and encoding tag are separated by a spacer (bolded and italicized).
Shorter 41nt mRNA ISH probes contain -AAAAA- single-stranded spacer. Longer 60nt mRNA ISH probes contain pre-hybridized 16bp double-stranded spacer flanked by -AAAA- single-stranded linkers.

TABLE 11

Sequences of HSP90-alpha mRNA ISH probes (with 4B encoding tag) encoding tag 4B

| # | mRNA-recognition region     encoding tag 4B | SEQ ID NO: |
|---|---|---|
| 1 | 5'-AGGAGTATGATTGTCAACCCAAAAATGGAGTTTGGGCAGAT-3' | SEQ ID NO: 1340 |
| 2 | 5'-CCTATATAAGGCGAAGCACAAAAATGGAGTTTGGGCAGAT-3' | SEQ ID NO: 1341 |
| 3 | 5'-GAGTGACTCGAGAGAGCTACAAAAATGGAGTTTGGGCAGAT-3' | SEQ ID NO: 1342 |
| 4 | 5'-ATAGTGAGCAACGTAGGCTTAAAAATGGAGTTTGGGCAGAT-3' | SEQ ID NO: 1343 |
| 5 | 5'-GGACATGAGTTGGGCAATTTAAAAATGGAGTTTGGGCAGAT-3' | SEQ ID NO: 1344 |
| 6 | 5'-GAGATCAACTCCCGAAGGAAAAAAATGGAGTTTGGGCAGAT-3' | SEQ ID NO: 1345 |
| 7 | 5'-AATCTTGTCCAAGGCATCAGAAAAATGGAGTTTGGGCAGAT-3' | SEQ ID NO: 1346 |
| 8 | 5'-AACTTCGAAGGGTCTGTCAGAAAAATGGAGTTTGGGCAGAT-3' | SEQ ID NO: 1347 |
| 9 | 5'-GGTTGGGGATGATGTCAATTAAAAATGGAGTTTGGGCAGAT-3' | SEQ ID NO: 1348 |
| 10 | 5'-TACCAAAGTCAGGGTACGTTAAAAATGGAGTTTGGGCAGAT-3' | SEQ ID NO: 1349 |
| 11 | 5'-TGAGATCAGCTTTGGTCATGAAAAATGGAGTTTGGGCAGAT-3' | SEQ ID NO: 1350 |

TABLE 11-continued

Sequences of HSP90-alpha mRNA ISH probes
(with 4B encoding tag) encoding tag 4B

| # | mRNA-recognition region encoding tag 4B | SEQ ID NO: |
|---|---|---|
| 12 | 5'-TTGGCAATGGTTCCCAAATTAAAAATGGAGTTTGGGCAGAT-3' | SEQ ID NO: 1351 |
| 13 | 5'-CTGAAGAGCCTCCATGAATGAAAAATGGAGTTTGGGCAGAT-3' | SEQ ID NO: 1352 |
| 14 | 5'-CCACCAAGTAGGCAGAATAAAAAATGGAGTTTGGGCAGAT-3' | SEQ ID NO: 1353 |
| 15 | 5'-TGCTTTGTGATCACAACCACAAAAATGGAGTTTGGGCAGAT-3' | SEQ ID NO: 1354 |
| 16 | 5'-CAGAAGACTCCCAAGCATACAAAAATGGAGTTTGGGCAGAT-3' | SEQ ID NO: 1355 |
| 17 | 5'-AGCACGCACAGTGAAGGAACAAAAATGGAGTTTGGGCAGAT-3' | SEQ ID NO: 1356 |
| 18 | 5'-TCTAGGTACTCTGTCTGATCAAAAATGGAGTTTGGGCAGAT-3' | SEQ ID NO: 1357 |
| 19 | 5'-TAAAGGGTGATGGGATAGCCAAAAATGGAGTTTGGGCAGAT-3' | SEQ ID NO: 1358 |
| 20 | 5'-TGTTTAGTTCTTCCTGATCAAAAATGGAGTTTGGGCAGAT-3' | SEQ ID NO: 1359 |
| 21 | 5'-AGGGTTTCTGGTCCAAATAGAAAAATGGAGTTTGGGCAGAT-3' | SEQ ID NO: 1360 |
| 22 | 5'-TCATTAGTGAGGCTCTTGTAAAAATGGAGTTTGGGCAGAT-3' | SEQ ID NO: 1361 |
| 23 | 5'-AAAGTGCTTGACTGCCAAGTAAAAATGGAGTTTGGGCAGAT-3' | SEQ ID NO: 1362 |
| 24 | 5'-TGAATTCCAACTGACCTTCTAAAAATGGAGTTTGGGCAGAT-3' | SEQ ID NO: 1363 |
| 25 | 5'-GAGCCCGACGAGGAATAAATAAAAATGGAGTTTGGGCAGAT-3' | SEQ ID NO: 1364 |
| 26 | 5'-TGAACACACGGCGGACATAGAAAAATGGAGTTTGGGCAGAT-3' | SEQ ID NO: 1365 |
| 27 | 5'-ATCAACTCATCACAGCTGTCAAAAATGGAGTTTGGGCAGAT-3' | SEQ ID NO: 1366 |
| 28 | 5'-AAGATTTTGCTCTGCTGGAGAAAAATGGAGTTTGGGCAGAT-3' | SEQ ID NO: 1367 |
| 29 | 5'-AGAGAAGAGCTCAAGGCACTAAAAATGGAGTTTGGGCAGAT-3' | SEQ ID NO: 1368 |
| 30 | 5'-GTGGATTCCAAGCTTGAGATAAAAATGGAGTTTGGGCAGAT-3' | SEQ ID NO: 1369 |
| 31 | 5'-AGACTGGGAGGTATGATAGCAAAAATGGAGTTTGGGCAGAT-3' | SEQ ID NO: 1370 |
| 32 | 5'-CTCTGACAGAGATGTCATCTAAAAATGGAGTTTGGGCAGAT-3' | SEQ ID NO: 1371 |
| 33 | 5'-TAGATGGACTTCTGTGTCTCAAAAATGGAGTTTGGGCAGAT-3' | SEQ ID NO: 1372 |
| 34 | 5'-GCTCCACAAAAGCTGAGTTGAAAAATGGAGTTTGGGCAGAT-3' | SEQ ID NO: 1373 |
| 35 | 5'-CATATATACCACCTCGAAGCAAAAATGGAGTTTGGGCAGAT-3' | SEQ ID NO: 1374 |
| 36 | 5'-ACACAGTACTCGTCAATGGGAAAAATGGAGTTTGGGCAGAT-3' | SEQ ID NO: 1375 |

TABLE 11-continued

Sequences of HSP90-alpha mRNA ISH probes
(with 4B encoding tag) encoding tag 4B

| # | mRNA-recognition region  encoding tag 4B | SEQ ID NO: |
|---|---|---|
| 37 | 5'-TTCCCATCAAATTCCTTGAG*AAAAA*TGGAGTTTGGGCAGAT-3' | SEQ ID NO: 1376 |
| 38 | 5'-GAGATTGTCACCTTCTCAAC*AAAAA*TGGAGTTTGGGCAGAT-3' | SEQ ID NO: 1377 |
| 39 | 5'-TGCAGCAAGGTGAAGACAC*AAAAA*TGGAGTTTGGGCAGAT-3' | SEQ ID NO: 1378 |
| 40 | 5'-GCTTTTTGGCCATCATATAG*AAAAA*TGGAGTTTGGGCAGAT-3' | SEQ ID NO: 1379 |
| 41 | 5'-AACTGCCTTATCATTCTTGT*AAAAA*TGGAGTTTGGGCAGAT-3' | SEQ ID NO: 1380 |
| 42 | 5'-ATCCTCAAGGGAAAAGCCAG*AAAAA*TGGAGTTTGGGCAGAT-3' | SEQ ID NO: 1381 |
| 43 | 5'-TGATCATGCGATAGATGCGG*AAAAA*TGGAGTTTGGGCAGAT-3' | SEQ ID NO: 1382 |
| 44 | 5'-CATCAGGAACTGCAGCATTG*AAAAA*TGGAGTTTGGGCAGAT-3' | SEQ ID NO: 1383 |
| 45 | 5'-CAAGGGCACAAGTTTTCC*AAAAAA*ATGGAGTTTGGGCAGAT-3' | SEQ ID NO: 1384 |
| 46 | 5'-TACTGCCTTCAACACAAGG*AAAAA*TGGAGTTTGGGCAGAT-3' | SEQ ID NO: 1385 |
| 47 | 5'-AGAGTAGAGAGGGAATGGGG*AAAAA*TGGAGTTTGGGCAGAT-3' | SEQ ID NO: 1386 |
| 48 | 5'-TACACAACATCCAATCCTGC*AAAAA*TGGAGTTTGGGCAGAT-3' | SEQ ID NO: 1387 |

Note: mRNA-recognition portion and encoding tag are separated by a spacer (bolded and italicized).
Shorter 41nt mRNA ISH probes contain -AAAAA- single-stranded spacer. Longer 60nt mRNA ISH probes contain pre-hybridized 16bp double-stranded spacer flanked by -AAAA- single-stranded linkers.

Example 3

Global In Situ Visualization of the DNaseI Hypersensitivity Site (DHS) Compartment of a Cell This example shows the global in situ visualization of the DNaseI Hypersensitivity Site (DHS) compartment of a cell, which allows for identification of nuclear compartments where regulatory DNA activation occurs. As shown in the graphic on the left side of FIG. 24, K562 cells were fixed with Paxgene reagent, treated with DNaseI, DNaseI-induced nicks were labeled using terminal transferase (TdT) and ethynyl-dUTP (EdUTP) (TUNEL assay), Alexafluor-488 (AF488) was conjugated to the EdUTP via copper click chemistry, and then SPDM imaging was performed. FIG. 24 shows multiple images of this. The top left image is of the raw signal data. The local density map image (top middle) shows a ring of condensation at the nuclear lamina, which is similar to findings reported by the Weintraub lab 30 years ago (Weintraub, Cell (1985) 43:471-482); see FIG. 24 top right reproduced image). Approximately 18.4% of the localized points are within the ring density at the nuclear lamina, as shown the calculations in the lower right box, in which the image data calculation was based off the image on the lower left of FIG. 24. The image data calculation is similar to the proportion of K562 DHS within lamina-associated domains (LADS). These findings indicate labeling of DNaseI cut sites in a cell's nucleus using a TUNEL assay may be used for better understanding of the nuclear localization of regulatory DNA activation.

Example 4

Nano-FISH Methods

This example shows how Nano-FISH was used to detect the presence or absence of the locus control region in human erythroleukemia K562 cells.

Cells and Tissue Culture

Human erythroleukemia K562 cells and their derivative lacking the locus control region (ΔLCR) were maintained in RPMI 1640 media supplemented with 2 mM L-glutamine (0.3 g/L), 10% Fetal Bovine Serum, penicillin, and streptomycin at 37° C. in 5% $CO_2$.

In Silico Design of Nano-FISH Probe Pools

Tiled 40 bp probe pools with a minimum of 2 bp spacing between consecutive probes were designed using Primer3 with default parameters. The resulting tiled probe sets were compared to a 16-mer database of genomic sequences in each register to model partial matches of probes to genomic sequences that could result in inappropriate background staining. A uniquely mapping oligonucleotide would therefore have a total of 24 matches to the 16-mer database. Individual probe sets with >100 16-mer database matches were empirically discarded from consideration. For the genomic target regions examined in this study, a pool of at least 30 oligonucleotides that satisfied these design criteria was used.

Nano-FISH Protocol

Cells were harvested, washed once in phosphate buffered saline (PBS), re-suspended in a small volume of PBS and subsequently seeded on 18 mm×18 mm coverslips in a 6-well plate that had been coated with poly-L-lysine (Sigma P1399). After allowing cells to adhere for 5 to 10 minutes at room temperature they were fixed by the addition of 4% formaldehyde (Polysciences 18814-10) in PBS for 10 minutes, washed with PBS, and then permeabilized for 15 minutes with 0.5% Triton X-100 in PBS. Following two washes in PBS, the cells were subjected to a 5 minute treatment of 0.1 M HCl and subsequently washed twice in saline sodium citrate (2×SSC) before incubation with RNase A (25 µg/mL in 2×SSC) at 37° C. for 30 minutes. The cover slips were washed in 2×SSC again and then pre-equilibrated for at least one hour in 50% formamide (Amresco 0606), 2×SSC (pH 7.0) at room temperature. To denature the cellular DNA the cover slips were incubated for 4.5 minutes in 70% formamide, 2×SSC (pH 7.0) preheated to 78° C. in a 6-well plate on a heat block equipped with an aluminum block designed for tissue culture plates. For consistency, only the center two wells were used for denaturations and the temperature allowed to re-equilibrate before the next batch. Cover slips were then inverted onto 80 µl of hybridization solution (50% formamide, 10% dextran sulfate, 2×SSC, 250 pM oligonucleotide pool) on parafilm in a humid chamber and incubated overnight at 37° C. Post-hybridization washes included two 15 minute incubations in 2×SSC followed by two 7 minute washes in 0.2×SSC/0.2% Tween-20 at 56° C. on a heat block and one wash in 4×SSC/0.2% Tween-20 at room temperature. Cellular DNA was counterstained with DAPI (100 ng/mL in 2×SSC), followed by two more washes in 2×SSC. Cover slips were then mounted on slides for imaging with Prolong Gold (Molecular Probes P36930).

Imaging

For standard widefield microscopy, slides were imaged on an inverted Nikon Eclipse Ti widefield microscope with a 60× Nikon Plan Apo lambda NA 1.40 oil objective and an Andor Zyla 4.2CL10 CMOS camera.

Example 5

Nano-FISH Detection of a 1.8 kb Nucleic Acid Sequence

This example and FIG. 33 shows the use of Nano-FISH to detect a 1.8 kb nucleic acid sequence. FIG. 33A shows a schematic of a Nano-FISH experiment. FIG. 33B shows the application of the Nano-FISH strategy to detect a 1.8 kb region encompassing the HS2 hypersensitive site of the β-globin locus control region (LCR) in triploid K562 erythroleukemia cells. FIG. 33C shows co-localization of the Nano-FISH signals (~1.8 kb target region) with those from standard BAC-derived probes (conventional DNA-FISH; ~170 kb target region), confirming the specificity of the detected Nano-FISH signal. Compared to the large size of BAC probes used to detect the β-globin LCR, Nano-FISH probes targeting HS2 covered a target region that was approximately 2 orders of magnitude smaller in size. Although most, but not all, spots corresponding to the alleles in the triploid cell were consistently detected using 30 tiled 40 base pair oligonucleotide probes targeting the HS2 hypersensitive site, increasing the number of probes and expanding the corresponding labeled genomic DNA target region illustrated that Nano-FISH was tunable. A modest increase in the number of Nano-FISH probes (~90) resulted in Nano-FISH detection of allele frequency that matched the performance of standard BAC probes. Conversely, decreasing the number of Nano-FISH probes below 30 probes drastically reduced allele detection sensitivity. Therefore, as shown in FIG. 33D, the sensitivity of efficiency and resolution of detection using Nano-FISH may be tuned according to the number of probes being used.

Using an efficient and robust automated image processing pipeline, results from hundreds of cells across multiple replicates were quantified. These studies showed that the diffraction-limited signals produced by Nano-FISH were smaller and dimmer than those generated by BAC-based probes (FIG. 33E and FIG. 33E). Despite this, Nano-FISH still showed robust detection of genomic regions with varying size, such as genomic region size ranging from about 800 bp to 2.1 kb, as shown in FIG. 33G. Thus, Nano-FISH is able to successfully label endogenous non-repetitive DNA loci that are much smaller than the current limit of resolution of BAC- and fosmid-based DNA-FISH approaches.

Example 6

Fine Structural Analysis Using Nano-FISH

This example and FIG. 34 show the use of Nano-FISH to perform fine structural analysis of specific genomic loci within the nucleus. Probe pools were designed to target a 1.6 kb region of chromosome 19 and a 1.4 kb region of chromosome 18. These chromosomes were chosen since chromosome 19 is known to occupy a central position within the nucleus while chromosome 18 is more marginally located. FIG. 34A shows the distinct spots produced by Nano-FISH probes targeting specific loci on these chromosomes. To measure the relative localization of the detected loci, the relative radial distance (RRD), a normalized measure of the position of the detected spot with respect to the nuclear centroid, was calculated. FIG. 34B shows a schematic of the relative radial distance. FIG. 34C shows that the chromosome 18 Nano-FISH signals are closer to the nuclear periphery. The distributions were obtained across 2,396 chromosome 18 signals and 3,388 chromosome 19 signals. FIG. 34D shows radial histograms of the two target loci. The differences in the distribution of signals with respect to the nuclear centroid are readily apparent in the histograms.

Example 7

Examination of Enhancer-Promoter Interactions Using Nano-FISH

This example and FIG. 35 show the use of Nano-FISH for examining the interaction of a gene enhancer with its target gene promoter. The positioning of a known enhancer of the CCND1 gene in 786-O and MCF-7 cells was examined. Based on DNaseI hypersensitivity mapping, this enhancer is active in 786-O cells, but is inactive in MCF-7 cells. Using large (~225 kb) probes, others have demonstrated that this enhancer is located in proximity to the CCND1 gene promoter in 786-O cells, but not in MCF-7 cells. Nano-FISH probes targeting the enhancer and promoter were designed and synthesized. FIG. 35A shows two-color Nano-FISH in 786-O and MCF-7 cells. The normalized inter-spot distance (NID) between these two genomic loci were compared. FIG.

35B shows a schematic of the normalized inter-spot distance. FIG. 35C shows that, on average, the spots are situated closer together in 786-O cells compared to MCF-7 cells. FIG. 35D shows that, in spite of this, absolute colocalization (NID=0) was actually a rare event in both cell types. Thus, the small size of genomic regions targeted by Nano-FISH permits fine scale localization of regulatory DNA regions and provides a granular view of their spatial localizations within nuclei.

Example 8

Detection of Small Genomic Structural Variations Using Nano-FISH

This example and FIG. 36 show the use of Nano-FISH to detect small genomic structural variations such as small losses or gains of DNA. ZFN-mediated genome editing was used to generate a triploid homozygous deletion of the β-globin locus control region (LCR, ~18 kb) in K562 cells, as shown in FIG. 36A. Cells imbued with this deletion are referred to as ΔLCR. Probes targeting either the HS2 or HS3 hypersensitive sites within the deleted region were utilized to detect loss of LCR in the genome edited cells, as shown in FIG. 36B and FIG. 36C. For the converse scenario, using TALEN-mediated homology directed repair, a sequence encoding for eGFP was inserted into the AAVS1 safe harbor locus on chromosome 19, as shown in FIG. 36D. This exogenously-derived sequenced was readily identified by Nano-FISH, as shown in FIG. 36E and FIG. 36F.

Example 9

Fine Scale Genome Localization Using Nano-FISH and Super-Resolution Microscopy

This example and FIG. 37 show the combination of Nano-FISH and super-resolution microscopy to obtain very fine-scale genome localization. A custom automated stimulated emission and depletion (STED) microscope was utilized to efficiently acquire multiple measurements of the physical distance between the HS2 and HS3 genomic loci, which are separated by 4.1 kb of linear genomic distance. FIG. 37A shows that these closely apposed loci are readily discernible as distinct spots by STED microscopy. Pair-wise measurements of other closely situated genomic segments such as HS1-HS4 (~12 kb) and HS2-HGB2 (~25 kb) were also readily obtained and revealed non-linear compaction of the β-globin locus control region and the surrounding genome which contains its target genes, as shown in FIG. 37B. Importantly, the high-throughput STED microscopy approach enables calculation of the distribution of actual distances between these various loci, as shown in FIG. 37C. These results demonstrated the suitability of Nano-FISH for super-resolution STED microscopy experiments.

Example 10

Optimal Nano-FISH Parameters

This example and FIG. 38 show a series of experiments to determine the optimal operating parameters for a Nano-FISH experiment. FIG. 38A shows how the labeling efficiency of the Nano-FISH procedure depends on denaturation temperature. With increasing temperature, the efficiency of Nano-FISH labeling increases, until a plateau is reached at a temperature of 78° C. FIG. 38B shows that the Nano-FISH labeling procedure is repeatable across experiments. FIG. 38C shows Nano-FISH detected for genomic regions with varying size, such as genomic region size ranging from about 800 bp to 2.1 kb. FIG. 38D shows how the labeling efficiency of the Nano-FISH experiment depends on the number of oligo probes used. The labeling efficiency increases with the number of oligo probes used, attaining a maximum efficiency when 30 oligo probes are utilized. FIG. 38E shows how the detected fluorescence spot size depends on the number of oligo probes. FIG. 38F shows how the intensity of the fluorescence spot size depends on the number of oligo probes.

Example 11

Optimal Conditions for Viral Transduction

This example describes methods and conditions optimized for effective viral transduction of CD34+ cells and subsequent Nano-FISH experiments.

CD34+ cells were grown in the StemSpan H3000 growth medium containing a combination of early-acting recombinant human cytokines (e.g., Flt3L, SCF and TPO) formulated to support the proliferation of human hematopoietic cells (e.g., CD34+ human stem cells).

On the next days (day 2), non-treated tissue culture 24-well plates were coated with RetroNectin® solution (50 μg/mL) for about 2 hrs at room temperature. After removal of the RetroNectin® solution, the well plates were treated with a BSA solution (2% BSA in PBS) for about 30 minutes. Upon completion, the well plates were washed with PBS either used immediately or stored at +4° C. until use. In parallel, CD34+ cells were counted and divided into the RetroNectie-coated well plates. If 24-well plates were used, a total amount of $1 \times 10^5$ to $3 \times 10^5$ cell was used per well to ensure formation of a cell monolayer in the well plates. In parallel, protamine sulfate was added to the solution containing the vector to achieve a final concentration of 8 μg/mL. Subsequently, calculate the required volume of vector solution based on the vector titer and according to the number of CD34+ cells per well plate. Various MOIs can be used. Some commonly used MOIs are 0, 5, 10, 35, and 100. Once the values and required volumes were calculated, the vector solution was added to the cells and the cells were incubated for 24 hrs.

On the next days (day 3), the cells were collected and centrifuged slowly at about 250 rpm for 10 minutes to form cell pellets. Upon removal of the supernatant medium, CD34+ cells were resuspended in 0.1 mg/ml DNase I solution in media (StemCell Technologies #07900), and incubated at room temperature for 15 minutes. Subsequently, cells were centrifuged, resuspended in fresh medium, and placed into new, non-RetroNectie-coated well plates.

At this time, a number of different steps can be performed. First, the transduced cell can be used for Nano-FISH experiments right away (short transduction protocol). Second, the transduced cells can be kept in culture for 1,2,3, or more days before Nano-FISH experiments are carried out (short transduction protocol). Third, the transduction steps from "day 2" and the wash and DNase I treatment steps from "day 3" can be repeated before Nano-FISH experiments are performed (long transduction protocol).

Example 12

Comparison of Nano-FISH and Conventional FISH

This example and FIG. 39 show a comparison of Nano-FISH and conventional FISH. FIG. 39A shows fluorescence images of β-globin lacking the LCR using conventional BAC probes (left panel), a pool of HS1-5 probes (middle panel), and the HS2 Nano-FISH technique (right panel). FIG. 39B shows the size of the probe sets used for the BAC, HS1-5, and HS2 experiments. As can be seen, the HS2 Nano-FISH experiment utilizes a significantly smaller nucleic acid sequence than conventional FISH techniques. FIG. 39C shows the labeling efficiency of the BAC, HS1-5, and HS2 experiments. FIG. 39D shows the size of the FISH spots for the BAC, HS1-5, and HS2 experiments. FIG. 39E shows the intensity of the FISH signals for the BAC, HS1-5, and HS2 experiments. As can be seen, the Nano-FISH experiment produces a lower signal-to-noise ratio (SNR) than conventional methods, with the Nano-FISH experiment producing a SNR smaller than the BAC method by a factor of approximately 2. The loss in SNR comes with a reduction in the size of the nucleic acid sequence by a factor of approximately 100. Thus, the tradeoff in SNR is well worth the significant reduction in size of nucleic acid sequence.

Example 13

Comparison of Nano-FISH Probes and Conventional Nick Translated Probes

This example illustrates the comparison of Nano-FISH oligonucleotide probes of the present disclosure to conventional nick translated probes regarding ease of operation (e.g., no need for blocking agent), transduction efficacy and accuracy, image resolution, and homogeneity of transductions between different samples.

A Nano-FISH experiment for the detection of CD19 CAR lentivirus integration was conducted using four different probe sets targeting the vector backbone. The three Nano-FISH oligonucleotide probe sets used were a lentivirus backbone probe set, a CD19 CAR+Hu probe set, and a CD19 CAR—Hu, and the conventional nick translated probe set was a nick translated CD19 CAR targeting probe set. The three Nano-FISH probe sets were composed of direct-labeled (Quasar-670) 40-mer oligonucleotide probes (Biosearch). The conventional nick translated probe set was composed of DIG-labeled probes derived from nick-translated CD19 CAR plasmid DNA and were created by digesting 2 ug of CD19 CAR plasmid with DNase I in the presence of Pol I and DIG-labeled dUTPs. The resulting probes were run on a gel to confirm their average size of 100 bp.

Each probe set was tested on wild type K562 and a clonal line of K562 cells containing a single integration of the CD19 CAR. To do this, the cells were processed with the 24-well plate format according to the Nano-FISH protocol of the present disclosure using methanol acetic acid fixation. Cells were imaged on a Nikon wide field fluorescent microscope, with a 60× oil objective. Oligonucleotide probe sets were hybridized at a concentration of 0.25 uM (i.e., 3.3 ng/μl). The nick-translated probe set was used at a final concentration of 0.64 ng/μl, and used with and without Cot-1 blocking DNA. The nick-translated probe set with the DIG-labeled nick-translated probes were then indirectly labeled using a Cy3-labeled, anti-nick probe antibody. Briefly, the cells were blocked in blocking buffer (2% BSA, 0.1% Tween20 in 1×PBS) for 30 minutes. The cells were then incubated with a 1:250 dilution of Cy3-anti-DIG antibody in blocking buffer for 1 hr, washed three times with PBS containing 0.1% triton, wherein one of the washing steps included DAPI stain. All samples were also probed with Quasar 570-, or Quasar 670-labeled HS2 and HS3 probes as endogenous controls for FISH. Resulting images were processed and fluorescent spots called and tabulated in each nucleus.

TABLE 12

Probe Set Descriptions

| Probe set | Total probes | Probes to CD19 CAR | Dye | Control HS2/HS3 probes |
|---|---|---|---|---|
| Vector backbone | 60 | 46 | Q670 | Q570 |
| CD19 CAR + Hu | 68 | 68 | Q670 | Q570 |
| CD19 CAR – Hu | 56 | 56 | Q670 | Q570 |
| Nick-translated CD19 CAR | N/A | N/A | Cy3 | Q670 |

FIG. 63 shows a representative set of four nuclei for each probe set tested in the K562 with a single CAR insertion (K562 single-insert clone), and a wild type negative control (K562 wild-type). The nuclei were DAPI stained and are shown in blue, and the nano-FISH signal is shown in yellow. The three oligonucleotide probe sets (FIG. 63A-FIG. 63F, top three rows) showed clear, mostly singular spots and low background signal, whereas the nick-translated probes (FIG. 63G-FIG. 63J, bottom two rows) showed relatively high background signal, even in the negative control cells (FIG. 63G, FIG. 63J). In addition, FIG. 65 shows diagrams indicating the number of FISH spots per cell. FISH spots were automatically detected, and then thresholded based on visual inspection (magnitude 8 for Cy5 and magnitude 18 for Cy3 channels). The oligonucleotide probes (specific to CD19 CAR+Hu, CD19 CAR—Hu, and the vector backbone only) clearly distinguished single-insert cells from the negative, wild type control, whereas the positive and negative cells were indistinguishable with nick-translated probes. These results demonstrates the significantly higher signal accuracy for Nano-FISH probe sets compared to conventional nick translated probe sets.

This comparison was additionally performed using the Nano-FISH protocol described herein on coverslips with PFA fixation. As described above, cells were imaged on a Nikon wide field fluorescent microscope, with a 60× oil objective. Oligonucleotide probes were hybridized at a concentration of 0.25 uM (i.e., 3.3 ng/μl). The nick-translated probe was used at a final concentration of 0.64 ng/μl, and used with and without Cot-1 blocking DNA. DIG-labeled nick-translated probes were indirectly labeled using a Cy3-labeled, anti-nick probe antibody. Briefly, the cells were blocked in blocking buffer (2% BSA, 0.1% Tween20 in 1×PBS) for 30 minutes. The cells were then incubated with a 1:250 dilution of Cy3-anti-DIG antibody in blocking buffer for 1 hr, washed three times with PBS containing 0.1% triton, wherein one of the washing steps included DAPI stain. Resulting images were processed and fluorescent spots called and tabulated in each nucleus.

FIG. 64 shows a representative set of nine nuclei for each probe set tested in the K562 with a single CAR insertion (K562 single-insert clone), and a wild type negative control (K562 wild-type). The nuclei are DAPI stained and shown in blue, and the nano-FISH signal is shown in yellow. The oligonucleotide probe sets (FIG. 64A-FIG. 64B, top row) showed clearly delineated, mostly singular spots and low background signal, whereas the nick-translated probes (FIG. 64C-FIG. 64F, middle and bottom row) showed relatively high background signal, even in the negative control cells.

Example 14

Discovery of Novel Biomarkers Using Nano-FISH

This example shows the discovery of the expression of novel biomarkers that correlate the number of the target nucleic acid sequence in a cell. A sample with a population of cells that is heterogeneous for the number of target nucleic acid sequences in a cell is obtained. Individual cells from the sample are distributed into a single well of a plate and are allowed to clonally expand. Samples of cells from each clone is then characterized for the number of target nucleic acid sequences in a cell using Nano-FISH and is characterized by RNA-Seq to determine novel biomarkers that correlate with the number of target nucleic acid sequences. If a novel biomarker is found to be a surface protein, then the surface protein is used as a selectable marker/sortable marker to isolate cells with the desired number of target nucleic acid sequences from the sample.

Example 15

Probing Multiplicity of Infection Following Lentiviral Transduction

This example and FIG. 40 shows the use of Nano-FISH to probe lentiviral transduction across a cell population with a broad range of multiplicity of infection (MOI). FIG. 40A shows lentiviral transduction across a population of cells with a broad range of MOI. FIG. 40B shows infection by the lentivirus, including reverse transcription and random integration into cells. FIG. 40C shows the use of Nano-FISH to assess the number of integrations in each cell in pools of cells. FIG. 40D shows the accumulation of statistics for integration of lentiviral nucleic acids as a function of MOI.

Example 16

Probing Viral Insertion Using Super-Resolution Nano-FISH

This example and FIG. 41 shows the use of Nano-FISH combined with super-resolution imaging to probe the statistics of viral insertion. FIG. 41A shows the average number of viral insertions per cell as a function of viral concentration, probed using quantitative PCR (qPCR), a Nikon widefield fluorescence microscope, and a Stellar Vision synthetic aperture optics (SAO) super-resolution microscope. As shown, the wide-field microscope and the SAO super-resolution microscope produced nearly identical results at all concentration. However, the SAO super-resolution microscope was able to image a field of view containing 13,288 cells, whereas the wide-field microscope was only able to image a field of view containing 2,440 cells. FIG. 41B shows a histogram of the number of viral integrations in each cell imaged by the SAO super-resolution microscope.

Example 17

Viral Integrant Copy Number Population Enrichment Using Nano-FISH

This example shows how Nano-FISH characterization of sorted subpools is enriched for a population with the desired distribution of viral integrations after viral transduction of a cell population. As illustrated in FIG. 42, an initial pool of sample cells is transduced with a lentivirus. A subset of cells from the initial pool is characterized for the number of viral integrants using viral Nano-FISH. Next, the initial pool is divided into K subpools, each comprising N cells, in which K and N are based on statistical modeling for obtaining a population of cells each comprising the desired number of viral integrants. The subpools are expanded and a subset of cells from each subpool are characterized by Nano-FISH. The subpools with a large population of cells comprising an unfavorable number of viral integrants, such as zero, are discarded. However, the remaining populations of the expanded subpools are shown to have a more desired distribution of the number of viral integrants in each cell, and are therefore combined into an enriched population. The enriched population is used for further testing or in a therapy.

Example 18

Discovery of Novel Biomarkers Using Nano-FISH

This example shows the discovery of the expression of novel biomarkers that correlate the number of viral integrants in a cell. As shown in FIG. 43, a pool of initial cells are transduced with a lentivirus. Each cell from the transduced pool is distributed into a single well of a plate and is allowed to clonally expand. Samples of cells from each clone is then characterized for the number of viral integrants in a cell using Nano-FISH and is characterized by RNA-Seq to determine novel biomarkers that correlate with the number of viral integrants. If a novel biomarker is found to be a surface protein, then the surface protein is used as a selectable marker/sortable marker to isolate cells with the viral integrant number correlated with the surface protein expression from a population of transduced cells.

Example 19

Improved Clinical Vector Manufacture, Production, and Delivery Using Nano-FISH This example shows a method for improving the clinical vector manufacture and production of therapies involving viral transduction of cells. As shown in FIG. 44, improved clinical vector manufacture and production by using viral Nano-FISH is used to determine the optimal manufacturing process. Several different transduction methods for a cell population are used to produce separate transduced cell populations. Each transduced cell population is screened for the number of viral integrants in the cells using Nano-FISH. The transduction method, and thus manufacturing process, leading to the largest population of transduced cells with the optimal distribution of viral integrants per cell is chosen for further use in Good Manufacturing Process of the therapy.

This is also used to optimize for which transduction method is used for a patient's cells when the cells are transduced to produce a therapeutic. As an example, T cells from a patient with cancer are removed, expanded, and transduced to with a lentivirus comprising a CAR. Small samples are taken from the expanded T cell pool and several different techniques of transduction are used to introduce the lentivirus comprising a CAR into these T cells. Nano-FISH is used to determine the distribution of viral integrants in cells for each small sample, and the best method of transduction for that specific patient's T cells is determined based on the transduction method that produced the most optimal distribution of viral integrants in the cell. The expanded T cell pool is then transduction by this method, and the cells are delivered back into the patient as a cancer therapeutic. Additionally, precise titration of virus or adjustment of similar parameters correlated with the number of viral integrants in each cell can be achieved due to the clear enumeration of viral integrant distribution in the cell population being used as the therapeutic. The delivered transduced cell population is therefore a more controlled population of cells which is titered appropriately for the patient receiving the treatment.

Furthermore, when more routine testing and quality control are used for transduced populations of cells, such as CAR T cell therapies, each batch is analyzed and batches are compared. As shown in FIG. 45, Nano-FISH is used for the improved quality control during the cell passage/expansion, cloning, and manufacture of cells after viral transduction for use as a therapy. "Jackpot" cells are identified as a result of batch to batch comparisons, in which "jackpot" cells are transduced cells with a "hit" (e.g., oncogenic hit) that allows them to outcompete and/or out-proliferate other transduced cells. Additionally, cells with toxic integrants are identified as a result of batch to batch comparisons, which cells with toxic integrants fail to proliferate or die as compared to other transduced cells.

Example 20

Correlation of Protein Expression with Number of Viral Integrants after Cell Transduction This example illustrates that the number of viral integrants in a cell correlates with protein expression. A population of cell is transduced with a lentivirus vector comprising a nucleic acid sequence encoding a reporter protein. For example, a surface marker protein is used as a reporter protein and is expressed on the cell surface. Both Nano-FISH and immunofluorescence is performed on the transduced cells. The number of viral integrants is detected by Nano-FISH, and the level of reporter protein expression is detected by immunofluorescence. The number of viral integrants is correlated with the expression of the reporter protein, and therefore the level of expression of the reporter protein can be used as a surrogate marker of the number viral integrants in a cell. This information is used for various sorting and/or enrichment strategies.

Example 21

Simultaneous Detection of Virally Integrated DNA and its Protein Product in Single Cells This example illustrates using Nano-FISH to detect the relationship between transgene integration count and transgene expression level in single cells after infection with a lentivirus comprising a transgene.

K562 Cells.

Briefly, K562 cells were transduced with lentivirus carrying the lenti-Cas9blast plasmid construct (Addgene plasmid #52962). Two weeks post-transduction (expansion, +2 passages after initial exposure to the lentivirus), cells were harvested for processing using Nano-FISH to quantify lentiviral and transgene integrations (viral backbone and Cas9 gene), followed by conventional immunofluorescence for the quantification of the Cas9 protein. This resulted in the simultaneous detection of small virally integrated DNA and its protein product with single cell resolution.

Methods.

Transduced K562 cells were washed with PBS, dropped onto poly-1-lysine coated cover slips, and allowed to settle for 10 minutes. Cells were fixed with 3:1 methanol:acetic acid for 10 minutes, washed, treated with RNase to remove RNA, and equilibrated in buffered 50% formamide for at least 30 minutes. Following equilibration, DNA denaturation was carried out in buffered 70% formamide for 4.5 minutes on a heat block set to 78° C. Denatured slides were hybridized with a Quasar-670-labeled 40-mer probe pool (140 probes; SEQ ID NO: 930-SEQ ID NO: 954, SEQ ID NO: 965-SEQ ID NO: 990, and SEQ ID NO: SEQ ID NO: 1123-SEQ ID NO: 1211) targeting the Cas9 gene and lentiviral backbone sequences. Following hybridization, cells were washed and blocked in 2% BSA in PBST before being incubated with a 1:100 dilution of mouse anti-Cas9 antibody (Abcam #ab191468) for 60 minutes. Cells were washed and incubated with 1:200 dilution of Alexa-488-labeled donkey-anti-mouse secondary antibody for 60 minutes. Cells were then washed, stained with DAPI, and mounted in Prolong Gold on slides. Imaging was carried out on a conventional wide-field fluorescent microscope as well as the Stellar Vision 2 microscope. Data from >17,000 cells was collected and viral integration and Cas9 expression information integrated on a per-cell basis.

Results.

Some cells comprised few integrations but showed high expression of the transgene, while other cells comprised many integrations but showed low or no expression of the transgene above background as shown in FIG. 47A. Overall, there was a trend of increased Cas9 expression with increased transgene integration number as shown in FIG. 47B.

T cells.

Briefly, CD4+ T cells ("Peripheral Blood, Cryopreserved, CD4+ Helper T cells, negatively selected" from ALL-CELLS) from a human donor were transduced with a hPGK-eGFP-C1 vector using retronectin and protamine sulfate as transduction enhancers. Transduction was carried out at a multiplicity of infection (MOI) of 10. Five days post transduction, cells were harvested for processing using Nano-FISH to quantify lentiviral and transgene integrations (viral backbone and eGFP), followed by conventional immunofluorescence for the eGFP protein. This resulted in the simultaneous detection of small virally integrated DNA and its protein product with single T cell resolution.

Methods.

Transduced T cells were washed with PBS, dropped onto poly-1-lysine coated cover slips, and allowed to settle for 10 minutes. Cells were fixed with 4% PFA for 10 minutes, permiabilized, treated with RNase to remove RNA, and equilibrated in buffered 50% formamide for at least 30 minutes. Alternatively, cells are fixed with 3:1 methanol:acetic acid for 10 minutes, washed, treated with RNase to remove RNA, and equilibrated in buffered 50% formamide for at least 30 minutes. Following equilibration, cells were co-denatured and hybridized in sealed slides for 3 minutes on a heatblock set to 78° C. Alternatively, DNA denaturation is carried out in buffered 70% formamide for 4.5 minutes on a heat block set to 78° C. Denatured slides were hybridized with a Quasar-670-labeled 40-mer probe pool (SEQ ID NO:

1212-SEQ ID NO: 1267 targeted the vector backbone, and SEQ ID NO: 1388-SEQ ID NO: 1403 targeted to eGFP) targeting the eGFP gene and lentiviral backbone sequences. Alternatively, cells are probed with just the vector backbone probe set. Following hybridization, cells were washed and blocked in 2% BSA in PBST before being incubated with a 1:500 dilution of rabbit anti-GFP antibody for 60 minutes. Cells were washed and incubated with 1:200 dilution of Alexa-488-labeled anti-rabbit secondary antibody for 60 minutes. Cells were then washed, stained with DAPI, and mounted in Prolong Gold on slides. Imaging was carried out on a conventional wide-field fluorescent microscope as well as the Stellar Vision 2 microscope.

Results.

Overall, there was a trend of increased eGFP expression with increased transgene integration number, though eGFP was not strongly predictive of insertion number. FIG. 61A shows fluorescent images of T cell nuclei after hPGK-eGFP-C1 vector transduction of T cells at a multiplicity of infection (MOI) of 10. A pink punctum indicates a viral insertion as detected by Nano-FISH. FIG. 61B illustrates the simultaneous detection of viral insertions and eGFP expression in T cell nuclei after hPGK-eGFP-C1 vector transduction of T cells at a MOI of 10 using retronectin and protamine sulfate. The viral insertions were detected using Nano-FISH and are shown as pink puncta. The eGFP expression was detected

TABLE 13

Sequences of eGFP probes

| SEQ ID NO | Sequences (5' to 3') | Sequence Description | % GC Content |
|---|---|---|---|
| SEQ ID NO: 1388 | CCCTTGCTCACCATGTCGACGAATTCCCGGCCGCCCTATA | CMV_GFP_13 | 60 |
| SEQ ID NO: 1389 | AGCTCGACCAGGATGGGCACCACCCCGGTGAACAGCTCCT | CMV_GFP_14 | 65 |
| SEQ ID NO: 1390 | TCGCCGGACACGCTGAACTTGTGGCCGTTTACGTCGCCGT | CMV_GFP_15 | 62.5 |
| SEQ ID NO: 1391 | AACTTCAGGGTCAGCTTGCCGTAGGTGGCATCGCCCTCGC | CMV_GFP_16 | 62.5 |
| SEQ ID NO: 1392 | TAGCGGCTGAAGCACTGCACGCCGTAGGTCAGGGTGGTCA | CMV_GFP_18 | 62.5 |
| SEQ ID NO: 1393 | ATGGCGGACTTGAAGAAGTCGTGCTGCTTCATGTGGTCGG | CMV_GFP_19 | 55 |
| SEQ ID NO: 1394 | TCCTTGAAGAAGATGGTGCGCTCCTGGACGTAGCCTTCGG | CMV_GFP_20 | 57.5 |
| SEQ ID NO: 1395 | CCCTCGAACTTCACCTCGGCGCGGGTCTTGTAGTTGCCGT | CMV_GFP_21 | 62.5 |
| SEQ ID NO: 1396 | AAGTCGATGCCCTTCAGCTCGATGCGGTTCACCAGGGTGT | CMV_GFP_22 | 57.5 |
| SEQ ID NO: 1397 | TTCTGCTTGTCGGCCATGATATAGACGTTGTGGCTGTTGT | CMV_GFP_24 | 47.5 |
| SEQ ID NO: 1398 | TCGATGTTGTGGCGGATCTTGAAGTTCACCTTGATGCCGT | CMV_GFP_25 | 50 |
| SEQ ID NO: 1399 | GTGTTCTGCTGGTAGTGGTCGGCGAGCTGCACGCTGCCGT | CMV_GFP_26 | 65 |
| SEQ ID NO: 1400 | TAGTGGTTGTCGGGCAGCAGCACGGGGCCGTCGCCGATGG | CMV_GFP_27 | 70 |
| SEQ ID NO: 1401 | TTCTCGTTGGGGTCTTTGCTCAGGGCGGACTGGGTGCTCA | CMV_GFP_28 | 60 |
| SEQ ID NO: 1402 | CCGGCGGCGGTCACGAACTCCAGCAGGACCATGTGATCGC | CMV_GFP_29 | 67.5 |
| SEQ ID NO: 1403 | TCCTCGGTACCCTTGTACAGCTCGTCCATGCCGAGAGTGA | CMV_GFP_30 | 57.5 | using a rabbit anti-GFP primary antibody and a secondary anti-rabbit antibody labeled with Alexa-488 dye.

Example 22

Detection of Lentiviral Genes in Chimeric Antigen Receptor (CAR) T Cells by Nano-FISH This example illustrates the detection of lentiviral genes in chimeric antigen receptor (CAR) T cells using Nano-FISH. CD4+ T cells ("Peripheral Blood, Cryopreserved, CD4+ Helper T cells, negatively selected" from ALL-CELLS) from a human donor were transduced with a CD19 CAR vector at a titer of $1.2 \times 10^7$ infectious units (IU)/mL and transduction was carried out at 4 different multiplicities of infection (MOI): 0, 1.2, 2.4, and 4.8. Alternatively, transduction was carried out at an MOI of 0.5, 1, 5, and 10. Transduction was carried out by spinoculation and involved centrifuging virus and cells at 2,100 RPM for 1 hour with 10 ug/mL of protamine sulfate. 50,000 cells were transduced per condition. Alternatively, 100,000 cells were transduced using retronectin and protamine sulfate as transduction enhancers. Each of the above MOIs was assessed for viral insertions with viral Nano-FISH probe sets 5 days post transduction, as described below, to evaluate dose-dependent detection of viral insertions (increased multiplicity of infection (MOI) with increased virus). A no virus sample was imaged using an HS2 probe set (60 Q670-labeled probes targeting the HS2 regulatory element in the B-globin LCR, and thirty Q570-labeled probes targeting HS3 regulatory element in the B-globin LCR) as a positive control for imaging.

Viral Nano-FISH probes were designed against the lentiviral backbone. TABLE 14 shows CAR T cell probe sequences. A single fluorophore was incorporated on the first nucleotide at the 3' end. Transduced T cells were prepared for hybridization with a viral Nano-FISH probe set, shown in TABLE 14 designed against the chimeric antigen receptor (CAR) transfer plasmid. Probes of SEQ ID NO: 1212-SEQ ID NO: 1267 targeted the vector backbone and SEQ ID NO: 1268-SEQ ID NO: 1281 were designed against human endogenous elements that are also components of the CD19 CAR payload. Cells were also incubated with Q570-labeled probes targeting HS2, which served as an internal positive control for each FISH sample. Cells were incubated with SEQ ID NO: 1212-SEQ ID NO: 1267 (−hu) or SEQ ID NO: 1268-SEQ ID NO: 1281 (+hu). FIG. 51 illustrates where each of the oligonucleotide Nano-FISH probes of TABLE 14 (identified on FIG. 51 with the sequence description) bind on the CAR transfer plasmid.

TABLE 14

CAR T Cell Probe Sequences

| SEQ ID NO | Sequences (5' to 3') | Sequence Description | % GC Content |
|---|---|---|---|
| SEQ ID NO: 1212 | AGTCGCCGCCCCTCGCCTCTTGCCGTGCGCGCTTCAGCAA | Lenti-5'p.dna_1 | 70 |
| SEQ ID NO: 1213 | AATACTGACGCTCTCGCACCCATCTCTCTCCTTCTAGCCT | Lenti-5'p.dna_2 | 53 |
| SEQ ID NO: 1214 | GATGTTTCTAACAGGCCAGGATTAACTGCGAATCGTTCTA | Lenti-5'p.dna_4 | 43 |
| SEQ ID NO: 1215 | TGATCTAAGTTCTTCTGATCCTGTCTGAAGGGATGGTTGT | Lenti-5'p.dna_5 | 43 |
| SEQ ID NO: 1216 | AAGCTTCCTTGGTGTCTTTTATCTCTATCCTTTGATGCAC | Lenti-5'p.dna_6 | 40 |
| SEQ ID NO: 1217 | GAAGATCAGCGGCCGGCCGCTTGCTGTGCGGTGGTCTTAC | Lenti-5'p.dna_7 | 65 |
| SEQ ID NO: 1218 | CGTCAGCGTCATTGACGCTGCGCCCATAGTGCTTCCTGCT | Lenti-5'p.dna_10 | 60 |
| SEQ ID NO: 1219 | GCGCCTCAATAGCCCTCAGCAAATTGTTCTGCTGCTGCAC | Lenti-5'p.dna_11 | 55 |
| SEQ ID NO: 1220 | CTTTCCACAGCCAGGATTCTTGCCTGGAGCTGCTTGATGC | Lenti-5'p.dna_12 | 55 |
| SEQ ID NO: 1221 | CACAGCAGTGGTGCAAATGAGTTTTCCAGAGCAACCCCAA | Lenti-5'p.dna_13 | 50 |
| SEQ ID NO: 1222 | CCCACTCCATCCAGGTCGTGTGATTCCAAATCTGTTCCAG | Lenti-5'p.dna_14 | 53 |
| SEQ ID NO: 1223 | TTTTCTTGCTGGTTTTGCGATTCTTCAATTAAGGAGTGTA | Lenti-5'p.dna_15 | 35 |
| SEQ ID NO: 1224 | CCAATTTGTTATGTTAAACCAATTCCACAAACTTGCCCAT | Lenti-5'p.dna_16 | 35 |
| SEQ ID NO: 1225 | GTACAGCAAAAACTATTCTTAAACCTACCAAGCCTCCTAC | Lenti-5'p.dna_17 | 40 |

TABLE 14-continued

CAR T Cell Probe Sequences

| SEQ ID NO | Sequences (5' to 3') | Sequence Description | % GC Content |
|---|---|---|---|
| SEQ ID NO: 1226 | CTCGGGGTTGGGAGGTGGGTCTGAA ACGATAATGGTGAAT | Lenti-5'p.dna_18 | 53 |
| SEQ ID NO: 1227 | TCTTTCCCCTGCACTGTACCCCCCAA TCCCCCCTTTTCTT | Lenti-5'p.dna_20 | 55 |
| SEQ ID NO: 1228 | GTAATCCAGAGGTTGATTGTTCCAG ACGCGGTCTAGATTA | Lenti-3'p.dna_0 | 45 |
| SEQ ID NO: 1229 | AAGCAGCGTATCCACATAGCGTAAA AGGAGCAACATAGTT | Lenti-3'p.dna_1 | 43 |
| SEQ ID NO: 1230 | AACCAGGATTTATACAAGGAGGAGA AAATGAAAGCCATAC | Lenti-3'p.dna_2 | 38 |
| SEQ ID NO: 1231 | GTCAGCAAACACAGTGCACACCACG CCACGTTGCCTGACA | Lenti-3'p.dna_3 | 58 |
| SEQ ID NO: 1232 | GGAGGGGGAAAGCGAAAGTCCCGG AAAGGAGCTGACAGGT | Lenti-3'p.dna_4 | 60 |
| SEQ ID NO: 1233 | GTGCCCAACAGCCGAGCCCCTGTCC AGCAGCGGGCAAGGC | Lenti-3'p.dna_5 | 73 |
| SEQ ID NO: 1234 | CCAGGTGGCAACACAGGCGAGCAG CCATGGAAAGGACGTC | Lenti-3'p.dna_6 | 63 |
| SEQ ID NO: 1235 | GGCCGCGGGAAGGAAGGTCCGCTG GATTGAGGGCCGAAGG | Lenti-3'p.dna_7 | 70 |
| SEQ ID NO: 1236 | GCCCAAAGGGAGATCCGACTCGTCT GAGGGCGAAGGCGAA | Lenti-3'p.dna_8 | 63 |
| SEQ ID NO: 1237 | TATTGCTACTTGTGATTGCTCCATGT TTTTCTAGGTCTCG | Lenti-3'p.dna_9 | 40 |
| SEQ ID NO: 1238 | GAAACCAGAGGAGCTCTCTCGACGC AGGACTCGGCTTGCT | Lenti-5'm35.dna_0 | 60 |
| SEQ ID NO: 1239 | CGACTGGTGAGTACGCCAAAAATTT TGACTAGCGGAGGCT | Lenti-5'm35.dna_1 | 50 |
| SEQ ID NO: 1240 | GTATTAAGCGGGGGAGAATTAGATC GCGATGGGAAAAAAT | Lenti-5'm35.dna_2 | 43 |
| SEQ ID NO: 1241 | TAAATTAAAACATATAGTATGGGCA AGCAGGGAGCTAGAA | Lenti-5'm35.dna_3 | 35 |
| SEQ ID NO: 1242 | ACATCAGAAGGCTGTAGACAAATAC TGGGACAGCTACAAC | Lenti-5'm35.dna_4 | 45 |
| SEQ ID NO: 1243 | GATCATTATATAATACAGTAGCAAC CCTCTATTGTGTGCA | Lenti-5'm35.dna_5 | 35 |
| SEQ ID NO: 1244 | TCTTCAGACCTGGAGGAGGAGATAT GAGGGACAATTGGAG | Lenti-5'm35.dna_7 | 50 |
| SEQ ID NO: 1245 | AATTGAACCATTAGGAGTAGCACCC ACCAAGGCAAAGAGA | Lenti-5'm35.dna_8 | 45 |
| SEQ ID NO: 1246 | GGAATAGGAGCTTTGTTCCTTGGGT TCTTGGGAGCAGCAG | Lenti-5'm35.dna_9 | 53 |
| SEQ ID NO: 1247 | TGACGGTACAGGCCAGACAATTATT GTCTGGTATAGTGCA | Lenti-5'm35.dna_10 | 45 |
| SEQ ID NO: 1248 | GGCGCAACAGCATCTGTTGCAACTC ACAGTCTGGGGCATC | Lenti-5'm35.dna_11 | 58 |
| SEQ ID NO: 1249 | GAAAGATACCTAAAGGATCAACAGC TCCTGGGGATTTGGG | Lenti-5'm35.dna_12 | 48 |
| SEQ ID NO: 1250 | CTGTGCCTTGGAATGCTAGTTGGAG TAATAAATCTCTGGA | Lenti-5'm35.dna_13 | 43 |

TABLE 14-continued

CAR T Cell Probe Sequences

| SEQ ID NO | Sequences (5' to 3') | Sequence Description | % GC Content |
|---|---|---|---|
| SEQ ID NO: 1251 | GTGGGACAGAGAAATTAACAATTAC ACAAGCTTAATACAC | Lenti-5'm35.dna_14 | 35 |
| SEQ ID NO: 1252 | TGTACTTTCTATAGTGAATAGAGTTA GGCAGGGATATTCA | Lenti-5'm35.dna_17 | 35 |
| SEQ ID NO: 1253 | CCGAGGGGACCCGACAGGCCCGAA GGAATAGAAGAAGAAG | Lenti-5'm35.dna_18 | 60 |
| SEQ ID NO: 1254 | GATTAGTGAACGGATCTCGACGGTA TCGCCTTTAAAAGAA | Lenti-5'm35.dna_19 | 43 |
| SEQ ID NO: 1255 | AAAGAATAGTAGACATAATAGCAAC AGACATACAAACTAA | Lenti-5'm35.dna_20 | 28 |
| SEQ ID NO: 1256 | AAATTTTCGGGTTTATTACAGGGAC AGCAGAGATCCAGTT | Lenti-5'm35.dna_21 | 40 |
| SEQ ID NO: 1257 | ATTACAAAATTTGTGAAAGATTGAC TGGTATTCTTAACTA | Lenti-3'm35.dna_0 | 25 |
| SEQ ID NO: 1258 | TGCTTTAATGCCTTTGTATCATGCTA TTGCTTCCCGTATG | Lenti-3'm35.dna_1 | 40 |
| SEQ ID NO: 1259 | TGGTTGCTGTCTCTTTATGAGGAGTT GTGGCCCGTTGTCA | Lenti-3'm35.dna_2 | 50 |
| SEQ ID NO: 1260 | CTGACGCAACCCCCACTGGTTGGGG CATTGCCACCACCTG | Lenti-3'm35.dna_3 | 65 |
| SEQ ID NO: 1261 | CCTCCCTATTGCCACGGCGGAACTC ATCGCCGCCTGCCTT | Lenti-3'm35.dna_4 | 65 |
| SEQ ID NO: 1262 | GGCACTGACAATTCCGTGGTGTTGT CGGGGAAGCTGACGT | Lenti-3'm35.dna_5 | 58 |
| SEQ ID NO: 1263 | CCTGGATTCTGCGCGGGACGTCCTT CTGCTACGTCCCTTC | Lenti-3'm35.dna_6 | 63 |
| SEQ ID NO: 1264 | CGGCCTGCTGCCGGCTCTGCGGCCT CTTCCGCGTCTTCGC | Lenti-3'm35.dna_7 | 75 |
| SEQ ID NO: 1265 | TGGGCCGCCTCCCCGCCTGGAATTA ATTCTGCAGTCGAGA | Lenti-3'm35.dna_8 | 60 |
| SEQ ID NO: 1266 | CAATACAGCAGCTACCAATGCTGAT TGTGCCTGGCTAGAA | Lenti-3'm35.dna_9 | 48 |
| SEQ ID NO: 1267 | GTCACACCTCAGGTACCTTTAAGAC CAATGACTTACAAGG | Lenti-3'm35.dna_10 | 45 |
| SEQ ID NO: 1268 | CAGTTTACCCCGCGCCACCTTCTCTA GGCACCGGTTCAAT | Lenti-hu-frag-payload.dna_6 | 58 |
| SEQ ID NO: 1269 | TGTGGGGAAACTCCATCGCATAAAA CCCCTCCCCCCAACC | Lenti-hu-frag-payload.dna_28 | 58 |
| SEQ ID NO: 1270 | CCATGGTGGCGGCGAATTCGAATCA CGACACCTGAAATGG | Lenti-hu-frag-payload.dna_32 | 55 |
| SEQ ID NO: 1271 | GCAGCAAGGCCAGCGGCAGGAGCA AGGCGGTCACTGGTAA | Lenti-hu-frag-payload.dna_33 | 65 |
| SEQ ID NO: 1272 | GGGCTGGACTTCGCCTGTGATTTCTG GGTGCTGGTCGTTG | Lenti-hu-frag-payload.dna_54B | 60 |
| SEQ ID NO: 1273 | GGGTCATGTTCATGTAGTCGCTGTG CAGCAGTCTGCTCCG | Lenti-hu-frag-payload.dna_57 | 58 |
| SEQ ID NO: 1274 | TGCCCCGTTTGCTCCGGTAGGCGGC GAAATCCCTGGGAGG | Lenti-hu-frag-payload.dna_59 | 68 |
| SEQ ID NO: 1275 | ATCGGCAGCTACAGCCATCTTCCTCT TGAGTAGTTTGTAC | Lenti-hu-frag-payload.dna_61 | 48 |

TABLE 14-continued

CAR T Cell Probe Sequences

| SEQ ID NO | Sequences (5' to 3') | Sequence Description | % GC Content |
|---|---|---|---|
| SEQ ID NO: 1276 | GAAGGAGGATGTGAACTGAGAGTG AAGTTCAGCAGGAGCG | Lenti-hu-frag-payload.dna_61B | 53 |
| SEQ ID NO: 1277 | CCATCTCAGGGTCCCGGCCACGTCT CTTGTCCAAAACATC | Lenti-hu-frag-payload.dna_65 | 58 |
| SEQ ID NO: 1278 | CTCTGCCCTCGCGAGGGGGCAGGGC CTGCATGTGAAGGGC | Lenti-hu-frag-payload.dna_70 | 73 |
| SEQ ID NO: 1279 | GGCCAGGGTTCTCTTCCACGTCGCC ACATGTCAGCAGGCT | Lenti-hu-frag-payload.dna_71 | 63 |
| SEQ ID NO: 1280 | TGCACTTGTCCACGCATTCCCTGCCT CGGCTGACATTCCG | Lenti-hu-frag-payload.dna_87 | 60 |
| SEQ ID NO: 1281 | GGCAGGTCTTGACGCAGTGGGGGCC GTCAATGTAGTGGGC | Lenti-hu-frag-payload.dna_91 | 65 |

Briefly, T cells were seeded onto a poly-1-lysine coated cover slip in a 6-well tissue culture plate at a concentration of approximately 2 million cells/mL in a 100 µl volume. T cells are fixed in 2.5 mL of 4% paraformaldehyde (PFA) in 1×PBS for 10 min at room temperature. Cells were washed twice with 1×PBS, subsequently permeabilized once with 2 mL of PBS/0.5% Triton X-100, and allowed to sit for 15 min at room temperature. Cells were washed twice with PBS and incubated for 5 min in ~1.5 mL of 0.1M HCl. Cells were washed twice with 2×SSC, incubated in 2×SSC with 25 m/ml RNase A for 30 min at 37° C., and washed twice with 2×SSC. Cover slips were pre-equilibrated in 2.5 mL of 50% formamide, 2×SSC (pH 7) for at least 30 min prior to denaturation.

Denaturation solution (70% formamide in 2×SSC at a pH of 7) was prepared and added at a volume of 3 mL to the center of two wells in a 6-well plate. Well plates were placed on a digital hot plate at 78° C. and are pre-heated for at least 30 minutes. Cover slips were transferred into the well plate with the denaturation solution (cells are on the side facing up) and incubated for 4.5 min at 78° C. Alternatively, cells were co-denatured and hybridized in sealed slides for 3 minutes on a heat block set to 78° C.

A humidified chamber was prepared for hybridization of viral Nano-FISH probes to the cells. First, a single sheet of Parafilm was overlaid on a wet flat napkin in a 150 mm tissue culture plate. 70 µl of hybridization buffer (50% formamide, 10% dextran sulfate in 2×SSC with 2.5 µl of the Nano-FISH probe set at a 10 µM working concentration) was added on the Parafilm sheet in the humidified chamber. The cover slip was removed from the denaturation solution, dabbed on a Kimwipe to remove excess liquid, and placed onto the hybridization solution (cells are on the side facing down). The humidified chamber was covered with a lid and incubated overnight at 37° C.

2.5 mL of 2×SSC was added to a fresh well-plate and cover-slips in hybridization solution are transferred to the fresh well-plate. Cells were washed 3 times with 2×SSC over 30 min at room temperature. Cells were washed twice for 7 min with 2 mL of 0.2×SSC/0.2% Tween-20 and placed onto a digital hot plate set to 56° C. Cells were washed once with 2 mL of 4×SSC/0.2% Tween-20. Cells were incubated in 2 mL of 2×SSC with 100 ng/mL DAPI for 10 min at room temperature. Cells were washed twice with 2×SSC. Cells were mounted and imaged.

Images of cells were collected for visualization of DAPI fluorescence, indicating the nucleus and visualization of fluorescence in the Cy5 channel, indicating the viral Nano-FISH probe.

Imaging was carried out and analyzed as shown in FIG. 48-FIG. 50. FIG. 48 illustrates a flow chart depicting the image analysis steps of the present disclosure including data/image capture, autonomous pre-processing, and interactive data selection, quality control, and visualization. Images of 100-500 cells are captured on a digital microscope. FIG. 49 shows an example quality control browser panel where images can be analyzed for spots indicating viral insertions. FIG. 50 illustrates an example experiment summary report with performance metrics. Autonomous pre-processing of the images is carried out by the accompanying software including any of the following: image enhancement (e.g., deconvolution), nucleus segmentation, Nano-FISH spot detection, and protein expression measurements. Data is then visualized on an interactive software platform that allows for thresholding, sorting, data compilation, data plotting, and calculation of performance metrics including any of the following: total cells (number of nuclei analyzed), mitotic index (fraction of cells undergoing cell division), insertion rate (expected number of insertion events per nucleus, based on fitting a Poisson distribution to the histogram of insertions per cell), insertion rate $R^2$ (Pearson correlation of actual versus Poisson prediction of histogram of insertions per cell), and expression enhancement (average change in protein expression (mean nuclear intensity) per insertion).

Cy5 fluorescence appeared as spots within the nuclei of transduced T cells and each spot was indicative of a viral insertion. FIG. 57 illustrates the Nano-FISH detection of viral insertions after transduction at an MOI of 0, 1.2, 2.4, and 4.8. FIG. 57A illustrates a schematic of T cells stimulated with the CD19 CAR transfer plasmid at the specified MOI. FIG. 57B illustrates fluorescence images of cell nuclei wherein the viral insertions are indicated by arrows and appear as punctate spots. FIG. 57C illustrates the experiment summary report indicating the insertion rate, insertion rate $R^2$, and the sample size. Results showed that as the MOI was increased, an increasing number of viral insertions were observed per cell with (+hu) and without (−hu) the probes directed against the CD19 CAR payload.

FIG. 60 illustrates Nano-FISH detection of viral insertions in T cells after transduction using at an MOI of 10. FIG. 60A illustrates a sample of T cells taken from a well of a 24-well plate after CD19 CAR lentivirus vector transduction. FIG. 60B illustrates the number of viral insertions per nucleus of cells from the sample in FIG. 60A as detected by probes to the lentivirus vector backbone and to select regions of the CD19 CAR using Nano-FISH. FIG. 60C shows fluorescent images of cell nuclei with 0-5+ viral insertions per cell from the sample in FIG. 60A. Each circle/punctum indicates a viral insertion.

Example 23

Detection of Viral Insertions in Engineered Chimeric Antigen Receptor (CAR) T Cells by Nano-FISH for Use in CAR T Cell Therapy for Relapsed/Refractory Multiple Myeloma This example describes detection of viral insertions in engineered chimeric antigen receptor (CAR) T cell therapy for relapsed/refractor multiple myeloma. T cells are transduced with a CAR transfer plasmid to introduce a B-cell mature antigen (BCMA) CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. T cells are administered to a subject in need thereof. The subject is a human or non-human animal. The subject's relapsed/refractor multiple myeloma is alleviated by the CAR T cell therapy.

Example 24

Detection of Viral Insertions in Engineered Chimeric Antigen Receptor (CAR) T Cells by Nano-FISH for Use in CAR T Cell Therapy for Non-Hodgkin Lymphoma This example describes detection of viral insertions in engineered chimeric antigen receptor (CAR) T cell therapy for non-Hodgkin lymphoma. T cells are transduced with a CAR transfer plasmid to introduce a CD19 CAR or a CD22 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's non-Hodgkin lymphoma is alleviated by the CAR T cell therapy.

Example 25

Detection of Viral Insertions in Engineered Chimeric Antigen Receptor (CAR) T Cells by Nano-FISH for Use in CAR T Cell Therapy for Pediatric Acute Lymphoblastic Leukemia This example describes detection of viral insertions in engineered chimeric antigen receptor (CAR) T cell therapy for pediatric acute lymphoblastic leukemia. T cells are transduced with a CAR transfer plasmid to introduce a CD22 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's pediatric acute lymphoblastic leukemia is alleviated by the CAR T cell therapy.

Example 26

Detection of Viral Insertions in Engineered Chimeric Antigen Receptor (CAR) T Cells by Nano-FISH for Use in CAR T Cell Therapy for Acute Myeloid Leukemia This example describes detection of viral insertions in engineered chimeric antigen receptor (CAR) T cell therapy for acute myeloid leukemia. T cells are transduced with a CAR transfer plasmid to introduce a WT1 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's acute myeloid leukemia is alleviated by the CAR T cell therapy.

Example 27

Detection of Viral Insertions in Engineered Chimeric Antigen Receptor (CAR) T Cells by Nano-FISH for Use in CAR T Cell Therapy for Non-Small Cell Lung Cancer This example describes detection of viral insertions in engineered chimeric antigen receptor (CAR) T cell therapy for non-small cell lung cancer. T cells are transduced with a CAR transfer plasmid to introduce a WT1 CAR or a ROR1 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's non-small cell lung cancer is alleviated by the CAR T cell therapy.

Example 28

Detection of Viral Insertions in Engineered Chimeric Antigen Receptor (CAR) T Cells by Nano-FISH for Use in CAR T Cell Therapy for Mesothelioma This example describes detection of viral insertions in engineered chimeric antigen receptor (CAR) T cell therapy for mesothelioma. T cells are transduced with a CAR transfer plasmid to introduce a WT1 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's mesothelioma is alleviated by the CAR T cell therapy.

Example 29

Detection of Viral Insertions in Engineered Chimeric Antigen Receptor (CAR) T Cells by Nano-FISH for Use in CAR T Cell Therapy for Pediatric Neuroblastoma This example describes detection of viral insertions in engineered chimeric antigen receptor (CAR) T cell therapy for pediatric neuroblastoma. T cells are transduced with a CAR transfer plasmid to introduce a L1CAM CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's pediatric neuroblastoma is alleviated by the CAR T cell therapy.

Example 30

Detection of Viral Insertions in Engineered Chimeric Antigen Receptor (CAR) T Cells by Nano-FISH for Use in CAR T Cell Therapy for Ovarian Cancer This example describes detection of viral insertions in engineered chimeric antigen receptor (CAR) T cell therapy for ovarian cancer. T cells are transduced with a CAR transfer plasmid to introduce a MUC16 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's ovarian cancer is alleviated by the CAR T cell therapy.

Example 31

Detection of Viral Insertions in Engineered Chimeric Antigen Receptor (CAR) T Cells by Nano-FISH for Use in CAR T Cell Therapy for Triple-Negative Breast Cancer This example describes detection of viral insertions in engineered chimeric antigen receptor (CAR) T cell therapy for triple-negative breast cancer. T cells are transduced with a CAR transfer plasmid to introduce a ROR1 CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CAR T cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's triple-negative breast cancer is alleviated by the CAR T cell therapy.

Example 32

Detection of Viral Insertions in Engineered Chimeric Antigen Receptor (CAR) T Cells by Nano-FISH for Use in CAR T Cell Therapy for Lung Cancer This example describes detection of viral insertions in engineered chimeric antigen receptor (CAR) T cell therapy for lung cancer. T cells are transduced with a CAR transfer plasmid to introduce a LeY CAR. Transduced CAR T cells are prepared for hybridization to a viral Nano-FISH probe set, as described above in EXAMPLE 22 and/or in a high throughput format as described below in EXAMPLE 39. A viral Nano-FISH probe set against the CAR transfer plasmid (including any one or more of the probes shown in TABLE 14, e.g., any one or more of SEQ ID NO: 1212-SEQ ID NO: 1281) is hybridized to the CART cells. CAR T cells are imaged to resolve spots within the nucleus, indicative of viral insertions. Performance metrics are calculated and displayed indicating any of the following: total cells, mitotic index, insertion rate, insertion rate $R^2$, and expression enhancement. CAR T cells are verified to have viral insertions, indicating successful transduction of the CAR. CAR T cells are administered to a subject in need thereof. The subject is a human or non-human animal. The subject's lung cancer is alleviated by the CAR T cell therapy.

Example 33

Detection of Lentiviral Genes in CD34+ Hematopoietic Stem Cells (HSCs) by Nano-FISH This example illustrates the detection of lentiviral genes in CD34+ hematopoietic stem cells (HSCs) using Nano-FISH. CD34+ HSCs from a human donor were transduced with a lentivirus vector with enhanced green fluorescent protein (eGFP), specifically the hPGK-eGFP-C1 vector or the gammaGlobin380-eGFP-C1 vector. The gamma-Globin380-eGFP-C1 vector comprised a fragment of the gamma globin promoter~380 base pairs in length in order to drive expression of the payload in a cell-type specific manner. Insulator elements were used to prevent adjacent regulatory elements from interfering with payload expression after lentivirus integration into the genome. Lentiviral-eGFP transduction was carried out at 4 different concentrations (0 virus, 20 µl virus, 60 µl virus, 180 µl virus) and in 20 µl virus with UM171 (a small molecule to stimulate replication of HSCs). Alternatively, cells were treated with virus at an MOI of 10, 25, or 35 with the addition of the small molecule UM171, and MOI 100. Each of the above concentrations was assessed for viral insertions with viral Nano-FISH probe sets, as described below, to evaluate dose-dependent detection of viral insertions (increased MOI with increased volumes of virus). A no virus sample was separately imaged using an HS2 probe set as a positive control for imaging. The HS2 probe set detected a 1.8 kb region encompassing the HS2 hypersensitive site of the β-globin locus control region (LCR) in triploid K562 erythroleukemia cells.

Viral Nano-FISH probes were designed against the lentiviral backbone. Viral Nano-FISH probe sequences are shown in TABLE 5. Probes of SEQ ID NO: 930-SEQ ID NO: 954 and SEQ ID NO: 965-SEQ ID NO: 990 targeting the vector backbone were used to detect lentiviral gene insertions in CD34+ HSCs. CD34+ HSCs are prepared for hybridization with one or more viral Nano-FISH probes, for example, one or more of the Nano-FISH probes shown in TABLE 5. FIG. 46 shows a vector map of where each of the probes described in TABLE 5 are designed to bind.

Briefly, CD34+ HSCs were seeded onto a poly-1-lysine coated cover slip in a 6-well tissue culture plate at a concentration of approximately 2 million cells/mL in a 100 µl volume. Alternatively, cells were fixed in a 24-well plate. Cells were fixed in 2.5 mL of a 3:1 methanol:acetic acid solution for 10 min at room temperature. Cells were washed twice with a 2× saline sodium citrate (SSC) buffer. Cells are incubated in 2×SSC and 25 m/mL of RNAse A for 30 min at 37° C. Cells were washed twice with 2×SSC. Cover slips were pre-equilibrated in 2.5 mL of 50% formamide, 2×SSC (pH 7) for at least 30 min prior to denaturation.

Denaturation solution (70% formamide in 2×SSC at a pH of 7) was prepared and added at a volume of 3 mL to the center of two wells in a 6-well plate. Well plates were placed on a digital hot plate at 78° C. and are pre-heated for at least 30 minutes. Cover slips were transferred into the well plate with the denaturation solution (cells are on the side facing up) and incubated for 4.5 min at 78° C. Alternatively, cells were co-denatured and hybridized in a 24-well plate for 10 minutes on a heat block set to 78° C.

A humidified chamber was prepared for hybridization of viral Nano-FISH probes to the cells. First, a single sheet of Parafilm was overlaid on a wet flat napkin in a 150 mm tissue culture plate. 70 µl of hybridization buffer (50% formamide, 10% dextran sulfate in 2×SSC with 2.5 µl of the Nano-FISH probe set) is added on the Parafilm sheet in the humidified chamber. The cover slip was removed from the denaturation solution, dabbed on a Kimwipe to remove excess liquid, and placed onto the hybridization solution (cells are on the side facing down). The humidified chamber was covered with a lid and incubated overnight at 37° C.

2.5 mL of 2×SSC was added to a fresh well-plate and cover-slips in hybridization solution are transferred to the fresh well-plate. Alternatively, washes were carried out in a 24-well plate. Cells were washed 3 times with 2×SSC over 30 min at room temperature. Cells were washed twice for 7 min with 2 mL of 0.2×SSC/0.2% Tween-20 and placed onto a digital hot plate set to 56° C. Cells were washed once with 2 mL of 4×SSC/0.2% Tween-20. Cells were incubated in 2 mL of 2×SSC with 100 ng/mL DAPI for 10 min at room temperature. Cells were washed twice with 2×SSC. Cells are mounted and imaged.

Images of cells were collected for visualization of DAPI fluorescence, indicating the nucleus and visualization of fluorescence in the Cy5 channel, indicating the viral Nano-FISH probe.

Imaging was carried out and analyzed as shown in FIG. 48-FIG. 50. FIG. 48 illustrates a flow chart depicting the image analysis steps of the present disclosure including data/image capture, autonomous pre-processing, and interactive data selection, quality control, and visualization. Images of 100-500 cells were captured on a digital microscope. FIG. 50 shows an example quality control browser panel where images can be analyzed for spots indicating viral insertions. FIG. 50 illustrates an example experiment summary report with performance metrics. Images of 100-500 cells are captured on a digital microscope. Autonomous pre-processing of the images is carried out by the accompanying software including any of the following: image enhancement (e.g., deconvolution), nucleus segmentation, Nano-FISH spot detection, and protein expression measurements. Data was then visualized on an interactive software platform that allows for thresholding, sorting, data compilation, data plotting, and calculation of performance metrics including any of the following: total cells (number of nuclei analyzed), mitotic index (fraction of cells undergoing cell division), insertion rate (expected number of insertion events per nucleus, based on fitting a Poisson distribution to the histogram of insertions per cell), insertion rate $R^2$ (Pearson correlation of actual versus Poisson prediction of histogram of insertions per cell), and expression enhancement (average change in protein expression (mean nuclear intensity) per insertion).

FIG. 58 illustrates Nano-FISH detection of viral insertions from a hPGK-EGFP-C1 vector and a gamma-Globin380-eGFP-C1 vector. FIG. 58A illustrates a schematic of CD34+ cells transduced with the hPGK-EGFP-C1 vector and a gammaGlobin380-eGFP-C1 vector with 0 μl, 20 μl, 60 μl, or 180 μl of virus. Samples also included cells transduced with 20 μl of virus with 35 nM of UM171 (a small molecule to stimulate replication of HSCs). FIG. 58B illustrates fluorescence images of cell nuclei wherein the viral insertions are indicated by arrows and appear as punctate spots. FIG. 58C illustrates the experiment summary report indicating the insertion rate. Cy5 fluorescence appeared as spots within the nuclei of CD34+ HSCs and each spot is indicative of a viral insertion.

Using the same methodology as described above, FIG. 59 illustrates Nano-FISH detection of viral insertions in CD34+ cells. FIG. 59A illustrates a sample of CD34+ cells taken from a well of a 24-well plate after transduction with gammaGlobin380-eGFP-C1 vector at an MOI of 35. FIG. 59B illustrates the number of viral insertions per nucleus of cells from the sample in FIG. 59A as detected by probes of SEQ ID NO: 930-SEQ ID NO: 954 and SEQ ID NO: 965-SEQ ID NO: 990 targeting the vector backbone and probes of SEQ ID NO: 1388-SEQ ID NO: 1403 targeting to eGFP using Nano-FISH. FIG. 59C shows fluorescent images of cell nuclei with 5-10 viral insertions per cell from the sample in FIG. 59A. Each circle/punctum indicates a viral insertion.

Example 34

Detection of Viral Insertions in Engineered CD34+ Hematopoietic Stem Cells (HSCs) by Nano-FISH for Use in Gene Therapy for Thalassemia This example describes detection of viral insertions in engineered CD34+ Hematopoietic Stem Cells (HSCs) for use in gene therapy for thalassemia. CD34+ HSCs are transduced with a lentivirus vector or adeno-associated virus vector to introduce a gene. CD34+ transduced cells are prepared for hybridization to a viral Nano-FISH probe set, as described above in EXAMPLE 33. A viral Nano-FISH probe set against the lentivirus vector or the adeno-associated virus vector is hybridized to the CD34+ transduced cells. Cells are imaged to resolve spots within the nucleus of the CD34+ transduced cells, indicative of viral insertions. Performance metrics are calculated and displayed indicating any of the following: total cells, mitotic index, insertion rate, insertion rate $R^2$, and expression enhancement. Transduced CD34+ cells are verified to have viral insertions, indicating successful transduction of the gene of interest for gene therapy. Transduced CD34+ cells are administered to a subject in need thereof. The subject is a human or non-human animal. The subject's thalassemia is alleviated by the gene therapy.

Example 35

Detection of Viral Insertions in Engineered CD34+ Hematopoietic Stem Cells (HSCs) by Nano-FISH for Use in Gene Therapy for Sickle Cell Disease This example describes detection of viral insertions in engineered CD34+ Hematopoietic Stem Cells (HSCs) for use in gene therapy for sickle cell disease. CD34+HSCs are transduced with a lentivirus vector or adeno-associated virus vector to introduce a gene. CD34+ transduced cells are prepared for hybridization to a viral Nano-FISH probe set, as described above in EXAMPLE 33. A viral Nano-FISH probe set against the lentivirus vector or the adeno-associated virus vector is hybridized to the CD34+ transduced cells. Cells are imaged to resolve spots within the nucleus of the CD34+ transduced cells, indicative of viral insertions. Performance metrics are calculated and displayed indicating any of the following: total cells, mitotic index, insertion rate, insertion rate $R^2$, and expression enhancement. Transduced CD34+ cells are verified to have viral insertions, indicating successful transduction of the gene of interest for gene therapy. Transduced CD34+ cells are administered to a subject in need thereof. The subject's sickle cell disease is alleviated by the gene therapy.

Example 36

Detection of Viral Insertions in Engineered Stem Cells (SCs) by Nano-FISH for Use in Gene Therapy for Muscular Atrophy Disease This example describes detection of viral insertions in engineered stem cells (SCs) for use in gene therapy for muscular atrophy disease. SCs are transduced with a lentivirus vector or adeno-associated virus vector to introduce a gene. Transduced cells are prepared for hybridization to a viral Nano-FISH probe set, as described above in EXAMPLE 33. A viral Nano-FISH probe set against the lentivirus vector or the adeno-associated virus vector is hybridized to the transduced cells. Cells are imaged to resolve spots within the nucleus of the transduced cells, indicative of viral insertions. Performance metrics are calculated and displayed indicating any of the following: total cells, mitotic index, insertion rate, insertion rate $R^2$, and expression enhancement. Transduced cells are verified to have viral insertions, indicating successful transduction of the gene of interest for gene therapy. Transduced cells are administered to a subject in need thereof. The subject is a human or non-human animal. The subject's muscular atrophy disease is alleviated by the gene therapy.

Example 37

Detection of Viral Insertions in Engineered CD34+ Hematopoietic Stem Cells (HSCs) by Nano-FISH for Use in Gene Therapy for an Immune Disorder This example describes detection of viral insertions in engineered CD34+ Hematopoietic Stem Cells (HSCs) for use in gene therapy for an immune disorder. CD34+ HSCs are transduced with a lentivirus vector or adeno-associated virus vector to introduce a gene. CD34+ transduced cells are prepared for hybridization to a viral Nano-FISH probe set, as described above in EXAMPLE 33. A viral Nano-FISH probe set against the lentivirus vector or the adeno-associated virus vector is hybridized to the CD34+ transduced cells. Cells are imaged to resolve spots within the nucleus of the CD34+ transduced cells, indicative of viral insertions. Performance metrics are calculated and displayed indicating any of the following: total cells, mitotic index, insertion rate, insertion rate $R^2$, and expression enhancement. Transduced CD34+ cells are verified to have viral insertions, indicating successful transduction of the gene of interest for gene therapy. Transduced CD34+ cells are administered to a subject in need thereof. The subject is a human or non-human animal. The subject's immune disorder is alleviated by the gene therapy.

Example 38

Viral Integrant Copy Number Population Enrichment Using Nano-FISH

This example illustrates using the Nano-FISH methods of the present disclosure to sort and enrich subpools for a population with the desired distribution of viral integrations after viral transduction of a cell population. FIG. 53 illustrates sub-sampling a cell population to enrich for a desirable viral copy number. Progenitor cells from cells transduced with a lentivirus were separated into 24 subpools in a 24 well plate. Each subpool containing 10 progenitor cells and were expanded until 500-800 cells/well, as shown in FIG. 54. Cells from each subpool were imaged by the Nano-FISH methods of the present disclosure to characterize the number of viral sequence insertions. FIG. 54 additionally shows images of "Jackpot" cells, which contain 5+ viral insertions. FIG. 55 illustrates stratification of cells from each subpool by "good" or "bad" viral insertion profiles. "Good" viral insertion profiles are indicated by the red circle and the yellow dotted circle and largely comprised 1-2 viral insertions. FIG. 56 illustrates selection of subpools deemed to have a good viral insertion profile (mainly 1-2 viral insertions).

Example 39

Determining Multiplicity of Infection (MOI) of a Viral Vector Using Nano-FISH

This example illustrates using the Nano-FISH methods of the present disclosure to determine the multiplicity of infection (MOI) of a viral vector. A viral vector is manufactured under GMP or non-GMP conditions. The viral vector is lentivirus, adenovirus, adeno-associated virus, or a retrovirus. Crude vector is purified through a series of filtration steps. Purified vectors are transduced into a cell. The cell can be a cell line, such as a Jurkat cell, or a cell from a human donor. The transduced cells are imaged using the Nano-FISH methods of the present disclosure to visualize the actual number of viral insertions per cell, thereby obtaining a multiplicity of infection on a single cell basis.

Example 40

High Throughput Assays Using Viral Nano-FISH

This example illustrates high throughput assays using viral Nano-FISH. A total of 0.5 mL/well of poly-L-lysine (PLL) solution is added to a 24-well glass-bottom plate. Plates are incubated for 1-2 hours at room temperature and PLL is aspirated. Plates are rinsed with ddH20 3 times, water is aspirated, and plates are left to dry overnight at room temperature. Cells are seeded onto the PLL coated 24-well glass-bottom plate. Cells are pre-washed with PBS, resuspended to ~2,000,000 cells/mL in PBS and 20-50 µL of cells are spotted onto the center of each well. Cells are allowed to settle for 10-15 minutes at room temperature. Cells are fixed in 0.5 mL/well of fresh fixative solution (3 parts methanol and 1 part acetic acid). 500 µL of fixative solution is added to the wall of each well. The plate is shaken to dislodge poorly attached cells and incubated for 10 minutes at room temperature. Cells are washed with 0.5 mL/well with 2× saline sodium citrate (SSC) buffer twice over 10 minutes. Cells are incubated in 0.3 mL/well of 2×SSC buffer with 25 µg/mL RNase A for 30 minutes at 37° C. Cells are washed twice with 0.5 mL/well with 2×SSC buffer for 10 minutes. Cells are pre-equilibrated with 0.5 mL/well of 50% formamide, 2×SSC buffer (pH 7) for at least 30 minutes at room temperature prior to denaturation.

A hybridization solution with oligonucleotide Nano-FISH probes is prepared. 10 uM of oligonucleotide Nano-FISH probes is diluted in the hybridization solution containing 50% formamide, 10% dextran sulfate, 0.05% Tween-20, and 2×SSC buffer at a ratio of 1:40. The final concentration of oligonucleotide Nano-FISH probes is 250 nM. After removal of the equilibration buffer, 250 µL of hybridization buffer containing the probes is added to each well. The plate is gently rocked to spread the solution over the surface of the well and the plate is incubated for 10-15 minutes at room temperature. The well plate is heated to 78° C. on a hotplate for 10 minutes and then equilibrated to 37° C. Hybridization is carried out in a dark humidified chamber overnight at 37° C.

Cells are washed by first removing the hybridization buffer, and adding 200 µL/well of 2×SSC buffer. SSC buffer is aspirated and cells are washed with 0.5 mL/well of 2×SSC buffer 3 times for 10 minutes each at room temperature. Cells are next washed twice with 0.2×SSC, 0.2% Tween-20. 0.5 mL/well of said wash buffer is added at room temperature and incubated for 7 minutes at 56° C. Cells are further washed with 0.5 mL/well 4×SSC, 0.2% Tween-20 for 5 minutes at room temperature, incubated in 0.3 mL/well of 2×SSC+100 ng/mL DAPI for 10 minutes at room temperature, and washed twice with 2×SSC buffer for 5 minutes each. Cells are mounted for imaging by pre-washing 12 mm round glass coverslips, placing a 10 µL drop of Prolong Gold onto the coverslip, aspirating SSC buffer from each well containing cells, and inverting a coverslip onto the cells in each well. Prolong Gold is cured for 24 hours at room temperature.

Example 41

Detection of Lentiviral Insertions by Nano-FISH for the Detection of Non-Random Viral Transduction Efficacy and Accumulation on a Per Cell Basis in Primary Cells This example illustrates the detection of lentiviral insertions in primary CD34+ cells, where the distribution of cells susceptible to viral infection at the time of transduction is heterogeneous. This heterogeneity led to a non-random biodistribution of viral insertions in the cellular population, where an unexpectedly high number of insertions were detected in a small population of cells five days post-transduction.

Primary stimulated CD4+ T cells and CD34+ cells were transduced with Vesicular Stomatitis Virus Glycoprotein (VSVG)-enveloped lentiviral vectors at an MOI of 10. Post-transduction cells were harvested and profiled for lentiviral insertion with a vector only probe set of 60 backbone probes, more than 30 of those probes bind to the target vector backbone sequences used in the transductions. FIG. 66A shows the resulting distribution of viral integrations observed in T cells. The distribution of viral insertions in cells followed a Poisson distribution with very few cells occurring with more than 5 integrations (0.3%). FIG. 66B shows randomly selected T cell nuclei with 5 or more clearly delineated spots per cell (0.3%), and T cell nuclei from the MOI 0 negative control experiment showing no spots per cell and low background signal. FIG. 66C shows the resulting distribution of viral integrations in CD34+ where a large number of cell with greater than five viral integrations were observed, and an unexpectedly large fraction of cells had zero integrations. FIG. 66D shows randomly selected CD34+ cell nuclei with 5 spots or more per cell (12%), and CD34+ cell nuclei from the MOI 0 negative control experiment showing no spots per cell and low background signal.

Differences in susceptibility of infection can be driven by biological differences among cells, including their rate of division, and distribution of receptors capable of binding lentivirus envelope proteins. Nano-FISH detection of the lentiviral insertions revealed different patterns of insertion when using the same MOI for T cells and CD34+ cells. The pattern observed in CD34+ cells indicates that the time of transduction, the populations of cells susceptible to lentiviral infection were heterogeneous. Some cells were not susceptible to infection in contrast to a small highly-susceptible population of cells that showed high numbers of insertions. This resulted in a suboptimal distribution of lentiviral insertions in CD34+ cells.

The Nano-FISH compositions and methods of the present disclosure can thus be used to evaluate different cell types or cells at different cell cycles for their susceptibility of transfection. This could be useful for quality control purposes in adoptive cell transfer (e.g., CAR T cell) therapies.

Example 42

Detection of Lentiviral Insertions by Nano-FISH for the Detection of Nonrandom Viral Transduction Efficacy on a Per Cell Basis Driven by Growth Conditions Prior to Transduction This example describes the detection of lentiviral insertions in primary CD34+ cells, where the distribution of cells susceptible to lentiviral infection is altered depending on the growth conditions of cells prior to transduction.

BACKGROUND

CD34+ cells are heterogeneously susceptible to lentiviral infection. Differences in susceptibility of infection are driven by biological differences among cells, including their rate of division, and distribution of receptors capable of binding lentivirus envelope proteins. Methods.

The growth conditions for CD34+ cells were altered by varying the exposure time (i.e., 24 or 48 hrs) to cytokines in the media. As cytokines promote cell division and differentiation of CD34+ cells, the integration profile of transduced cells was altered.

Human primary CD34+ cells were thawed and cultured in StemSpan H3000 media (Stemcell technologies) with antibiotics (penicillin/streptomycin) and CC110 cytokine cocktail (Stemcell technologies) for either 24 hrs or 48 hrs prior to transduction with lentivirus carrying the GFP gene driven by a fragment of the gammaGlobin promoter. Cells were transduced at an MOI of 0, 10, and 50 on 50 ug/ml retronectin-coated plates using a concentration of 8 μg/ml protamine sulfate for both short and long cytokine treatment. Cells were collected on day 5 post-thaw and profiled with Nano-FISH in 24-well format with methanol/acetic acid fixation using 60 probes designed to generic lentivirus backbone sequences, and 16 probes designed to the GFP gene. The Nano-FISH probes were labeled with Quasar 670 dye. Samples were imaged on a Nikon wide field fluorescent microscope, using a 60× oil objective. The resulting images were processed and fluorescent spots called and tabulated in each nucleus.

The results obtained in this study demonstrated that a longer exposure time to cytokines led to an increase in the number of CD34+ cells with five or more viral insertions at an MOI of 50, as illustrated in FIG. 62. FIG. 62 shows the result of different exposure times to cytokines prior to transduction. FIG. 62A shows the insertion rates for MOIs of 0, 50 (short exposure (24 hrs)), and 50 (long exposure (48 hrs)). FIG. 62B shows 25 randomly-selected nuclei from MOI 50 short-exposure (24 hrs, left) to cytokines, long exposure (48 hrs, middle) to cytokines, and MOI 0 (right).

Example 43

Detection of Lentiviral Insertions by Nano-FISH for the Development of Optimal Viral Envelope-Target Cell Interactions This example describes the use of Nano-FISH for the detection of lentiviral insertions to select an optimal viral envelope protein for enhanced lentiviral insertions in target cells.

BACKGROUND

Differences in susceptibility of infection are driven by biological differences among cells such as their rate of division and the distribution of receptors capable of binding lentivirus envelope proteins. The most popular lentivirus envelope is the Vesicular Stomatitis Virus Glycoprotein (VSVG) that generally offers a wide tropism among cells. However, cells which lack the LDLR receptor to which VSVG binds are not highly susceptible to infection. Primary quiescent HSCs are an example of a cell type with low levels of LDLR, making VSVG a poor envelope match for this clinically relevant stem cell type. New envelope proteins are often rationally designed from existing virus envelopes and then tested for their efficacy of transduction in hard-to-transduce cell types. The resulting transductions are evaluated using gold-standard methods, such as qPCR and/or florescent cell sorting of a reporter gene. However, these methods do not reveal the single-cell distribution of insertions and therefore will not reveal unexpected accumulation of insertions in some cells and/or a lack of insertions in other cells of the same cell population.
Methods.

To reveal the true distribution of infection-susceptible cells within a cell population, Nano-FISH using lentiviral backbone probes as described herein could be used on cells in which lentivirus with new envelope proteins are tested, offering the possibility to screen for optimal envelope proteins for any cell type of interest.

Primary stimulated CD4+ T cells and CD34+ cells are transduced according to the methods as described herein using different envelope proteins that are engineered to target LDLR with high affinity at different binding sites or other cell surface receptors. Transduction conditions are varied and MOIs in this study ranged from 5-50. Post-transduction cells are harvested and profiled for lentiviral insertion with a vector only Nano-FISH probe set of 60 backbone probes, more than 30 of those probes bind to the target vector backbone sequences used in the transductions. The Nano-FISH probe distribution pattern among cells within a given cell population reveal information about the ability of engineered envelope proteins to facilitate transduction of the target cells. Thus, the compositions and methods of the present disclosure can be useful for the evaluation and high-throughput screening of the transduction efficacy of newly developed envelope proteins.

Example 44

Detection of Latent HIV Insertions by Nano-FISH

This example describes the detection of HIV insertions in the genome of cells of human patient in which the virus is latent, i.e. integrated in to genome but not currently active.

BACKGROUND

HIV latency poses a barrier for curing the disease because inactive virus is difficult to target by drug or immunotherapy. Furthermore, the identity and number of T cells (or other cell types) latently infected with HIV is not well characterized and likely varies between patients.
Methods.
HIV integrations are detected by nano-FISH using probes to target the HIV genome or universal lentivirus backbone probes in patient cells that are otherwise healthy cells that cannot or only with high difficulty are detected using conventional methodologies.

Cells derived from human patient samples are incubated with a Nano-FISH vector only probe set of 60 backbone probes as described herein. More than 30 of those probes bind to universal lentivirus backbone sequences of HIV. The resulting distribution of viral integrations observed in these cells provides information about the present of HIV-derived insertions into the host genome. In addition, the Nano-FISH compositions and methods of the present disclosure may reveal additional features of a latent HIV-infected cell such as cell type and frequency of integrations that can be useful to evaluate the size of the viral reservoir. these two pieces of information will further guide patient care and inform anti-retroviral treatment outcomes.

The examples and embodiments described herein are for illustrative purposes only and various modifications or changes suggested to persons skilled in the art are to be included within the spirit and purview of this application and scope of the appended claims.

What is claimed is:

1. A method for detecting presence or absence of a viral vector backbone nucleic acid sequence integrated into genomic DNA of human cells, wherein the viral vector backbone nucleic acid sequence is no more than 3 kilobases (kb) in length, the method comprising:
  a) contacting fixed and permeabilized human cells with a plurality of probes under hybridization conditions, wherein each probe of the plurality of probes:
    (i) has a length of 30 to 50 nucleotides;
    (ii) binds to the viral vector backbone nucleic acid sequence and is at least 95% complementary to the viral vector backbone nucleic acid sequence; and
    (iii) comprises a single fluorophore directly conjugated to the first nucleotide at the 3' end of the probes, wherein the same fluorophore is directly conjugated to each probe, and wherein the probes are not conjugated to a quencher,
    wherein the plurality of probes are at least 30 probes and no more than 70 probes;
  b) detecting a presence of the fluorophore in the cells, wherein the presence of the fluorophore indicates the presence of the viral vector backbone nucleic acid sequence.

2. The method of claim 1, wherein each probe of the plurality of probes has a length of up to 40 nucleotides.

3. The method of claim 1, wherein the viral vector backbone nucleic acid sequence is selected from the group consisting of lentivirus, adenovirus, and adeno-associated virus vector backbone nucleic acid sequence.

4. The method of claim 1, further comprising determining: a number of insertions from the viral vector backbone nucleic acid sequence on a per cell basis or a distribution of insertions from the viral vector backbone nucleic acid sequence in a population of the human cells.

5. The method of claim 4, further comprising correlating the number of insertions from the viral vector backbone nucleic acid sequence on a per cell basis to a property of the cell.

6. The method of claim 5, wherein the property of the cell comprises protein expression, mRNA transcript level, or cellular state.

7. The method of claim 1, wherein the plurality of probes comprises a first probe that hybridizes to a plus strand of the viral vector backbone nucleic acid sequence and a second probe that hybridizes to a minus strand of the viral vector backbone nucleic acid sequence.

8. The method of claim 1, wherein the plurality of probes is not blocked with a blocking agent prior to the contacting the plurality of probes with the cells.

9. The method of claim 1, wherein the viral vector backbone nucleic acid sequence is less than 2.5 kilobases in length.

SEQUENCE LISTING (1458 sequences)

SEQ ID NO: 1 - DNA, 40 bp, Artificial Sequence
  synthetic sequence
tttcccttgctcttcatgattttaacaacatgatggattt

SEQ ID NO: 2 - DNA, 40 bp, Artificial Sequence
  synthetic sequence
ccctgccccccattaactcacatcctgaattttatgttta

SEQ ID NO: 3 - DNA, 40 bp, Artificial Sequence
  synthetic sequence
gcacttcatcatcgtctttgaagtccccttcttgtcctcc

SEQ ID NO: 4 - DNA, 40 bp, Artificial Sequence
  synthetic sequence
tatgatgaacaccatgcaccacatgcaggttctggtgaag

SEQ ID NO: 5 - DNA, 40 bp, Artificial Sequence
  synthetic sequence
gatacaaaagaatattggtatgtatgttgcacagactcat

SEQ ID NO: 6 - DNA, 40 bp, Artificial Sequence
  synthetic sequence
cctatttcccccacacagccttcccacattggccaaccct

SEQ ID NO: 7 - DNA, 40 bp, Artificial Sequence
  synthetic sequence
tacaaagggcttctctggccagagagagccggtgtctgct

SEQ ID NO: 8 - DNA, 40 bp, Artificial Sequence
  synthetic sequence
tgggggggttaatggagttatggactgggatgggcagcct

SEQ ID NO: 9 - DNA, 40 bp, Artificial Sequence
  synthetic sequence
acctacctagggaactctttctccctggcactaggctagt

SEQ ID NO: 10 - DNA, 40 bp, Artificial Sequence
  synthetic sequence
actgactgagctgacctccagtacagggcctgaggccact

SEQ ID NO: 11 - DNA, 40 bp, Artificial Sequence
  synthetic sequence
ctgggagctaaatagaagcaaatatccccaggcctgggtg

SEQ ID NO: 12 - DNA, 40 bp, Artificial Sequence
  synthetic sequence
atgcgtcaagcaactacactcccacagtaaactgggaacc

SEQ ID NO: 13 - DNA, 40 bp, Artificial Sequence
  synthetic sequence
cagctccttggcagcctaggctctagctcaacatctgctt

SEQ ID NO: 14 - DNA, 40 bp, Artificial Sequence
  synthetic sequence
tgctggagtcgcaccaacctggctctgcctatctccagca

SEQ ID NO: 15 - DNA, 40 bp, Artificial Sequence
  synthetic sequence
ctctgtaggctgcacaacgtggaacagatgaaaggaacca

SEQ ID NO: 16 - DNA, 40 bp, Artificial Sequence
  synthetic sequence
tggggtaaattataatcatgaaattccgtcaagcttgaat

SEQ ID NO: 17 - DNA, 40 bp, Artificial Sequence
  synthetic sequence
aacatatttaatatggcatattcaaatgacagaaagtacg

SEQ ID NO: 18 - DNA, 40 bp, Artificial Sequence
  synthetic sequence
ctttattcttgctaatgttgactccttagcaaagataatt

SEQ ID NO: 19 - DNA, 40 bp, Artificial Sequence
  synthetic sequence
tgatctttgctaaactcttcaggaataaatgaacatttcc

SEQ ID NO: 20 - DNA, 40 bp, Artificial Sequence
  synthetic sequence
ttttcaagcagttaagaagcaagaattaatgactcgaata

SEQ ID NO: 21 - DNA, 40 bp, Artificial Sequence
  synthetic sequence
atgagagtgttgactgatgaagggctcctatacgcgggtt

SEQ ID NO: 22 - DNA, 40 bp, Artificial Sequence
  synthetic sequence
tctttcccatctgtttcccggcccctaccagaaataagtg

SEQ ID NO: 23 - DNA, 40 bp, Artificial Sequence
  synthetic sequence
atgaacctccctcgctccaagaccagagctcctaggaagt

SEQ ID NO: 24 - DNA, 40 bp, Artificial Sequence
  synthetic sequence
tctttattttattggccacaattgaacataggtataattt

SEQ ID NO: 25 - DNA, 40 bp, Artificial Sequence
  synthetic sequence
cagaagcaagccctgatcaaggaaaccattcacacttgat

SEQ ID NO: 26 - DNA, 40 bp, Artificial Sequence
  synthetic sequence
gtggcttttgctcaaagtgaggacgttatcagctctgccc

SEQ ID NO: 27 - DNA, 40 bp, Artificial Sequence
  synthetic sequence
ctttaaacaaaaactaaaggcgtaaggaaagataactact

SEQ ID NO: 28 - DNA, 40 bp, Artificial Sequence
  synthetic sequence
cagttgccacactttttttcactgctaaagttcgtaatga

SEQ ID NO: 29 - DNA, 40 bp, Artificial Sequence
  synthetic sequence
ggcaatcagaagtattttggttgcttctaggtcagaatga

SEQ ID NO: 30 - DNA, 40 bp, Artificial Sequence
  synthetic sequence
ggcagcaaacttgtttaggtatgattcatcattgtctgct

SEQ ID NO: 31 - DNA, 40 bp, Artificial Sequence
  synthetic sequence
ctacaaaacaatgagtctgattacgacccacagaaatgaa

SEQ ID NO: 32 - DNA, 40 bp, Artificial Sequence
  synthetic sequence
cctcccacagacccaaacatgctgctgcaaatgtctcact

SEQ ID NO: 33 - DNA, 40 bp, Artificial Sequence
  synthetic sequence
ggacaagcacacacatcgctgggaagatctgcaagcctcc

SEQ ID NO: 34 - DNA, 40 bp, Artificial Sequence
  synthetic sequence
taaacctggataacaagaacactgtttccactgcgctagt

SEQ ID NO: 35 - DNA, 40 bp, Artificial Sequence
  synthetic sequence
tcatcacgatgacaatggacaagccatatccctaacaggg

SEQ ID NO: 36 - DNA, 40 bp, Artificial Sequence
  synthetic sequence
tttccatgacaccaggaccgtaaagcaccttttacaccgt

SEQ ID NO: 37 - DNA, 40 bp, Artificial Sequence
  synthetic sequence
aattgggatgtgcaaaacctcttaacttgtagcaccaagt

SEQ ID NO: 38 - DNA, 40 bp, Artificial Sequence
  synthetic sequence
tcttgtgttattcgcctgcattgaaatcccatcccaatcc

SEQ ID NO: 39 - DNA, 40 bp, Artificial Sequence
  synthetic sequence
tgagtgatctctttgctgatcataaacatattcctccatc

SEQ ID NO: 40 - DNA, 40 bp, Artificial Sequence
  synthetic sequence
tgcattcattactaaatacacagggcatagcacatagtaa

SEQ ID NO: 41 - DNA, 40 bp, Artificial Sequence
  synthetic sequence
cttcaatgttgccaggaaaatccttgcaggaatcacaccc

SEQ ID NO: 42 - DNA, 40 bp, Artificial Sequence
  synthetic sequence
atttttttctaaagctttaggaaatacacacgtttcccct

SEQ ID NO: 43 - DNA, 40 bp, Artificial Sequence
  synthetic sequence
agagtaatcttcaacaatccttggtctaaacacacacaag

SEQ ID NO: 44 - DNA, 40 bp, Artificial Sequence
  synthetic sequence
cccagggacccacgccaagctcaccgcaccttccaccaaa

SEQ ID NO: 45 - DNA, 40 bp, Artificial Sequence
  synthetic sequence
agctcctgtactagctggtggggtgtggagcacacagccc

SEQ ID NO: 46 - DNA, 40 bp, Artificial Sequence
  synthetic sequence
tcacacagggaaagtgaggcttggtggttgatttgagcaa

SEQ ID NO: 47 - DNA, 40 bp, Artificial Sequence
  synthetic sequence
ccttccaacagccgtgtgagacaagaggtcttatcctctt

SEQ ID NO: 48 - DNA, 40 bp, Artificial Sequence
  synthetic sequence
acaagggtcactgagcacatgccatgtgttgggcacagtg

SEQ ID NO: 49 - DNA, 40 bp, Artificial Sequence
  synthetic sequence
gtctcctaagtctcattcttttcttaggattcttcagatc

SEQ ID NO: 50 - DNA, 40 bp, Artificial Sequence
  synthetic sequence
tccgcctaagtaaaacataaaattacttaagctgcgtaaa

SEQ ID NO: 51 - DNA, 40 bp, Artificial Sequence
  synthetic sequence
cattttgacctgattatctttgtctataagtcttaagcca

SEQ ID NO: 52 - DNA, 40 bp, Artificial Sequence
  synthetic sequence
ccggttcctccaccctcactgccccaacaactgaaagaag

SEQ ID NO: 53 - DNA, 40 bp, Artificial Sequence
  synthetic sequence
acagtgtgttgaaagaatccataactctttctttccagcc

SEQ ID NO: 54 - DNA, 40 bp, Artificial Sequence
  synthetic sequence
gaagtttcatctttatcaaaatctccattcccaggcggac

SEQ ID NO: 55 - DNA, 40 bp, Artificial Sequence
  synthetic sequence
aagtccatttttttaagctttgcgcttcagctccagaaca

SEQ ID NO: 56 - DNA, 40 bp, Artificial Sequence
  synthetic sequence
tcttcgttatgaatacaaataggaaaacaatcagacccaa

SEQ ID NO: 57 - DNA, 40 bp, Artificial Sequence
  synthetic sequence
tcctcggggcattctagaaccgtagcagacctgcttacat

SEQ ID NO: 58 - DNA, 40 bp, Artificial Sequence
  synthetic sequence
tccttatgtgggaaaataaagaggatagacagatttgatt

SEQ ID NO: 59 - DNA, 40 bp, Artificial Sequence
  synthetic sequence
agctgcgagtccctaacagacttccaggacagctgaaaaa

SEQ ID NO: 60 - DNA, 40 bp, Artificial Sequence
  synthetic sequence
aggacaagggagagacgcccacccgcctctgtcagggata

SEQ ID NO: 61 - DNA, 40 bp, Artificial Sequence
  synthetic sequence
aatccatgagggtgacatacacatccttactgttcccaca

SEQ ID NO: 62 - DNA, 40 bp, Artificial Sequence
  synthetic sequence
acttccttccctgagatgcccatcctttgattctgggatt

SEQ ID NO: 63 - DNA, 40 bp, Artificial Sequence
  synthetic sequence
gctcccggataaattaattaccgtgaccctgagctgcttc

SEQ ID NO: 64 - DNA, 40 bp, Artificial Sequence
  synthetic sequence
tagactaagagaatctaatttgtggcaaagatcttgagtg

SEQ ID NO: 65 - DNA, 40 bp, Artificial Sequence
  synthetic sequence
tgaaggatgactaagagcttccctataaaccccatactgg

SEQ ID NO: 66 - DNA, 40 bp, Artificial Sequence
  synthetic sequence
agccaggactatagagtttcagaaaagggagaaaattcta

SEQ ID NO: 67 - DNA, 40 bp, Artificial Sequence
  synthetic sequence
tgctgctaatttaagtttctggcaagtcaaaataaatctc

SEQ ID NO: 68 - DNA, 40 bp, Artificial Sequence
  synthetic sequence
cgaaaaccatcaattaactagaatgatcaggaaattgcgt

SEQ ID NO: 69 - DNA, 40 bp, Artificial Sequence
  synthetic sequence
tttatttagtccccagggtgtatgaagtgctcttccaggc

SEQ ID NO: 70 - DNA, 40 bp, Artificial Sequence
  synthetic sequence
ggtccttcttggtaccgatattgccatattggctggacat

SEQ ID NO: 71 - DNA, 40 bp, Artificial Sequence
  synthetic sequence
tggcttggtaggatgcactcacatgggctgtagtaatact

SEQ ID NO: 72 - DNA, 40 bp, Artificial Sequence
  synthetic sequence
tatcaccagcataacttgtggttcttcagccagtaatttc

SEQ ID NO: 73 - DNA, 40 bp, Artificial Sequence
  synthetic sequence
gaacaactgggtatctacaggcaaagaaatgaaccttgac

SEQ ID NO: 74 - DNA, 40 bp, Artificial Sequence
  synthetic sequence
taggtactgttgtgtccctatatatttgacttggtaataa

SEQ ID NO: 75 - DNA, 40 bp, Artificial Sequence
  synthetic sequence
tatgtgaacatcggtgaatatcataatttattatgcaaac

SEQ ID NO: 76 - DNA, 40 bp, Artificial Sequence
  synthetic sequence
agctgaacactctttgtggtcctcttgaagcctagaatta

SEQ ID NO: 77 - DNA, 40 bp, Artificial Sequence
  synthetic sequence
ccccacctcactgccccccagttctgactcacggtgtccc

SEQ ID NO: 78 - DNA, 40 bp, Artificial Sequence
  synthetic sequence
actcccatcacctggccagcttggctgtcccctgacccac

SEQ ID NO: 79 - DNA, 40 bp, Artificial Sequence
  synthetic sequence
ggctgcccagctgcccagcagcaaaactgcataggaactc

SEQ ID NO: 80 - DNA, 40 bp, Artificial Sequence
  synthetic sequence
gcccaggacgccaagtgtcaccaccctctccccaggcagg

SEQ ID NO: 81 - DNA, 40 bp, Artificial Sequence
  synthetic sequence
cacaaggtcagctccacccgtgggtcagtgtgccccagat

SEQ ID NO: 82 - DNA, 40 bp, Artificial Sequence
  synthetic sequence
ggagacaaaacgggcacccagcccagtcatgcccgtgcct

SEQ ID NO: 83 - DNA, 40 bp, Artificial Sequence
  synthetic sequence
ctgaaatcagtcagcagtttcggtgagtctgcagctgaca

SEQ ID NO: 84 - DNA, 40 bp, Artificial Sequence
  synthetic sequence
cgccacatttggggctgggagagatgtcacaggggctgac

SEQ ID NO: 85 - DNA, 40 bp, Artificial Sequence
  synthetic sequence
cacatgttctctgcataggtttttaagcagccagcagctg

SEQ ID NO: 86 - DNA, 40 bp, Artificial Sequence
  synthetic sequence
tttaaaatgaaaacccacacttccaaaatagcacttgagt

SEQ ID NO: 87 - DNA, 40 bp, Artificial Sequence
  synthetic sequence
aacatgtttgtgtaattaagcattttaaaatcataaccat

SEQ ID NO: 88 - DNA, 40 bp, Artificial Sequence
  synthetic sequence
tgcttatctgtgctttttatgttccacccccccaccacca

SEQ ID NO: 89 - DNA, 40 bp, Artificial Sequence
  synthetic sequence
attaataataattctgtgtttatggggattgcagatacat

SEQ ID NO: 90 - DNA, 40 bp, Artificial Sequence
  synthetic sequence
ccagctttgtgtcttcatgacccaactggagtaagaatgg

SEQ ID NO: 91 - DNA, 40 bp, Artificial Sequence
  synthetic sequence
aaagacctcatttgcagcatggttagcagtgtcaaacatt

SEQ ID NO: 92 - DNA, 40 bp, Artificial Sequence
  synthetic sequence
tctcgtagcactggctgcagccggcctgtgtgtgcccacc

SEQ ID NO: 93 - DNA, 40 bp, Artificial Sequence
  synthetic sequence
gccttcatcctgaacggctgaccagcggaaacaaaagatc

SEQ ID NO: 94 - DNA, 40 bp, Artificial Sequence
  synthetic sequence
atggccagataacagtgtttagacatgtctttgatgtttt

SEQ ID NO: 95 - DNA, 40 bp, Artificial Sequence
  synthetic sequence
ccctgactgtgtaaggggtctctctccatggggaatagag

SEQ ID NO: 96 - DNA, 40 bp, Artificial Sequence
  synthetic sequence
ctgagcttagcttctactgtgctgttaatttcaggcaaga

SEQ ID NO: 97 - DNA, 40 bp, Artificial Sequence
  synthetic sequence
agatcaataatatttgcattagctacttacatcagtctct

SEQ ID NO: 98 - DNA, 40 bp, Artificial Sequence
  synthetic sequence
taattgcagaaaacttataaagcatggaagaatacaaaac

SEQ ID NO: 99 - DNA, 40 bp, Artificial Sequence
  synthetic sequence
aaacaaattcctctacctggacatgactgttgttagcatt

SEQ ID NO: 100 - DNA, 40 bp, Artificial Sequence
  synthetic sequence
gggagattcttcatatccttttaatgtagatatgcacatt

SEQ ID NO: 101 - DNA, 40 bp, Artificial Sequence
  synthetic sequence
acaaaaaaggctatcatattgtacatataactttgctgta

SEQ ID NO: 102 - DNA, 40 bp, Artificial Sequence
  synthetic sequence
tctgctaggaacctgtacccatgtcattactgtaagcatt

SEQ ID NO: 103 - DNA, 40 bp, Artificial Sequence
  synthetic sequence
actactcaaattttagtatctgcagatatcagatatcctt

SEQ ID NO: 104 - DNA, 40 bp, Artificial Sequence
  synthetic sequence
tgaaatggtattgttgccctttctgattagtaaagtatac

SEQ ID NO: 105 - DNA, 40 bp, Artificial Sequence
  synthetic sequence
ttataatctagcaaggttagagatcatggatcactttcag

SEQ ID NO: 106 - DNA, 40 bp, Artificial Sequence
  synthetic sequence
acagcttgcctccgataagccagaattccagagcttctgg

SEQ ID NO: 107 - DNA, 40 bp, Artificial Sequence
  synthetic sequence
tcaatcaacctgatagcttaggggataaactaatttgaag

SEQ ID NO: 108 - DNA, 40 bp, Artificial Sequence
  synthetic sequence
gatcatgaaggatgaaagaatttcaccaatattataataa

SEQ ID NO: 109 - DNA, 40 bp, Artificial Sequence
  synthetic sequence
tttagccatctgtatcaatgagcagatataagctttacac

SEQ ID NO: 110 - DNA, 40 bp, Artificial Sequence
  synthetic sequence
aggggtagattatttatgctgcccatttttagaccataaa

SEQ ID NO: 111 - DNA, 40 bp, Artificial Sequence
  synthetic sequence
cactaccatttcacaattcgcactttctttctttgtcctt

SEQ ID NO: 112 - DNA, 40 bp, Artificial Sequence
  synthetic sequence
gctccatcaaatcataaaggacccacttcaaatgccatca

SEQ ID NO: 113 - DNA, 40 bp, Artificial Sequence
  synthetic sequence
tcctactttcaggaacttctttctccaaacgtcttctgcc

SEQ ID NO: 114 - DNA, 40 bp, Artificial Sequence
  synthetic sequence
aattctattttttcttcaacgtactttaggcttgtaatgt

SEQ ID NO: 115 - DNA, 40 bp, Artificial Sequence
  synthetic sequence
taagatgcaaatagtaagcctgagcccttctgtctaactt

SEQ ID NO: 116 - DNA, 40 bp, Artificial Sequence
  synthetic sequence
ctgtgtttcagaataaaataccaactctactactctcatc

SEQ ID NO: 117 - DNA, 40 bp, Artificial Sequence
  synthetic sequence
gaaaccatgtttatctcaggtttacaaatctccacttgtc

SEQ ID NO: 118 - DNA, 40 bp, Artificial Sequence
  synthetic sequence
ctttggaaaagtaatcaggtttagaggagctcatgagagc

SEQ ID NO: 119 - DNA, 40 bp, Artificial Sequence
  synthetic sequence
gctgaatccccaactcccaattggctccatttgtggggga

SEQ ID NO: 120 - DNA, 40 bp, Artificial Sequence
  synthetic sequence
ggtgttatgaacttaacgcttgtgtctccagaaaattcac

SEQ ID NO: 121 - DNA, 40 bp, Artificial Sequence
  synthetic sequence
agttaatgcacgttaataagcaagagtttagtttaatgtg

SEQ ID NO: 122 - DNA, 40 bp, Artificial Sequence
  synthetic sequence
taattgagaaggcagattcactggagttcttatataattg

SEQ ID NO: 123 - DNA, 40 bp, Artificial Sequence
  synthetic sequence
cacggtcagatgaaaatatagtgtgaagaatttgtataac

SEQ ID NO: 124 - DNA, 40 bp, Artificial Sequence
  synthetic sequence
cacaagtcagcatcagcgtgtcatgtctcagcagcagaac

SEQ ID NO: 125 - DNA, 40 bp, Artificial Sequence
  synthetic sequence
ggaggtggggacttaggtgaaggaaatgagccagcagaag

SEQ ID NO: 126 - DNA, 40 bp, Artificial Sequence
  synthetic sequence
gtcacagcatttcaaggaggagacctcattgtaagcttct

SEQ ID NO: 127 - DNA, 40 bp, Artificial Sequence
  synthetic sequence
aaagaggtgaaattaatcccatacccttaagtctacagac

SEQ ID NO: 128 - DNA, 40 bp, Artificial Sequence
  synthetic sequence
ctttactaaggaacttttcattttaagtgttgacgcatgc

SEQ ID NO: 129 - DNA, 40 bp, Artificial Sequence
  synthetic sequence
caggtttttctttccacggtaactacaatgaagtgatcct

SEQ ID NO: 130 - DNA, 40 bp, Artificial Sequence
  synthetic sequence
gctctacagggaggttgaggtgttagagatcagagcagga

SEQ ID NO: 131 - DNA, 40 bp, Artificial Sequence
  synthetic sequence
tactatttccaacggcatctggcttttctcagcccttgtg

SEQ ID NO: 132 - DNA, 40 bp, Artificial Sequence
  synthetic sequence
aaggtttaggcagggatagccattctattttattaggggc

SEQ ID NO: 133 - DNA, 40 bp, Artificial Sequence
  synthetic sequence
aggggctcaacgaagaaaaagtgttccaagctttaggaag

SEQ ID NO: 134 - DNA, 40 bp, Artificial Sequence
  synthetic sequence
gggctgaacccccttccctggattgcagcacagcagcgag

SEQ ID NO: 135 - DNA, 40 bp, Artificial Sequence
  synthetic sequence
ctgacgtcataatctaccaaggtcatggatcgagttcaga

SEQ ID NO: 136 - DNA, 40 bp, Artificial Sequence
  synthetic sequence
gaaggtagagctctcctccaataagccagatttccagagt

SEQ ID NO: 137 - DNA, 40 bp, Artificial Sequence
  synthetic sequence
caccaatattattataattcctatcaacctgataggttag

SEQ ID NO: 138 - DNA, 40 bp, Artificial Sequence
  synthetic sequence
agatataagccttacacaggattatgaagtctgaaaggat

SEQ ID NO: 139 - DNA, 40 bp, Artificial Sequence
  synthetic sequence
acatgtatctttctggtcttttagccgcctaacactttga

SEQ ID NO: 140 - DNA, 40 bp, Artificial Sequence
  synthetic sequence
caaagaacaagtgcaatatgtgcagctttgttgcgcaggt

SEQ ID NO: 141 - DNA, 40 bp, Artificial Sequence
  synthetic sequence
tattattatgtgagtaactggaagatactgataagttgac

SEQ ID NO: 142 - DNA, 40 bp, Artificial Sequence
  synthetic sequence
taaaaatctttctcacccatccttagattgagagaagtca

SEQ ID NO: 143 - DNA, 40 bp, Artificial Sequence
  synthetic sequence
ttgggttcacctcagtctctataatctgtaccagcatacc

SEQ ID NO: 144 - DNA, 40 bp, Artificial Sequence
  synthetic sequence
cacacccatctcacagatcccctatcttaaagagacccta

SEQ ID NO: 145 - DNA, 40 bp, Artificial Sequence
  synthetic sequence
atggaacccaaccagactctcagatatggccaaagatcta

SEQ ID NO: 146 - DNA, 40 bp, Artificial Sequence
  synthetic sequence
gacaccagtctctgacacattcttaaaggtcaggctctac

SEQ ID NO: 147 - DNA, 40 bp, Artificial Sequence
  synthetic sequence
agagattcaaaagattcacttgtttaggccttagcgggct

SEQ ID NO: 148 - DNA, 40 bp, Artificial Sequence
  synthetic sequence
tccttagtctgaggaggagcaattaagattcacttgttta

SEQ ID NO: 149 - DNA, 40 bp, Artificial Sequence
  synthetic sequence
taaatggggaagttgtttgaaaacaggagggatcctagat

SEQ ID NO: 150 - DNA, 40 bp, Artificial Sequence
  synthetic sequence
gggtttatacatgacttttagaacactgccttggtttttg

SEQ ID NO: 151 - DNA, 40 bp, Artificial Sequence
  synthetic sequence
aactcttaaaagatattgcctcaaaagcataagaggaaat

SEQ ID NO: 152 - DNA, 40 bp, Artificial Sequence
  synthetic sequence
aaatcgaggaataagacagttatggataaggagaaatcaa

SEQ ID NO: 153 - DNA, 40 bp, Artificial Sequence
  synthetic sequence
tcagttaggatttaatcaatgtcagaagcaatgatatagg

SEQ ID NO: 154 - DNA, 40 bp, Artificial Sequence
  synthetic sequence
cttgaaaacacttgaaattgcttgtgtaaagaaacagttt

SEQ ID NO: 155 - DNA, 40 bp, Artificial Sequence
  synthetic sequence
ataatcttcagaggaaagttttattctctgacttatttaa

SEQ ID NO: 156 - DNA, 40 bp, Artificial Sequence
  synthetic sequence
agattccttctgtcattttgcctctgttcgaatactttct

SEQ ID NO: 157 - DNA, 40 bp, Artificial Sequence
  synthetic sequence
atttcagcttctaaactttatttggcaatgccttcccatg

SEQ ID NO: 158 - DNA, 40 bp, Artificial Sequence
  synthetic sequence
gcaggagtttgttttcttctgcttcagagctttgaattta

SEQ ID NO: 159 - DNA, 40 bp, Artificial Sequence
  synthetic sequence
acatatcaacggcactggttctttatctaactctctggca

SEQ ID NO: 160 - DNA, 40 bp, Artificial Sequence
  synthetic sequence
ttatgcttccctgaaacaataccacctgctattctccact

SEQ ID NO: 161 - DNA, 40 bp, Artificial Sequence
  synthetic sequence
ttctcactccctaccactgaggacaagtttatgtccttag

SEQ ID NO: 162 - DNA, 40 bp, Artificial Sequence
  synthetic sequence
ttagagattatgtcattaccagagttaaaattctataatg

SEQ ID NO: 163 - DNA, 40 bp, Artificial Sequence
  synthetic sequence
ggtcattcttagaatagtaatccagccaatagtacaggtt

SEQ ID NO: 164 - DNA, 40 bp, Artificial Sequence
  synthetic sequence
caggcaataagggctttttaagcaaaacagttgtgataaa

SEQ ID NO: 165 - DNA, 40 bp, Artificial Sequence
  synthetic sequence
atgatgggcactgaaggttaaaacttgagtctgtcaactt

SEQ ID NO: 166 - DNA, 40 bp, Artificial Sequence
  synthetic sequence
aactcataaatatcccattttccgctgaaatatagcttta

SEQ ID NO: 167 - DNA, 40 bp, Artificial Sequence
  synthetic sequence
cctggtttctttgaccttttgggaccttgagtaagtaaag

SEQ ID NO: 168 - DNA, 40 bp, Artificial Sequence
  synthetic sequence
cttcatttattttcatgattaaaattctaagaaattcttg

SEQ ID NO: 169 - DNA, 40 bp, Artificial Sequence
  synthetic sequence
tttttaattaaattgcattgcctaatgtatttatgaacta

SEQ ID NO: 170 - DNA, 40 bp, Artificial Sequence
  synthetic sequence
catagaaataaaacaatactctgaagtagttcagaatgtg

SEQ ID NO: 171 - DNA, 40 bp, Artificial Sequence
  synthetic sequence
caatttatataaagagttaattcaaatgagactattttaa

SEQ ID NO: 172 - DNA, 40 bp, Artificial Sequence
  synthetic sequence
agggctttgaatcttatgtctagaaattttgaaaaacctc

SEQ ID NO: 173 - DNA, 40 bp, Artificial Sequence
  synthetic sequence
tatatgctaagattccacctctagtgctagaactgagaag

SEQ ID NO: 174 - DNA, 40 bp, Artificial Sequence
  synthetic sequence
tgacttggtgatcttttttaaattctgaaacaacagcaac

SEQ ID NO: 175 - DNA, 40 bp, Artificial Sequence
  synthetic sequence
agctaaggactttttcttgcctatgcatgctatcttcagt

SEQ ID NO: 176 - DNA, 40 bp, Artificial Sequence
  synthetic sequence
tgattatttagtattgaaactataacatagtatgtttcct

SEQ ID NO: 177 - DNA, 40 bp, Artificial Sequence
  synthetic sequence
aaaaaatgtgtatttctctggagaaggttaaaactgagga

SEQ ID NO: 178 - DNA, 40 bp, Artificial Sequence
  synthetic sequence
caagtgagcaaggcttaaatggaagaagcaatgatctcgt

SEQ ID NO: 179 - DNA, 40 bp, Artificial Sequence
  synthetic sequence
ccaccttcattaacgagatcatccatcatgaggaaatatg

SEQ ID NO: 180 - DNA, 40 bp, Artificial Sequence
  synthetic sequence
accaggccccctctgttttgtgtcactaagggtgaggatg

SEQ ID NO: 181 - DNA, 40 bp, Artificial Sequence
  synthetic sequence
atgatttttccctcccccgggcttcttttagccatcaata

SEQ ID NO: 182 - DNA, 40 bp, Artificial Sequence
  synthetic sequence
tagccccacaggagtttgttctgaaagtaaacttccacaa

SEQ ID NO: 183 - DNA, 40 bp, Artificial Sequence
  synthetic sequence
aagcttattgaggctaaggcatctgtgaaggaaagaaaca

SEQ ID NO: 184 - DNA, 40 bp, Artificial Sequence
  synthetic sequence
ctctaaaccactatgctgctagagcctcttttctgtactc

SEQ ID NO: 185 - DNA, 40 bp, Artificial Sequence
  synthetic sequence
ctcattcagacactagtgtcaccagtctcctcatatacct

SEQ ID NO: 186 - DNA, 40 bp, Artificial Sequence
  synthetic sequence
tattttcttcttcttgctggtttagtcatgttttctggga

SEQ ID NO: 187 - DNA, 40 bp, Artificial Sequence
  synthetic sequence
ggcaaacccattatttttttctttagacttgggatggtga

SEQ ID NO: 188 - DNA, 40 bp, Artificial Sequence
  synthetic sequence
tgggcagcgtcagaaactgtgtgtggatatagataagagc

SEQ ID NO: 189 - DNA, 40 bp, Artificial Sequence
  synthetic sequence
gactatgctgagctgtgatgagggaggggcctagctaaag

SEQ ID NO: 190 - DNA, 40 bp, Artificial Sequence
  synthetic sequence
tgagagtcagaatgctcctgctattgccttctcagtcccc

SEQ ID NO: 191 - DNA, 40 bp, Artificial Sequence
  synthetic sequence
ttggtttctacacaagtagatacatagaaaaggctatagg

SEQ ID NO: 192 - DNA, 40 bp, Artificial Sequence
  synthetic sequence
tgtttgagagtcctgcatgattagttgctcagaaatgccc

SEQ ID NO: 193 - DNA, 40 bp, Artificial Sequence
  synthetic sequence
ttacaaatatgtgattatcatcaaaacgtgagggctaaag

SEQ ID NO: 194 - DNA, 40 bp, Artificial Sequence
  synthetic sequence
cagataacttgcaagtcctaggataccaggaaaataaatt

SEQ ID NO: 195 - DNA, 40 bp, Artificial Sequence
  synthetic sequence
agcattatgtctgtctgtcattgtttttcatcctcttgta

SEQ ID NO: 196 - DNA, 40 bp, Artificial Sequence
  synthetic sequence
ttcacagttacccacacaggtgaacccttttagctctcct

SEQ ID NO: 197 - DNA, 40 bp, Artificial Sequence
  synthetic sequence
gaatgtttctttcctctcaggatcagagttgcctacatct

SEQ ID NO: 198 - DNA, 40 bp, Artificial Sequence
  synthetic sequence
aatgcaccaagactggcctgagatgtatccttaagatgag

SEQ ID NO: 199 - DNA, 40 bp, Artificial Sequence
  synthetic sequence
tcccagtagcaccccaagtcagatctgaccccgtatgtga

SEQ ID NO: 200 - DNA, 40 bp, Artificial Sequence
  synthetic sequence
gtgtcctctaacagcacaggccttttgccacctagctgtc

SEQ ID NO: 201 - DNA, 40 bp, Artificial Sequence
  synthetic sequence
ggcaaacaaggtttgttttcttttcctgttttcatgcctt

SEQ ID NO: 202 - DNA, 40 bp, Artificial Sequence
  synthetic sequence
ttccatatccttgtttcatattaatacatgtgtatagatc

SEQ ID NO: 203 - DNA, 40 bp, Artificial Sequence
  synthetic sequence
aaatctatacacatgtattaataaagcctgattctgccgc

SEQ ID NO: 204 - DNA, 40 bp, Artificial Sequence
  synthetic sequence
aggtatagaggccacctgcaagataaatatttgattcaca

SEQ ID NO: 205 - DNA, 40 bp, Artificial Sequence
  synthetic sequence
ctaatcattctatggcaattgataacaacaaatatatata

SEQ ID NO: 206 - DNA, 40 bp, Artificial Sequence
  synthetic sequence
ataatatattctagaatatgtcacattctgtctcaggcat

SEQ ID NO: 207 - DNA, 40 bp, Artificial Sequence
  synthetic sequence
tttctttatgatgccgtttgaggtggagttttagtcaggt

SEQ ID NO: 208 - DNA, 40 bp, Artificial Sequence
  synthetic sequence
agcttctccttttttttgccatctgccctgtaagcatcct

SEQ ID NO: 209 - DNA, 40 bp, Artificial Sequence
  synthetic sequence
gggacccagataggagtcatcactctaggctgagaacatc

SEQ ID NO: 210 - DNA, 40 bp, Artificial Sequence
  synthetic sequence
cacacaccctaagcctcagcatgactcatcatgactcagc

SEQ ID NO: 211 - DNA, 40 bp, Artificial Sequence
  synthetic sequence
ctgtgcttgagccagaaggtttgcttagaaggttacacag

SEQ ID NO: 212 - DNA, 40 bp, Artificial Sequence
  synthetic sequence
aactgctcatgcttggactatgggaggtcactaatggaga

SEQ ID NO: 213 - DNA, 40 bp, Artificial Sequence
  synthetic sequence
cagaaatgtaacaggaactaaggaaaaactgaagcttatt

SEQ ID NO: 214 - DNA, 40 bp, Artificial Sequence
  synthetic sequence
cagagatgaggatgctggaagggatagagggagctgagct

SEQ ID NO: 215 - DNA, 40 bp, Artificial Sequence
  synthetic sequence
aaaagtatagtaatcattcagcaaatggttttgaagcacc

SEQ ID NO: 216 - DNA, 40 bp, Artificial Sequence
  synthetic sequence
gtatcttattccccacaagagtccaagtaaaaaataacag

SEQ ID NO: 217 - DNA, 40 bp, Artificial Sequence
  synthetic sequence
gaaaagaatgtttctctcactgtggattattttagagagt

SEQ ID NO: 218 - DNA, 40 bp, Artificial Sequence
  synthetic sequence
aatggtcaagatttttttaaaaattaagaaaacataagtt

SEQ ID NO: 219 - DNA, 40 bp, Artificial Sequence
  synthetic sequence
cttgagaaatgaaaatttatttttttgttggaggataccc

SEQ ID NO: 220 - DNA, 40 bp, Artificial Sequence
  synthetic sequence
tctatctcccatcagggcaagctgtaaggaactggctaag

SEQ ID NO: 221 - DNA, 40 bp, Artificial Sequence
  synthetic sequence
agtgagacagagtgacttagtcttagaggccccactggta

SEQ ID NO: 222 - DNA, 40 bp, Artificial Sequence
  synthetic sequence
gatgagaaggcaccttcatcactcatcacagtcagctctg

SEQ ID NO: 223 - DNA, 40 bp, Artificial Sequence
  synthetic sequence
tctcctctctcctttctcatcagaaatttcataagtctac

SEQ ID NO: 224 - DNA, 40 bp, Artificial Sequence
  synthetic sequence
gtcaggcagatcacataagaaaagaggatgccagttaagg

SEQ ID NO: 225 - DNA, 40 bp, Artificial Sequence
  synthetic sequence
gttgctgttagacaatttcatctgtgccctgcttaggagc

SEQ ID NO: 226 - DNA, 40 bp, Artificial Sequence
  synthetic sequence
tctttaatgaaagctaagctttcattaaaaaaagtctaac

SEQ ID NO: 227 - DNA, 40 bp, Artificial Sequence
  synthetic sequence
tgcattcgactttgactgcagcagctggttagaaggttct

SEQ ID NO: 228 - DNA, 40 bp, Artificial Sequence
  synthetic sequence
gaggagggtcccagcccattgctaaattaacatcaggctc

SEQ ID NO: 229 - DNA, 40 bp, Artificial Sequence
  synthetic sequence
actggcagtatatctctaacagtggttgatgctatcttct

SEQ ID NO: 230 - DNA, 40 bp, Artificial Sequence
  synthetic sequence
cttgcctgctacattgagaccactgacccatacataggaa

SEQ ID NO: 231 - DNA, 40 bp, Artificial Sequence
  synthetic sequence
atagctctgtcctgaactgttaggccactggtccagagag

SEQ ID NO: 232 - DNA, 40 bp, Artificial Sequence
  synthetic sequence
catctcctttgatcctcataataaccctatgagatagaca

SEQ ID NO: 233 - DNA, 40 bp, Artificial Sequence
  synthetic sequence
tattactcttactttatagatgatgatcctgaaaacatag

SEQ ID NO: 234 - DNA, 40 bp, Artificial Sequence
  synthetic sequence
caaggcacttgcccctagctgggggtataggggagcagtc

SEQ ID NO: 235 - DNA, 40 bp, Artificial Sequence
  synthetic sequence
gtagtagtagaatgaaaaatgctgctatgctgtgcctccc

SEQ ID NO: 236 - DNA, 40 bp, Artificial Sequence
  synthetic sequence
ctttcccatgtctgccctctactcatggtctatctctcct

SEQ ID NO: 237 - DNA, 40 bp, Artificial Sequence
  synthetic sequence
cctgggagtcatggactccacccagcaccaccaacctgac

SEQ ID NO: 238 - DNA, 40 bp, Artificial Sequence
  synthetic sequence
ccacctatctgagcctgccagcctataacccatctgggcc

SEQ ID NO: 239 - DNA, 40 bp, Artificial Sequence
  synthetic sequence
tagctggtggccagccctgaccccaccccaccctccctgg

SEQ ID NO: 240 - DNA, 40 bp, Artificial Sequence
  synthetic sequence
tctgatagacacatctggcacaccagctcgcaaagtcacc

SEQ ID NO: 241 - DNA, 40 bp, Artificial Sequence
  synthetic sequence
gggtcttgtgtttgctgagtcaaaattccttgaaatccaa

SEQ ID NO: 242 - DNA, 40 bp, Artificial Sequence
  synthetic sequence
ttagagactcctgctcccaaatttacagtcatagacttct

SEQ ID NO: 243 - DNA, 40 bp, Artificial Sequence
  synthetic sequence
ggctgtctcctttatccacagaatgattcctttgcttcat

SEQ ID NO: 244 - DNA, 40 bp, Artificial Sequence
  synthetic sequence
ccatccatctgatcctcctcatcagtgcagcacagggccc

SEQ ID NO: 245 - DNA, 40 bp, Artificial Sequence
  synthetic sequence
gcagtagctgcagagtctcacataggtctggcactgcctc

SEQ ID NO: 246 - DNA, 40 bp, Artificial Sequence
  synthetic sequence
atgtccgaccttaggcaaatgcttgactcttctgagctca

SEQ ID NO: 247 - DNA, 40 bp, Artificial Sequence
  synthetic sequence
tgtcatggcaaaataaagataataatagtgtttttttatg

SEQ ID NO: 248 - DNA, 40 bp, Artificial Sequence
  synthetic sequence
tagcgtgaggatggaaaacaatagcaaaattgattagact

SEQ ID NO: 249 - DNA, 40 bp, Artificial Sequence
  synthetic sequence
aaggtctcaacaaatagtagtagattttatcgtccattaa

SEQ ID NO: 250 - DNA, 40 bp, Artificial Sequence
  synthetic sequence
tccctctcctctcttactcatcccatcacgtatgcctctt

SEQ ID NO: 251 - DNA, 40 bp, Artificial Sequence
  synthetic sequence
ttcccttacctataataagagttattcctcttattatatt

SEQ ID NO: 252 - DNA, 40 bp, Artificial Sequence
  synthetic sequence
ttatagtgattctggatattaaagtgggaatgaggggcag

SEQ ID NO: 253 - DNA, 40 bp, Artificial Sequence
  synthetic sequence
ctaacgaagaagatgtttctcaaagaagccattctcccca

SEQ ID NO: 254 - DNA, 40 bp, Artificial Sequence
  synthetic sequence
gatcatctcagcagggttcaggaagataaaggaggatcaa

SEQ ID NO: 255 - DNA, 40 bp, Artificial Sequence
  synthetic sequence
tgttgaggtgggaggaccgcttgagcctgggaagtgcaag

SEQ ID NO: 256 - DNA, 40 bp, Artificial Sequence
  synthetic sequence
agtgagccgagattttgccactacactcccatttgggtga

SEQ ID NO: 257 - DNA, 40 bp, Artificial Sequence
  synthetic sequence
gtgagaccctttctcaaaaacaaactaattaaaaaaccct

SEQ ID NO: 258 - DNA, 40 bp, Artificial Sequence
  synthetic sequence
tttacagatgaagaaactgagtcatacaactactaagaga

SEQ ID NO: 259 - DNA, 40 bp, Artificial Sequence
  synthetic sequence
gagtcactaatcactcaggtggtctggctccagcatctgt

SEQ ID NO: 260 - DNA, 40 bp, Artificial Sequence
  synthetic sequence
ttaatctctgctctatactgcccaagacttttataaagtc

SEQ ID NO: 261 - DNA, 40 bp, Artificial Sequence
  synthetic sequence
gttgagtcactgaaatgagttattgggatggctgtgtggg

SEQ ID NO: 262 - DNA, 40 bp, Artificial Sequence
  synthetic sequence
gtgctaagttctttcctaaaggtatgtgagaatacaaagg

SEQ ID NO: 263 - DNA, 40 bp, Artificial Sequence
  synthetic sequence
aagcatcctcctttttacacacgtgaactagtgcatgcaa

SEQ ID NO: 264 - DNA, 40 bp, Artificial Sequence
  synthetic sequence
gacactcagtgggcctgggtgaaggtgagaattttattgc

SEQ ID NO: 265 - DNA, 40 bp, Artificial Sequence
  synthetic sequence
tgagagcctctggggacatcttgccagtcaatgagtctca

SEQ ID NO: 266 - DNA, 40 bp, Artificial Sequence
  synthetic sequence
caatttccttctcagtcttggagtaacagaagctcatgca

SEQ ID NO: 267 - DNA, 40 bp, Artificial Sequence
  synthetic sequence
ataaacggaaattttgtattgaaatgagagccattggaaa

SEQ ID NO: 268 - DNA, 40 bp, Artificial Sequence
  synthetic sequence
ttactccagactcctacttataaaaagagaaactgaggct

SEQ ID NO: 269 - DNA, 40 bp, Artificial Sequence
  synthetic sequence
gaagggtggggactttctcagtatgacatggaaatgatca

SEQ ID NO: 270 - DNA, 40 bp, Artificial Sequence
  synthetic sequence
tggattcaaagctcctgactttctgtctagtgtatgtgca

SEQ ID NO: 271 - DNA, 40 bp, Artificial Sequence
  synthetic sequence
gccccttttcctctaactgaaagaaggaaaaaaaaatgga

SEQ ID NO: 272 - DNA, 40 bp, Artificial Sequence
  synthetic sequence
aaaatattctacatagtttccatgtcacagccagggctgg

SEQ ID NO: 273 - DNA, 40 bp, Artificial Sequence
  synthetic sequence
tctcctgttatttcttttaaaataaatatatcatttaaat

SEQ ID NO: 274 - DNA, 40 bp, Artificial Sequence
  synthetic sequence
aaataagcaaaccctgctcgggaatgggagggagagtctc

SEQ ID NO: 275 - DNA, 40 bp, Artificial Sequence
  synthetic sequence
gtccaccccttctcggccctggctctgcagatagtgctat

SEQ ID NO: 276 - DNA, 40 bp, Artificial Sequence
  synthetic sequence
gccctgacagagccctgcccattgctgggccttggagtga

SEQ ID NO: 277 - DNA, 40 bp, Artificial Sequence
  synthetic sequence
gcctagtagagaggcagggcaagccatctcatagctgctg

SEQ ID NO: 278 - DNA, 40 bp, Artificial Sequence
  synthetic sequence
ggagagagaaaagggctcattgtctataaactcaggtcat

SEQ ID NO: 279 - DNA, 40 bp, Artificial Sequence
  synthetic sequence
attcttattctcacactaagaaaaagaatgagatgtctac

SEQ ID NO: 280 - DNA, 40 bp, Artificial Sequence
  synthetic sequence
accctgcgtcccctcttgtgtactggggtccccaagagct

SEQ ID NO: 281 - DNA, 40 bp, Artificial Sequence
  synthetic sequence
aaaagtgatggcaaagtcattgcgctagatgccatcccat

SEQ ID NO: 282 - DNA, 40 bp, Artificial Sequence
  synthetic sequence
tataaacctgcatttgtctccacacaccagtcatggacaa

SEQ ID NO: 283 - DNA, 40 bp, Artificial Sequence
  synthetic sequence
cctcctcccaggtccacgtgcttgtctttgtataatactc

SEQ ID NO: 284 - DNA, 40 bp, Artificial Sequence
  synthetic sequence
aatttcggaaaatgtattctttcaatcttgttctgttatt

SEQ ID NO: 285 - DNA, 40 bp, Artificial Sequence
  synthetic sequence
tttcaatggcttagtagaaaaagtacatacttgttttccc

SEQ ID NO: 286 - DNA, 40 bp, Artificial Sequence
  synthetic sequence
attgacaatagacaatttcacatcaatgtctatatgggtc

SEQ ID NO: 287 - DNA, 40 bp, Artificial Sequence
  synthetic sequence
tgtttgctgtgtttgcaaaaactcacaataactttatatt

SEQ ID NO: 288 - DNA, 40 bp, Artificial Sequence
  synthetic sequence
ctactctaagaaagttacaacatggtgaatacaagagaaa

SEQ ID NO: 289 - DNA, 40 bp, Artificial Sequence
  synthetic sequence
ttacaagtccagaaaataaaagttatcatcttgaggcctc

SEQ ID NO: 290 - DNA, 40 bp, Artificial Sequence
  synthetic sequence
ttctaggaataatatcaatattacaaaattaatctaacaa

SEQ ID NO: 291 - DNA, 40 bp, Artificial Sequence
  synthetic sequence
gaacagcaatgagataatgtgtacaaagtacccagaccta

SEQ ID NO: 292 - DNA, 40 bp, Artificial Sequence
  synthetic sequence
gtagagcatcaaggaagcgcattgcggagcagttttttgt

SEQ ID NO: 293 - DNA, 40 bp, Artificial Sequence
  synthetic sequence
ttgtttttgtattctgtttcgtgaggcaaggtttcactct

SEQ ID NO: 294 - DNA, 40 bp, Artificial Sequence
  synthetic sequence
tccaggctggagtgcagtggcaagatcatgtctcactgca

SEQ ID NO: 295 - DNA, 40 bp, Artificial Sequence
  synthetic sequence
tgacctcctgagctcaagggatcctcccatttcggcctcc

SEQ ID NO: 296 - DNA, 40 bp, Artificial Sequence
  synthetic sequence
tagctgggactacaggtgtacatcacatgcctggctaatt

SEQ ID NO: 297 - DNA, 40 bp, Artificial Sequence
  synthetic sequence
ttttttttttaagtagagacgaggtcttgctatgttgtcc

SEQ ID NO: 298 - DNA, 40 bp, Artificial Sequence
  synthetic sequence
taatatcaaactcttgagctcaagcagtcctcccacttct

SEQ ID NO: 299 - DNA, 40 bp, Artificial Sequence
  synthetic sequence
tggaggtatccagtatgaaatttagataatacctgccttc

SEQ ID NO: 300 - DNA, 40 bp, Artificial Sequence
  synthetic sequence
gttgaaattagaacttaatgatataatgcatcaatgaact

SEQ ID NO: 301 - DNA, 40 bp, Artificial Sequence
  synthetic sequence
atagttcctagcacaaagtaagaatcctttcaatgtgtgt

SEQ ID NO: 302 - DNA, 40 bp, Artificial Sequence
  synthetic sequence
gtgtatgtatttatctgttattaataggaatcttatgggc

SEQ ID NO: 303 - DNA, 40 bp, Artificial Sequence
  synthetic sequence
tctcacttaatccttattaataactatgaagcaggtattt

SEQ ID NO: 304 - DNA, 40 bp, Artificial Sequence
  synthetic sequence
gagttttccaagtgagttaagtatagcttgtaatacttaa

SEQ ID NO: 305 - DNA, 40 bp, Artificial Sequence
  synthetic sequence
atatccacaggttacatagctagtatataactgagaaata

SEQ ID NO: 306 - DNA, 40 bp, Artificial Sequence
  synthetic sequence
tatttatattataaaacattctaacaatacagatgtatat

SEQ ID NO: 307 - DNA, 40 bp, Artificial Sequence
  synthetic sequence
taaaaaactgaaagggctcatgcaaccctaccttctcaat

SEQ ID NO: 308 - DNA, 40 bp, Artificial Sequence
  synthetic sequence
cttcttcacttagaaaaaaccagccttagctgtctgctat

SEQ ID NO: 309 - DNA, 40 bp, Artificial Sequence
  synthetic sequence
cctttcaaaatatacttctgagaaatgagagagagaaatg

SEQ ID NO: 310 - DNA, 40 bp, Artificial Sequence
  synthetic sequence
gggtagaaggaaggaagatagggtaagagacagggaagga

SEQ ID NO: 311 - DNA, 40 bp, Artificial Sequence
  synthetic sequence
tggggaaagaaattaaattattcttttctctgtctcttga

SEQ ID NO: 312 - DNA, 40 bp, Artificial Sequence
  synthetic sequence
gctctttccattacattgaatcaaaggtaatgttgccatt

SEQ ID NO: 313 - DNA, 40 bp, Artificial Sequence
  synthetic sequence
gactcttgaaataaagaaagaccgatgtatgaaataattt

SEQ ID NO: 314 - DNA, 40 bp, Artificial Sequence
  synthetic sequence
agtctatggcattttcaaaatgcaaggtgatgtcttacta

SEQ ID NO: 315 - DNA, 40 bp, Artificial Sequence
  synthetic sequence
gcctttgctttattattagaaatggggaagtgagtataga

SEQ ID NO: 316 - DNA, 40 bp, Artificial Sequence
  synthetic sequence
ttatcaggagatatattaggaaaaagggaaactggagaaa

SEQ ID NO: 317 - DNA, 40 bp, Artificial Sequence
  synthetic sequence
gaggagtatccagatgtcctgtccctgtaaggtgggggca

SEQ ID NO: 318 - DNA, 40 bp, Artificial Sequence
  synthetic sequence
ccttcaatcaaaagggctccttaacaacttccttgcttgg

SEQ ID NO: 319 - DNA, 40 bp, Artificial Sequence
  synthetic sequence
ccaccatcttggaccattagctccacaggtatcttcttcc

SEQ ID NO: 320 - DNA, 40 bp, Artificial Sequence
  synthetic sequence
agtggtcataacagcagcttcagctacctctctaaagagt

SEQ ID NO: 321 - DNA, 40 bp, Artificial Sequence
  synthetic sequence
ccagatataggtcaggaaatataatccactaataaaaaga

SEQ ID NO: 322 - DNA, 40 bp, Artificial Sequence
  synthetic sequence
cattttgactgtagttgtttgttttttgtcattgtgacta

SEQ ID NO: 323 - DNA, 40 bp, Artificial Sequence
  synthetic sequence
taacattctcactctttcatcagtaatcactcaggttatt

SEQ ID NO: 324 - DNA, 40 bp, Artificial Sequence
  synthetic sequence
gaccaacagactgtgggaaaaatcagagaaggaggcatcc

SEQ ID NO: 325 - DNA, 40 bp, Artificial Sequence
  synthetic sequence
gcttactagcctaaactgaaattgctatagcagagtgaac

SEQ ID NO: 326 - DNA, 40 bp, Artificial Sequence
  synthetic sequence
aggtttacagatattttccacaaagagtaaaaggattgaa

SEQ ID NO: 327 - DNA, 40 bp, Artificial Sequence
  synthetic sequence
tctccagatcaatgcataggaaataataatggaccataaa

SEQ ID NO: 328 - DNA, 40 bp, Artificial Sequence
  synthetic sequence
atattatgacgaacaacattaggataagtccatatcaatt

SEQ ID NO: 329 - DNA, 40 bp, Artificial Sequence
  synthetic sequence
atccagtcataagcacagactacgtgaagcacgtccaagt

SEQ ID NO: 330 - DNA, 40 bp, Artificial Sequence
  synthetic sequence
gcaggagaaatgagaggagcaagaaagaggagccatttga

SEQ ID NO: 331 - DNA, 40 bp, Artificial Sequence
  synthetic sequence
gaatagcagaaaaaggaaaggcaagtcatattaacaaatg

SEQ ID NO: 332 - DNA, 40 bp, Artificial Sequence
  synthetic sequence
tcatgccaacagtacagataactctgctaataaaggtaga

SEQ ID NO: 333 - DNA, 40 bp, Artificial Sequence
  synthetic sequence
taatacaggtagtagcagatatctacatagtagttaaagg

SEQ ID NO: 334 - DNA, 40 bp, Artificial Sequence
  synthetic sequence
ggccatcagtacagaagattccataaaggagaacctaaag

SEQ ID NO: 335 - DNA, 40 bp, Artificial Sequence
  synthetic sequence
agaataatttgtcagaagcttaaaagctgaactctgaggc

SEQ ID NO: 336 - DNA, 40 bp, Artificial Sequence
  synthetic sequence
aactacaatatccttttgactgtggaaagggtggtgaaag

SEQ ID NO: 337 - DNA, 40 bp, Artificial Sequence
  synthetic sequence
gttcaaggacatttgagccaacatagagaggaacattggc

SEQ ID NO: 338 - DNA, 40 bp, Artificial Sequence
  synthetic sequence
tgagggatatctgtcctgatgttgtccaggatggtgatga

SEQ ID NO: 339 - DNA, 40 bp, Artificial Sequence
  synthetic sequence
catataaataacgtagagaaaacaggaggggatagagatc

SEQ ID NO: 340 - DNA, 40 bp, Artificial Sequence
  synthetic sequence
caaagaggcatcaaagatagggatgtttgtaaggatgaaa

SEQ ID NO: 341 - DNA, 40 bp, Artificial Sequence
  synthetic sequence
ctgttcttctctgagtagccaagctcagcttggttcaagc

SEQ ID NO: 342 - DNA, 40 bp, Artificial Sequence
  synthetic sequence
catactgtggatctgtagcaaattccccctgaaaacccag

SEQ ID NO: 343 - DNA, 40 bp, Artificial Sequence
  synthetic sequence
tctgaccctcacattcaagttctgaggaagggccactgcc

SEQ ID NO: 344 - DNA, 40 bp, Artificial Sequence
  synthetic sequence
gccttgagatacctggtccttattccttggactttggcaa

SEQ ID NO: 345 - DNA, 40 bp, Artificial Sequence
  synthetic sequence
atagggcttgttttagggagaaacctgttctccaaactct

SEQ ID NO: 346 - DNA, 40 bp, Artificial Sequence
  synthetic sequence
ctggtgtccatactctgaatgggaagaatgatgggattac

SEQ ID NO: 347 - DNA, 40 bp, Artificial Sequence
  synthetic sequence
agcaggagaggatcaaccccatactctgaatctaagagaa

SEQ ID NO: 348 - DNA, 40 bp, Artificial Sequence
  synthetic sequence
tcagatccctggatgcaagccaggtctggaaccataggca

SEQ ID NO: 349 - DNA, 40 bp, Artificial Sequence
  synthetic sequence
ctcctccctaccacctttagccataaggaaacatggaatg

SEQ ID NO: 350 - DNA, 40 bp, Artificial Sequence
  synthetic sequence
gacacaaacctgggcctttcaatgctataacctttcttga

SEQ ID NO: 351 - DNA, 40 bp, Artificial Sequence
  synthetic sequence
ctacctgacttctgagtcaggatttataagccttgttact

SEQ ID NO: 352 - DNA, 40 bp, Artificial Sequence
  synthetic sequence
tgaaccaacaagcatcgaagcaataatgagactgcccgca

SEQ ID NO: 353 - DNA, 40 bp, Artificial Sequence
  synthetic sequence
gaaaagcaataatccatttttcatggtatctcatatgata

SEQ ID NO: 354 - DNA, 40 bp, Artificial Sequence
  synthetic sequence
taacacttatctctctgaactttgggcttttaatatagga

SEQ ID NO: 355 - DNA, 40 bp, Artificial Sequence
  synthetic sequence
ttttctgactgtctaatctttctgatctatcctggatggc

SEQ ID NO: 356 - DNA, 40 bp, Artificial Sequence
  synthetic sequence
atcttcatcgaatttgggtgtttctttctaaaagtccttt

SEQ ID NO: 357 - DNA, 40 bp, Artificial Sequence
  synthetic sequence
gaaattacaaatgctaaagcaaacccaaacaggcaggaat

SEQ ID NO: 358 - DNA, 40 bp, Artificial Sequence
  synthetic sequence
attaggcatcttacagtttttagaatcctgcatagaactt

SEQ ID NO: 359 - DNA, 40 bp, Artificial Sequence
  synthetic sequence
tacaatatttgactcttcaggttaaacatatgtcataaat

SEQ ID NO: 360 - DNA, 40 bp, Artificial Sequence
  synthetic sequence
aacattcagtgaagtgaagggcctactttacttaacaaga

SEQ ID NO: 361 - DNA, 40 bp, Artificial Sequence
  synthetic sequence
tcttttcctatcagtggtttacaagccttgtttatatttt

SEQ ID NO: 362 - DNA, 40 bp, Artificial Sequence
  synthetic sequence
tatttttgttctgagaatatagatttagatacataatgga

SEQ ID NO: 363 - DNA, 40 bp, Artificial Sequence
  synthetic sequence
caaaatctaacacaaaatctagtagaatcatttgcttaca

SEQ ID NO: 364 - DNA, 40 bp, Artificial Sequence
  synthetic sequence
agaatttatgacttgtgatatccaagtcattcctggataa

SEQ ID NO: 365 - DNA, 40 bp, Artificial Sequence
  synthetic sequence
ttacactagaaaatagccacaggcttcctgcaaggcagcc

SEQ ID NO: 366 - DNA, 40 bp, Artificial Sequence
  synthetic sequence
agtttgaacacttgttatggtctattctctcattctttac

SEQ ID NO: 367 - DNA, 40 bp, Artificial Sequence
  synthetic sequence
acttcgtgagagatgaggcagaggtacactacgaaagcaa

SEQ ID NO: 368 - DNA, 40 bp, Artificial Sequence
  synthetic sequence
tcttgagaatgagcctcagccctggctcaaactcacctgc

SEQ ID NO: 369 - DNA, 40 bp, Artificial Sequence
  synthetic sequence
aataggatgtctgtgctccaagttgccagagagagagatt

SEQ ID NO: 370 - DNA, 40 bp, Artificial Sequence
  synthetic sequence
attaaagatccctcctgcttaattaacattcacaagtaac

SEQ ID NO: 371 - DNA, 40 bp, Artificial Sequence
  synthetic sequence
acttaaagtagcgataccctttcaccctgtcctaatcaca

SEQ ID NO: 372 - DNA, 40 bp, Artificial Sequence
  synthetic sequence
tctcaggtgttaactttatagtgaggactttcctgccata

SEQ ID NO: 373 - DNA, 40 bp, Artificial Sequence
  synthetic sequence
atagtttcatataaatgggttcctcatcatctatgggtac

SEQ ID NO: 374 - DNA, 40 bp, Artificial Sequence
  synthetic sequence
ggtatttacatttgccattccctatgccctaaatatttaa

SEQ ID NO: 375 - DNA, 40 bp, Artificial Sequence
  synthetic sequence
tattgatattccttgaaaattctaagcatcttacatcttt

SEQ ID NO: 376 - DNA, 40 bp, Artificial Sequence
  synthetic sequence
cttttattctccccttcaccgaatctcatcctacattggc

SEQ ID NO: 377 - DNA, 40 bp, Artificial Sequence
  synthetic sequence
tagtgtcccaaattttataatttaggacttctatgatctc

SEQ ID NO: 378 - DNA, 40 bp, Artificial Sequence
  synthetic sequence
atatggtcacctctttgttcaaagtcttctgatagtttcc

SEQ ID NO: 379 - DNA, 40 bp, Artificial Sequence
  synthetic sequence
acaatcttcctgcttctaccactgccccactacaatttct

SEQ ID NO: 380 - DNA, 40 bp, Artificial Sequence
  synthetic sequence
agtcactgtcaccaccacctaaattatagctgttgactca

SEQ ID NO: 381 - DNA, 40 bp, Artificial Sequence
  synthetic sequence
ctgaccccttgccttcacctccaatgctaccactctggtc

SEQ ID NO: 382 - DNA, 40 bp, Artificial Sequence
  synthetic sequence
agaaaatcctgttggtttttcgtgaaaggatgttttcaga

SEQ ID NO: 383 - DNA, 40 bp, Artificial Sequence
  synthetic sequence
acatatactcacagccagaaattagcatgcactagagtgt

SEQ ID NO: 384 - DNA, 40 bp, Artificial Sequence
  synthetic sequence
acccaaagactcactttgcctagcttcaaaatccttactc

SEQ ID NO: 385 - DNA, 40 bp, Artificial Sequence
  synthetic sequence
tgaggtagagactgtgatgaacaaacaccttgacaaaatt

SEQ ID NO: 386 - DNA, 40 bp, Artificial Sequence
  synthetic sequence
tccatatccacccacccagctttccaattttaaagccaat

SEQ ID NO: 387 - DNA, 40 bp, Artificial Sequence
  synthetic sequence
aaggtatgatgtgtagacaagctccagagatggtttctca

SEQ ID NO: 388 - DNA, 40 bp, Artificial Sequence
  synthetic sequence
ctctggtcagcatccaagaaatacttgatgtcactttggc

SEQ ID NO: 389 - DNA, 40 bp, Artificial Sequence
  synthetic sequence
aactgtgaacttccttcagctagaggggcctggctcagaa

SEQ ID NO: 390 - DNA, 40 bp, Artificial Sequence
  synthetic sequence
tgattgttctctgacttatctaccattttccctccttaaa

SEQ ID NO: 391 - DNA, 40 bp, Artificial Sequence
  synthetic sequence
aaacaaaacccatcaaattccctgaccgaacagaattctg

SEQ ID NO: 392 - DNA, 40 bp, Artificial Sequence
  synthetic sequence
cagaggtcacagcctaaacatcaaattccttgaggtgcgg

SEQ ID NO: 393 - DNA, 40 bp, Artificial Sequence
  synthetic sequence
gaaggcaggtgtggctctgcagtgtgattgggtacttgca

SEQ ID NO: 394 - DNA, 40 bp, Artificial Sequence
  synthetic sequence
catggaggaaaaactcatcagggatggaggcacgcctcta

SEQ ID NO: 395 - DNA, 40 bp, Artificial Sequence
  synthetic sequence
agcttgttaaattgaattctatccttcttattcaattcta

SEQ ID NO: 396 - DNA, 40 bp, Artificial Sequence
  synthetic sequence
catagttgtcagcacaatgcctaggctataggaagtactc

SEQ ID NO: 397 - DNA, 40 bp, Artificial Sequence
  synthetic sequence
gcagatatagcttgatggccccatgcttggtttaacatcc

SEQ ID NO: 398 - DNA, 40 bp, Artificial Sequence
  synthetic sequence
ctaaataactagaatactctttattttttcgtatcatgaa

SEQ ID NO: 399 - DNA, 40 bp, Artificial Sequence
  synthetic sequence
agtgtttaaagggtgatatcagactaaacttgaaatatgt

SEQ ID NO: 400 - DNA, 40 bp, Artificial Sequence
  synthetic sequence
ggatgggtctagaaagactagcattgttttaggttgagtg

SEQ ID NO: 401 - DNA, 40 bp, Artificial Sequence
  synthetic sequence
tgctgccaacattaacagtcaagaaatacctccgaataac

SEQ ID NO: 402 - DNA, 40 bp, Artificial Sequence
  synthetic sequence
tattgtgagaggtctgaatagtgttgtaaaataagctgaa

SEQ ID NO: 403 - DNA, 40 bp, Artificial Sequence
  synthetic sequence
ttacaacatgatggcttgttgtctaaatatctcctaggga

SEQ ID NO: 404 - DNA, 40 bp, Artificial Sequence
  synthetic sequence
ctaagtagaagggtactttcacaggaacagagagcaaaag

SEQ ID NO: 405 - DNA, 40 bp, Artificial Sequence
  synthetic sequence
gtcttgtattgcccagtgacatgcacactggtcaaaagta

SEQ ID NO: 406 - DNA, 40 bp, Artificial Sequence
  synthetic sequence
ccctatgtcttccctgatgggctagagttcctctttctca

SEQ ID NO: 407 - DNA, 40 bp, Artificial Sequence
  synthetic sequence
aaagtttccccaaattttaccaatgcaagccatttctcca

SEQ ID NO: 408 - DNA, 40 bp, Artificial Sequence
  synthetic sequence
aactgcagattctctgcatctccctttgccgggtctgaca

SEQ ID NO: 409 - DNA, 40 bp, Artificial Sequence
  synthetic sequence
tagtgctgtggtgctgtgataggtacacaagaaatgagaa

SEQ ID NO: 410 - DNA, 40 bp, Artificial Sequence
  synthetic sequence
taactagcgtcaagaactgagggccctaaactatgctagg

SEQ ID NO: 411 - DNA, 40 bp, Artificial Sequence
  synthetic sequence
cattggctccgtcttcatcctgcagtgacctcagtgcctc

SEQ ID NO: 412 - DNA, 40 bp, Artificial Sequence
  synthetic sequence
tgtttatgtgttatagtgttcatttactcttctggtctaa

SEQ ID NO: 413 - DNA, 40 bp, Artificial Sequence
  synthetic sequence
cctttgaccccttggtcaagctgcaactttggttaaaggg

SEQ ID NO: 414 - DNA, 40 bp, Artificial Sequence
  synthetic sequence
ttctcttgggttacagagattgtcatatgacaaattataa

SEQ ID NO: 415 - DNA, 40 bp, Artificial Sequence
  synthetic sequence
tggaagttgtggtccaagccacagttgcagaccatacttc

SEQ ID NO: 416 - DNA, 40 bp, Artificial Sequence
  synthetic sequence
ctgccctgtggcccttgcttcttacttttacttcttgtcg

SEQ ID NO: 417 - DNA, 40 bp, Artificial Sequence
  synthetic sequence
aactcagatattgtggatgcgagaaattagaagtagatat

SEQ ID NO: 418 - DNA, 40 bp, Artificial Sequence
  synthetic sequence
tacagaaccaccaagtagtaaggctaggatgtagacccag

SEQ ID NO: 419 - DNA, 40 bp, Artificial Sequence
  synthetic sequence
tgagctctcctactgtctacattacatgagctcttattaa

SEQ ID NO: 420 - DNA, 40 bp, Artificial Sequence
  synthetic sequence
aagctaataagtagacaattagtaattagaagtcagatgg

SEQ ID NO: 421 - DNA, 40 bp, Artificial Sequence
  synthetic sequence
agcccaatgtacttgtagtgtagatcaacttattgaaagc

SEQ ID NO: 422 - DNA, 40 bp, Artificial Sequence
  synthetic sequence
ccaatactcagaagtagattattacctcatttattgatga

SEQ ID NO: 423 - DNA, 40 bp, Artificial Sequence
  synthetic sequence
gctagaatcaaatttaagtttatcatatgaggccgggcac

SEQ ID NO: 424 - DNA, 40 bp, Artificial Sequence
  synthetic sequence
taatactaatgataagtaacacctcttgagtacttagtat

SEQ ID NO: 425 - DNA, 40 bp, Artificial Sequence
  synthetic sequence
atggtaattctgtgagatatgtattattgaacatactata

SEQ ID NO: 426 - DNA, 40 bp, Artificial Sequence
  synthetic sequence
tgaaagagaagtgggaattaatacttactgaaatctttct

SEQ ID NO: 427 - DNA, 40 bp, Artificial Sequence
  synthetic sequence
gagagacacgaggaaatagtgtagatttaggctggaggta

SEQ ID NO: 428 - DNA, 40 bp, Artificial Sequence
  synthetic sequence
gttgagagggaaacaagatggtgaagggactagaaaccac

SEQ ID NO: 429 - DNA, 40 bp, Artificial Sequence
  synthetic sequence
caaggttctgaacatgagaaatttttaggaatctgcacag

SEQ ID NO: 430 - DNA, 40 bp, Artificial Sequence
  synthetic sequence
tgccatctaaaaaaatctgacttcactggaaacatggaag

SEQ ID NO: 431 - DNA, 40 bp, Artificial Sequence
  synthetic sequence
gggatcctctcttaagtgtttcctgctggaatctcctcac

SEQ ID NO: 432 - DNA, 40 bp, Artificial Sequence
  synthetic sequence
gtttccttcatgtgacagggagcctcctgccccgaacttc

SEQ ID NO: 433 - DNA, 40 bp, Artificial Sequence
  synthetic sequence
ttggataagagtagggaagaacctagagcctacgctgagc

SEQ ID NO: 434 - DNA, 40 bp, Artificial Sequence
  synthetic sequence
atctggggctttgtgaagactggcttaaaatcagaagccc

SEQ ID NO: 435 - DNA, 40 bp, Artificial Sequence
  synthetic sequence
accgcaatgcttcctgcccattcagggctccagcatgtag

SEQ ID NO: 436 - DNA, 40 bp, Artificial Sequence
  synthetic sequence
tatggggaagcagggtatgaaagagctctgaatgaaatgg

SEQ ID NO: 437 - DNA, 40 bp, Artificial Sequence
  synthetic sequence
ggttgcatgaatcagattatcaacagaaatgttgagacaa

SEQ ID NO: 438 - DNA, 40 bp, Artificial Sequence
  synthetic sequence
aatgcaggcctaggcatgactgaaggctctctcataattc

SEQ ID NO: 439 - DNA, 40 bp, Artificial Sequence
  synthetic sequence
taacgttttcttgtctgctaccccatcatatgcacaacaa

SEQ ID NO: 440 - DNA, 40 bp, Artificial Sequence
  synthetic sequence
ttaattcccaaactcatatagctctgagaaagtctatgct

SEQ ID NO: 441 - DNA, 40 bp, Artificial Sequence
  synthetic sequence
ccctataggggatttctaccctgagcaaaaggctggtctt

SEQ ID NO: 442 - DNA, 40 bp, Artificial Sequence
  synthetic sequence
tcctcaccatatagaaagcttttaacccatcattgaataa

SEQ ID NO: 443 - DNA, 40 bp, Artificial Sequence
  synthetic sequence
taagctgtctagcaaaagcaagggcttggaaaatctgtga

SEQ ID NO: 444 - DNA, 40 bp, Artificial Sequence
  synthetic sequence
aggattagaagattcttctgtgtgtaagaatttcataaac

SEQ ID NO: 445 - DNA, 40 bp, Artificial Sequence
  synthetic sequence
attatcttctggaatagggaatcaagttatattatgtaac

SEQ ID NO: 446 - DNA, 40 bp, Artificial Sequence
  synthetic sequence
ctctctggttgactgttagagttctggcacttgtcactat

SEQ ID NO: 447 - DNA, 40 bp, Artificial Sequence
  synthetic sequence
tcttcagttagatggttaactttgtgaagttgaaaactgt

SEQ ID NO: 448 - DNA, 40 bp, Artificial Sequence
  synthetic sequence
ctacaccatgtggagaaggggtggtggttttgattgctgc

SEQ ID NO: 449 - DNA, 40 bp, Artificial Sequence
  synthetic sequence
actttcctaacctgagcctaacatccctgacatcaggaaa

SEQ ID NO: 450 - DNA, 40 bp, Artificial Sequence
  synthetic sequence
tacactttattcgtctgtgtcctgctctgggatgatagtc

SEQ ID NO: 451 - DNA, 40 bp, Artificial Sequence
  synthetic sequence
tactctttgcattccactgtttttcctaagtgactaaaaa

SEQ ID NO: 452 - DNA, 40 bp, Artificial Sequence
  synthetic sequence
aaaggcctcccaggccaagttatccattcagaaagcattt

SEQ ID NO: 453 - DNA, 40 bp, Artificial Sequence
  synthetic sequence
tattgacatgtacttcttggcagtctgtatgctggatgct

SEQ ID NO: 454 - DNA, 40 bp, Artificial Sequence
  synthetic sequence
tttggtcctaattatgtctttgctcactatccaataaata

SEQ ID NO: 455 - DNA, 40 bp, Artificial Sequence
  synthetic sequence
gttaaaaaaactacctctcaacttgctcaagcatacactc

SEQ ID NO: 456 - DNA, 40 bp, Artificial Sequence
  synthetic sequence
taattagtgctttgcataattaatcatatttaatactctt

SEQ ID NO: 457 - DNA, 40 bp, Artificial Sequence
  synthetic sequence
actagtgttctgtactttatgcccattcatctttaactgt

SEQ ID NO: 458 - DNA, 40 bp, Artificial Sequence
  synthetic sequence
gtattttttgtttaactgcaatcattcttgctgcaggtga

SEQ ID NO: 459 - DNA, 40 bp, Artificial Sequence
  synthetic sequence
gcagtgacttataaatgctaactactctagaaatgtttgc

SEQ ID NO: 460 - DNA, 40 bp, Artificial Sequence
  synthetic sequence
ttataagcatgattacaggagttttaacaggctcataaga

SEQ ID NO: 461 - DNA, 40 bp, Artificial Sequence
  synthetic sequence
agtatccctcaagtagtgtcaggaattagtcatttaaata

SEQ ID NO: 462 - DNA, 40 bp, Artificial Sequence
  synthetic sequence
agtcacccatttggtatattaaagatgtgttgtctactgt

SEQ ID NO: 463 - DNA, 40 bp, Artificial Sequence
  synthetic sequence
tggtcataaaacattgaattctaatctccctctcaaccct

SEQ ID NO: 464 - DNA, 40 bp, Artificial Sequence
  synthetic sequence
acagttgaaaagacctaagcttgtgcctgatttaagcctt

SEQ ID NO: 465 - DNA, 40 bp, Artificial Sequence
  synthetic sequence
caactacagggccttgaactgcacactttcagtccggtcc

SEQ ID NO: 466 - DNA, 40 bp, Artificial Sequence
  synthetic sequence
gtggttctttgaagagacttccacctgggaacagttaaac

SEQ ID NO: 467 - DNA, 40 bp, Artificial Sequence
  synthetic sequence
tggaggaaatatttatccccaggtagttccctttttgcac

SEQ ID NO: 468 - DNA, 40 bp, Artificial Sequence
  synthetic sequence
gcctggtgcttttggtaggggagcttgcactttccccctt

SEQ ID NO: 469 - DNA, 40 bp, Artificial Sequence
  synthetic sequence
tctcatttctttgagaacttcagggaaaatagacaaggac

SEQ ID NO: 470 - DNA, 40 bp, Artificial Sequence
  synthetic sequence
caaacttttcaagccttctctaatcttaaaggtaaacaag

SEQ ID NO: 471 - DNA, 40 bp, Artificial Sequence
  synthetic sequence
tcaacaaaggagaaaagtttgttggcctccaaaggcacag

SEQ ID NO: 472 - DNA, 40 bp, Artificial Sequence
  synthetic sequence
gatgcaacagaccttggaagcatacaggagagctgaactt

SEQ ID NO: 473 - DNA, 40 bp, Artificial Sequence
  synthetic sequence
catctgagatcccagcttctaagaccttcaattctcactc

SEQ ID NO: 474 - DNA, 40 bp, Artificial Sequence
  synthetic sequence
tatcttaacagtgagtgaacaggaaatctcctcttttccc

SEQ ID NO: 475 - DNA, 40 bp, Artificial Sequence
  synthetic sequence
aactcatgctttgtagatgactagatcaaaaaatttcagc

SEQ ID NO: 476 - DNA, 40 bp, Artificial Sequence
  synthetic sequence
tcaaaggaagtcaaaagatgtgaaaaacaatttctgaccc

SEQ ID NO: 477 - DNA, 40 bp, Artificial Sequence
  synthetic sequence
tgccttcacttaagtaatcaattcctaggttatattctga

SEQ ID NO: 478 - DNA, 40 bp, Artificial Sequence
  synthetic sequence
ccctaccttgttcaaaatgttcctgtccagaccaaagtac

SEQ ID NO: 479 - DNA, 40 bp, Artificial Sequence
  synthetic sequence
gcacttacaaattatactacgctctatactttttgtttaa

SEQ ID NO: 480 - DNA, 40 bp, Artificial Sequence
  synthetic sequence
ctttagtttcatttcaaacaatccatacacacacagccct

SEQ ID NO: 481 - DNA, 40 bp, Artificial Sequence
  synthetic sequence
tagggaccacagggttaagggggcagtagaattatactcc

SEQ ID NO: 482 - DNA, 40 bp, Artificial Sequence
  synthetic sequence
ctcacaattaagctaagcagctaagagtcttgcagggtag

SEQ ID NO: 483 - DNA, 40 bp, Artificial Sequence
  synthetic sequence
gttgaaagacagagaggatggggtgctatgccccaaatca

SEQ ID NO: 484 - DNA, 40 bp, Artificial Sequence
  synthetic sequence
gcttgtctaattttatatatcaccctactgaacatgaccc

SEQ ID NO: 485 - DNA, 40 bp, Artificial Sequence
  synthetic sequence
aatattgtacacgtacaccaaagcatcatgttgtacccca

SEQ ID NO: 486 - DNA, 40 bp, Artificial Sequence
  synthetic sequence
tgtgaagtggtggatttgttaattagccttatttaaccat

SEQ ID NO: 487 - DNA, 40 bp, Artificial Sequence
  synthetic sequence
tgacacatatgacattttaactatgttccagatttttgaa

SEQ ID NO: 488 - DNA, 40 bp, Artificial Sequence
  synthetic sequence
gcaaggaatcattcaatgttttctaaatctattactgcat

SEQ ID NO: 489 - DNA, 40 bp, Artificial Sequence
  synthetic sequence
cattttcataggttttcctcgattgatcattattcatgat

SEQ ID NO: 490 - DNA, 40 bp, Artificial Sequence
  synthetic sequence
aaagtgatcaagatatttttagttcaggctccaaaatttt

SEQ ID NO: 491 - DNA, 40 bp, Artificial Sequence
  synthetic sequence
ctttacaggccgagaaaaatgaatctgaattcctgacctc

SEQ ID NO: 492 - DNA, 40 bp, Artificial Sequence
  synthetic sequence
tccactcaaggcctacattctgctataatgcaatttcaag

SEQ ID NO: 493 - DNA, 40 bp, Artificial Sequence
  synthetic sequence
aactgcttaaaattaatggcacaagtcatgtttttgatgt

SEQ ID NO: 494 - DNA, 40 bp, Artificial Sequence
  synthetic sequence
ctgactgtgacgtagcaataaagaaacccacgtttcatat

SEQ ID NO: 495 - DNA, 40 bp, Artificial Sequence
  synthetic sequence
ctggcccactgcttggaggagagcactcaggaccatgaac

SEQ ID NO: 496 - DNA, 40 bp, Artificial Sequence
  synthetic sequence
ttctgaaatgataaagtcaatcacaggaaggcacctggac

SEQ ID NO: 497 - DNA, 40 bp, Artificial Sequence
  synthetic sequence
atcattctctttcccttcctctatgtggcagaaagtaaaa

SEQ ID NO: 498 - DNA, 40 bp, Artificial Sequence
  synthetic sequence
ggagataataatgtgttactccctaaggcagagtgccctt

SEQ ID NO: 499 - DNA, 40 bp, Artificial Sequence
  synthetic sequence
caattaacttggccatgtgactggttgtgactaaaataat

SEQ ID NO: 500 - DNA, 40 bp, Artificial Sequence
  synthetic sequence
cactaaatcaatatacttctcaacaatttccaacagccct

SEQ ID NO: 501 - DNA, 40 bp, Artificial Sequence
  synthetic sequence
ctaggctcctgagtttgctggggatgcgaagaacccttat

SEQ ID NO: 502 - DNA, 40 bp, Artificial Sequence
  synthetic sequence
ccgaggaccccgcactcggagccgccagccggccccaccg

SEQ ID NO: 503 - DNA, 40 bp, Artificial Sequence
  synthetic sequence
ttggaagcacagggtgtgggataatgctaattactagtga

SEQ ID NO: 504 - DNA, 40 bp, Artificial Sequence
  synthetic sequence
gttcagtatgcctttgattttacaataatattcctgttat

SEQ ID NO: 505 - DNA, 40 bp, Artificial Sequence
  synthetic sequence
agattccatgaagtattacagcatttggtagtctttttgc

SEQ ID NO: 506 - DNA, 40 bp, Artificial Sequence
  synthetic sequence
tatttgctctgaaataagacataatttggggtgagaaagc

SEQ ID NO: 507 - DNA, 40 bp, Artificial Sequence
  synthetic sequence
actcatgatatttggctctagaatacatgctctgaatcat

SEQ ID NO: 508 - DNA, 40 bp, Artificial Sequence
  synthetic sequence
tccaagatgaagtggctactaactgacagagggcataatt

SEQ ID NO: 509 - DNA, 40 bp, Artificial Sequence
  synthetic sequence
tattcacagtaactctgtgcctcaagtactattgtaatac

SEQ ID NO: 510 - DNA, 40 bp, Artificial Sequence
  synthetic sequence
acatcctcaatctacacactaggatagtataaaagtaata

SEQ ID NO: 511 - DNA, 40 bp, Artificial Sequence
  synthetic sequence
gtctacccatatgtgaccttcatgtctttgctctaagccc

SEQ ID NO: 512 - DNA, 40 bp, Artificial Sequence
  synthetic sequence
cgtgtaatccttgacaatgtcatctcatctatttattccc

SEQ ID NO: 513 - DNA, 40 bp, Artificial Sequence
  synthetic sequence
tctgaaagagactaaccttccctcgctttgcagagaaaga

SEQ ID NO: 514 - DNA, 40 bp, Artificial Sequence
  synthetic sequence
atgcatggattctcttgaaaaaatgtttctgccatgatgt

SEQ ID NO: 515 - DNA, 40 bp, Artificial Sequence
  synthetic sequence
tagttgaagacctactgtgttcagggccgtgagccagggc

SEQ ID NO: 516 - DNA, 40 bp, Artificial Sequence
  synthetic sequence
caacgtggagagctgtcctggcaccatttcttcctgctgt

SEQ ID NO: 517 - DNA, 40 bp, Artificial Sequence
  synthetic sequence
atcctcaaaggagcctggcttgggctaacaaggaagaact

SEQ ID NO: 518 - DNA, 40 bp, Artificial Sequence
  synthetic sequence
tgcctgggaccctgccccaagcaaagtaataatctgaatg

SEQ ID NO: 519 - DNA, 40 bp, Artificial Sequence
  synthetic sequence
ctggtgtgtccagtgtgatccctgcacccatgcccggagc

SEQ ID NO: 520 - DNA, 40 bp, Artificial Sequence
  synthetic sequence
ctgccccctgcagcagggaaggggctctggaagggtctga

SEQ ID NO: 521 - DNA, 40 bp, Artificial Sequence
  synthetic sequence
tagctgctgccccactatgcaccatcgcttatctgttctt

SEQ ID NO: 522 - DNA, 40 bp, Artificial Sequence
  synthetic sequence
gaaacccgaaaaatgtcctggtcctcttcttaagtctggg

SEQ ID NO: 523 - DNA, 40 bp, Artificial Sequence
  synthetic sequence
gctgagaacatgactctgcttggcgttccatttaattgac

SEQ ID NO: 524 - DNA, 40 bp, Artificial Sequence
  synthetic sequence
gagagggtgtgcatttgaagtatagatttgttaaacatag

SEQ ID NO: 525 - DNA, 40 bp, Artificial Sequence
  synthetic sequence
catcaggcaaaaatacttcgatgggactgtgttctttcag

SEQ ID NO: 526 - DNA, 40 bp, Artificial Sequence
  synthetic sequence
tctaaagtgatgtaatgttgccacggaaattctaatccct

SEQ ID NO: 527 - DNA, 40 bp, Artificial Sequence
  synthetic sequence
cgtgcagaaccagctctgtcttcccagacactgtcgcttt

SEQ ID NO: 528 - DNA, 40 bp, Artificial Sequence
  synthetic sequence
acccctgagcacctcagtgtccgtgactgtggagcggagg

SEQ ID NO: 529 - DNA, 40 bp, Artificial Sequence
  synthetic sequence
ctgcctgggacacgtacggctgcccagtgatcctgagcgc

SEQ ID NO: 530 - DNA, 40 bp, Artificial Sequence
  synthetic sequence
cacagccggatggtgtgggagctggcactgccggggctcc

SEQ ID NO: 531 - DNA, 40 bp, Artificial Sequence
  synthetic sequence
cgtcttggcagaggctccctgtcatcaaggacctgaggtt

SEQ ID NO: 532 - DNA, 40 bp, Artificial Sequence
  synthetic sequence
gaccccacaaagatgagcgggtccccttcccaattttcgg

SEQ ID NO: 533 - DNA, 40 bp, Artificial Sequence
  synthetic sequence
tcaggaagccggtgctcagcaaacttatctgaagctcttg

SEQ ID NO: 534 - DNA, 40 bp, Artificial Sequence
  synthetic sequence
gaggctgcagaggaacatcgtttggtcaaatgtgaaatgt

SEQ ID NO: 535 - DNA, 40 bp, Artificial Sequence
  synthetic sequence
ctagcttctagaaagtgctgccaatttggggaccaaggga

SEQ ID NO: 536 - DNA, 40 bp, Artificial Sequence
  synthetic sequence
ggaaacacttctttttcccttgacaaaggacatcctctgc

SEQ ID NO: 537 - DNA, 40 bp, Artificial Sequence
  synthetic sequence
gcatgtgcataaacactcgtgtgtgtgtccttttatccca

SEQ ID NO: 538 - DNA, 40 bp, Artificial Sequence
  synthetic sequence
ccaaatctctatacatgtccatagagagaggcagacgtat

SEQ ID NO: 539 - DNA, 40 bp, Artificial Sequence
  synthetic sequence
gggttgaagacaaggggctcagagcttgctttttatacac

SEQ ID NO: 540 - DNA, 40 bp, Artificial Sequence
  synthetic sequence
agattcatcttcatggcaggacttcaggcaagagaggccc

SEQ ID NO: 541 - DNA, 40 bp, Artificial Sequence
  synthetic sequence
ctcaccccttagcaggaccctgacggaactgggtacaggc

SEQ ID NO: 542 - DNA, 40 bp, Artificial Sequence
  synthetic sequence
ggttgggagacaatgggtggcccctcggtgtggtgtcctc

SEQ ID NO: 543 - DNA, 40 bp, Artificial Sequence
  synthetic sequence
agagtctagagggcccgtggggacgggagtcctgggaacc

SEQ ID NO: 544 - DNA, 40 bp, Artificial Sequence
  synthetic sequence
gcggcatgtccggcttcaccctgcccagaatcacagcctc

SEQ ID NO: 545 - DNA, 40 bp, Artificial Sequence
  synthetic sequence
atggttaaaaaattctcctacttaagactcccagacccct

SEQ ID NO: 546 - DNA, 40 bp, Artificial Sequence
  synthetic sequence
tgagattccagggctggttccacaacggccggcatcggcc

SEQ ID NO: 547 - DNA, 40 bp, Artificial Sequence
  synthetic sequence
ctgagtcactaacaaagctcaggcctgaccacaggacatt

SEQ ID NO: 548 - DNA, 40 bp, Artificial Sequence
  synthetic sequence
ggctggcctacctgccacggggccagggctgggtgctttc

SEQ ID NO: 549 - DNA, 40 bp, Artificial Sequence
  synthetic sequence
gggctctggacgctggaggcctgaggctgcaccccaggtt

SEQ ID NO: 550 - DNA, 40 bp, Artificial Sequence
  synthetic sequence
acagtggccactcacccactgggcccacatccccacaggc

SEQ ID NO: 551 - DNA, 40 bp, Artificial Sequence
  synthetic sequence
actctgccagcctttgatgcctcgctgagacagagggtct

SEQ ID NO: 552 - DNA, 40 bp, Artificial Sequence
  synthetic sequence
agccggggctctggccccatccaggggctcccccagcagc

SEQ ID NO: 553 - DNA, 40 bp, Artificial Sequence
  synthetic sequence
ccttggaagtcagtcagcaggtcaggacacagttcagccc

SEQ ID NO: 554 - DNA, 40 bp, Artificial Sequence
  synthetic sequence
ttacatgcagttggtcttctcctgtgaatggggaaactga

SEQ ID NO: 555 - DNA, 40 bp, Artificial Sequence
  synthetic sequence
ctgcatcacagaacagctgcatttctaatgtcaggcttct

SEQ ID NO: 556 - DNA, 40 bp, Artificial Sequence
  synthetic sequence
cagcctgggaggcttgtcaacctcctttgacaagcacgcc

SEQ ID NO: 557 - DNA, 40 bp, Artificial Sequence
  synthetic sequence
agaaactggggctccagggcatggaggctgcctgtggcca

SEQ ID NO: 558 - DNA, 40 bp, Artificial Sequence
  synthetic sequence
tcccggcctggaggaagtcttattagcctcatttcatgga

SEQ ID NO: 559 - DNA, 40 bp, Artificial Sequence
  synthetic sequence
tcctgccagccccctcacgctcacgaattcagtcccaggg

SEQ ID NO: 560 - DNA, 40 bp, Artificial Sequence
  synthetic sequence
aattctaaaggtgaagggacgtctacacccccaacaaaac

SEQ ID NO: 561 - DNA, 40 bp, Artificial Sequence
  synthetic sequence
ggaaatattagtcccctctgcctgggacaagaccaccgaa

SEQ ID NO: 562 - DNA, 40 bp, Artificial Sequence
  synthetic sequence
aaacacacctctgaatggaaagctgagaaacagtgatctc

SEQ ID NO: 563 - DNA, 40 bp, Artificial Sequence
  synthetic sequence
actgcaccccctcccttcccgtgccggcaatttaaccggg

SEQ ID NO: 564 - DNA, 40 bp, Artificial Sequence
  synthetic sequence
tgccttcctaccttgaccagtcggtccttgcgggggtccc

SEQ ID NO: 565 - DNA, 40 bp, Artificial Sequence
  synthetic sequence
atttccttcatcttgtccttctagcctggagactcttcgg

SEQ ID NO: 566 - DNA, 40 bp, Artificial Sequence
  synthetic sequence
aatgcccgaaaattccagcagcagcccaagatggtggcca

SEQ ID NO: 567 - DNA, 40 bp, Artificial Sequence
  synthetic sequence
cgttgcaaatgcccaagggggtaaccctaaaagttaaagg

SEQ ID NO: 568 - DNA, 40 bp, Artificial Sequence
  synthetic sequence
acacaacccctgtgcaagtttcattccggcgcacaggggc

SEQ ID NO: 569 - DNA, 40 bp, Artificial Sequence
  synthetic sequence
tgcaagaactaatttagcatgcaaggacggggaggaccgg

SEQ ID NO: 570 - DNA, 40 bp, Artificial Sequence
  synthetic sequence
gccacgagggcacccacgggcggacagacggccaaagaat

SEQ ID NO: 571 - DNA, 40 bp, Artificial Sequence
  synthetic sequence
accccatatccaagccggcagaatgggcgcatttccaaga

SEQ ID NO: 572 - DNA, 40 bp, Artificial Sequence
  synthetic sequence
gcctggggagaccacgagaaggggtgactggggcgcggcg

SEQ ID NO: 573 - DNA, 40 bp, Artificial Sequence
  synthetic sequence
ctgcagtaggggacaactaggaaggccggcaggccacacg

SEQ ID NO: 574 - DNA, 40 bp, Artificial Sequence
  synthetic sequence
gagtgggtcccccgggatttagggggtgaggtggaggtgg

SEQ ID NO: 575 - DNA, 40 bp, Artificial Sequence
  synthetic sequence
tccccgccagggaagaggggtgcagggggccccgtccgcc

SEQ ID NO: 576 - DNA, 40 bp, Artificial Sequence
  synthetic sequence
tgaggcgccgcgcctgccctgcggcggagttgcccctgta

SEQ ID NO: 577 - DNA, 40 bp, Artificial Sequence
  synthetic sequence
aaacgccgggagcagcgaggggcagagcccaaaagccatc

SEQ ID NO: 578 - DNA, 40 bp, Artificial Sequence
  synthetic sequence
ttgttaagcaaagatcaaagcccggcagagaatgggagcg

SEQ ID NO: 579 - DNA, 40 bp, Artificial Sequence
  synthetic sequence
caacttcaacaaaactcccctgtagtccgtgtgacgttac

SEQ ID NO: 580 - DNA, 40 bp, Artificial Sequence
  synthetic sequence
ctgctactgcgccgacagccctctggaggctccaggactt

SEQ ID NO: 581 - DNA, 40 bp, Artificial Sequence
  synthetic sequence
gctcttctgcccctcgccggagcgtgcggactctgctgct

SEQ ID NO: 582 - DNA, 40 bp, Artificial Sequence
  synthetic sequence
tccgcgctcggctctcgcttctgctgccccgcgctccctc

SEQ ID NO: 583 - DNA, 40 bp, Artificial Sequence
  synthetic sequence
tttccacttcgcagcacaggagctggtgttccatggctgg

SEQ ID NO: 584 - DNA, 40 bp, Artificial Sequence
  synthetic sequence
ggtcgttgaggaggttggcatcggggtacgcgcggcggat

SEQ ID NO: 585 - DNA, 40 bp, Artificial Sequence
  synthetic sequence
tgtcctacttcaaatgtgtgcagaaggaggtcctgccgtc

SEQ ID NO: 586 - DNA, 40 bp, Artificial Sequence
  synthetic sequence
tcgggcggctctcttaagacttccctgcaacttgttgccc

SEQ ID NO: 587 - DNA, 40 bp, Artificial Sequence
  synthetic sequence
acccacgtttctttgctactcacccccctcccttctctcc

SEQ ID NO: 588 - DNA, 40 bp, Artificial Sequence
  synthetic sequence
ctagaactttgaagtttgccgtggtgtttctagggatccg

SEQ ID NO: 589 - DNA, 40 bp, Artificial Sequence
  synthetic sequence
agaagggggtccgggaggggtgccttcgggagaagccagt

SEQ ID NO: 590 - DNA, 40 bp, Artificial Sequence
  synthetic sequence
caggggcaccccaatgggcccgagggtgcgggctggcagg

SEQ ID NO: 591 - DNA, 40 bp, Artificial Sequence
  synthetic sequence
gggtgcgctttgtgtcccccgcctgcgccccagcccggct

SEQ ID NO: 592 - DNA, 40 bp, Artificial Sequence
  synthetic sequence
gcctcagcggccgggagccgccaactccggggggaggggg

SEQ ID NO: 593 - DNA, 40 bp, Artificial Sequence
  synthetic sequence
aaagtgcagtaatacccttgatcagagttgatgacttgaa

SEQ ID NO: 594 - DNA, 40 bp, Artificial Sequence
  synthetic sequence
gagagaaataaagtagttgctctatttgtaaattgaaaag

SEQ ID NO: 595 - DNA, 40 bp, Artificial Sequence
  synthetic sequence
ggtagcagtgattgctgtatatttgtgaaaaggaggcaag

SEQ ID NO: 596 - DNA, 40 bp, Artificial Sequence
  synthetic sequence
tgctgataatggaagtgcagtgggttagctttgtttccat

SEQ ID NO: 597 - DNA, 40 bp, Artificial Sequence
  synthetic sequence
ccgttctaccgtgactagtatggaattgtgggaaccagaa

SEQ ID NO: 598 - DNA, 40 bp, Artificial Sequence
  synthetic sequence
ttaacatcagtgtcaactgcagtgttgtttctgagtaata

SEQ ID NO: 599 - DNA, 40 bp, Artificial Sequence
  synthetic sequence
cataactccatgctctcaaaccaatcactccttcattcat

SEQ ID NO: 600 - DNA, 40 bp, Artificial Sequence
  synthetic sequence
ttctcctatgctgcaccagaaagggttttgtgggttatca

SEQ ID NO: 601 - DNA, 40 bp, Artificial Sequence
  synthetic sequence
atcgttcagcatctttaggaaatatccagagactgcattg

SEQ ID NO: 602 - DNA, 40 bp, Artificial Sequence
  synthetic sequence
tttattaagagcaaaaaaagcctgtttcgttagccagtca

SEQ ID NO: 603 - DNA, 40 bp, Artificial Sequence
  synthetic sequence
ttgttcatatgcctaacttaataaattcttcatacagaaa

SEQ ID NO: 604 - DNA, 40 bp, Artificial Sequence
  synthetic sequence
ataacttttaaacccaaacacctagagatttcattatgta

SEQ ID NO: 605 - DNA, 40 bp, Artificial Sequence
  synthetic sequence
ttcttaccattaagtcttccaaatgataatttattataaa

SEQ ID NO: 606 - DNA, 40 bp, Artificial Sequence
  synthetic sequence
tatgtaaggacaacttcattatatgcttgaagaaattgtt

SEQ ID NO: 607 - DNA, 40 bp, Artificial Sequence
  synthetic sequence
aatcttaaaagtgacactagtcacattccacacggttaaa

SEQ ID NO: 608 - DNA, 40 bp, Artificial Sequence
  synthetic sequence
attttgaaaactattcctttatctggaatgaatgtaaacc

SEQ ID NO: 609 - DNA, 40 bp, Artificial Sequence
  synthetic sequence
ttgcattaagggcaccagaaacttatagaaaaccaaaaag

SEQ ID NO: 610 - DNA, 40 bp, Artificial Sequence
  synthetic sequence
taaaagacagtgaactgaacagtaattaacattacatcca

SEQ ID NO: 611 - DNA, 40 bp, Artificial Sequence
  synthetic sequence
caaaaaactgtgtttatcatataccaaacattttcaagtt

SEQ ID NO: 612 - DNA, 40 bp, Artificial Sequence
  synthetic sequence
tctcaggatattttgttctctgacacaaatacaccagtca

SEQ ID NO: 613 - DNA, 40 bp, Artificial Sequence
  synthetic sequence
tagctttacatctcagaatgaatcaatgtgggggcagaaa

SEQ ID NO: 614 - DNA, 40 bp, Artificial Sequence
  synthetic sequence
agacctatatacctatagtgcctaatagacaataagccac

SEQ ID NO: 615 - DNA, 40 bp, Artificial Sequence
  synthetic sequence
tctctcccctgcctagactaaggtaagtgggtcttacctt

SEQ ID NO: 616 - DNA, 40 bp, Artificial Sequence
  synthetic sequence
catcctgcttttaaaacccttagtgctcagcggcttgtct

SEQ ID NO: 617 - DNA, 40 bp, Artificial Sequence
  synthetic sequence
agcttataaacttcagagtaatgtagcacaaatgtctgtc

SEQ ID NO: 618 - DNA, 40 bp, Artificial Sequence
  synthetic sequence
aacttgaaataaaactttaaacgttgattgattctttccc

SEQ ID NO: 619 - DNA, 40 bp, Artificial Sequence
  synthetic sequence
gacaggcttagagtccataacaaacaatcttagctggaaa

SEQ ID NO: 620 - DNA, 40 bp, Artificial Sequence
  synthetic sequence
tgctcaacaacacttgtggaagagcagggcaagctatttc

SEQ ID NO: 621 - DNA, 40 bp, Artificial Sequence
  synthetic sequence
ttacaacatcactgtagacattacttttacccacagtgcc

SEQ ID NO: 622 - DNA, 40 bp, Artificial Sequence
  synthetic sequence
atcctagttgtatatacttcttggataaagtatcttcgta

SEQ ID NO: 623 - DNA, 40 bp, Artificial Sequence
  synthetic sequence
atttttggggagtgccattcctgcaggtcttgaagacagg

SEQ ID NO: 624 - DNA, 40 bp, Artificial Sequence
  synthetic sequence
cacacagccaatgaaactgacagagccaatgcaaccaaaa

SEQ ID NO: 625 - DNA, 40 bp, Artificial Sequence
  synthetic sequence
acgacttcaatcaagagaaacaggcaggtcagagtgtgaa

SEQ ID NO: 626 - DNA, 40 bp, Artificial Sequence
  synthetic sequence
ctggttatcagggttcatagcacataggtttgacaaccac

SEQ ID NO: 627 - DNA, 40 bp, Artificial Sequence
  synthetic sequence
tttattattcagctgggtaagccaagtgacagtcttcccc

SEQ ID NO: 628 - DNA, 40 bp, Artificial Sequence
  synthetic sequence
gttttattctaggaatcaactgctttctaaaaatgtctaa

SEQ ID NO: 629 - DNA, 40 bp, Artificial Sequence
  synthetic sequence
tttactgatggtacttattcccccaattattgattattga

SEQ ID NO: 630 - DNA, 40 bp, Artificial Sequence
  synthetic sequence
gcatttaggaatattcaatattgatactaaggtcatcttt

SEQ ID NO: 631 - DNA, 40 bp, Artificial Sequence
  synthetic sequence
tactctgtaatgtagtaatctttatgaagaaataaatttg

SEQ ID NO: 632 - DNA, 40 bp, Artificial Sequence
  synthetic sequence
attttgaaaaaatgtttcactgcattttactatacaagct

SEQ ID NO: 633 - DNA, 40 bp, Artificial Sequence
  synthetic sequence
accacacattcatcaaaaaatacctcaaagaaaattctgc

SEQ ID NO: 634 - DNA, 40 bp, Artificial Sequence
  synthetic sequence
gttgtcacaataaactcagtactgagtaaaatatcacaaa

SEQ ID NO: 635 - DNA, 40 bp, Artificial Sequence
  synthetic sequence
gagtatatattgtattacttacctgatgcgcaaagaccca

SEQ ID NO: 636 - DNA, 40 bp, Artificial Sequence
  synthetic sequence
aaaatgacagcaacataggtgccacctgaggtccacatct

SEQ ID NO: 637 - DNA, 40 bp, Artificial Sequence
  synthetic sequence
tggagagagtggggttaatctgttactacactttgctact

SEQ ID NO: 638 - DNA, 40 bp, Artificial Sequence
  synthetic sequence
atttccatcattttgtctttcagtaagcatgtacgaagta

SEQ ID NO: 639 - DNA, 40 bp, Artificial Sequence
  synthetic sequence
gagatgaagatggtacatcagtagggagcccctctactgg

SEQ ID NO: 640 - DNA, 40 bp, Artificial Sequence
  synthetic sequence
tctaattcatcaaagtattctgggttgattccaggtacgt

SEQ ID NO: 641 - DNA, 40 bp, Artificial Sequence
  synthetic sequence
acaaactcgttttgtacagagaggaaaatattaaaacacc

SEQ ID NO: 642 - DNA, 40 bp, Artificial Sequence
  synthetic sequence
atgttaattataaacactgttataagttttacaaatgtaa

SEQ ID NO: 643 - DNA, 40 bp, Artificial Sequence
  synthetic sequence
tccactggcagagagaatatatgtttccattacggtccca

SEQ ID NO: 644 - DNA, 40 bp, Artificial Sequence
  synthetic sequence
tcaaaggttttctatcacgttttctattatttactcacat

SEQ ID NO: 645 - DNA, 40 bp, Artificial Sequence
  synthetic sequence
aaaaacaagagtcacacaacctatgctccacaatatctgc

SEQ ID NO: 646 - DNA, 40 bp, Artificial Sequence
  synthetic sequence
ataggttattctacaatcgacaccaactatcagcggcttt

SEQ ID NO: 647 - DNA, 40 bp, Artificial Sequence
  synthetic sequence
attgaattaaatgatggcttgattatccaggaatcagcca

SEQ ID NO: 648 - DNA, 40 bp, Artificial Sequence
  synthetic sequence
cttaccataacagagtaatctctagcttattccaaggata

SEQ ID NO: 649 - DNA, 40 bp, Artificial Sequence
  synthetic sequence
acctaaaatttaactagaatcacttttcaatgaagctgct

SEQ ID NO: 650 - DNA, 40 bp, Artificial Sequence
  synthetic sequence
taaactaagagcctttgatcttgccttattctgataaaat

SEQ ID NO: 651 - DNA, 40 bp, Artificial Sequence
  synthetic sequence
aaataataattcacaaggaaatccttattgtttatttaaa

SEQ ID NO: 652 - DNA, 40 bp, Artificial Sequence
  synthetic sequence
gtaatatgtaggttaaacagaaatgttggttgaatcatgt

SEQ ID NO: 653 - DNA, 40 bp, Artificial Sequence
  synthetic sequence
tgcagacactaatcaaaccaaacagggccaattaaaattg

SEQ ID NO: 654 - DNA, 40 bp, Artificial Sequence
  synthetic sequence
taaagtgcaatgggacagagcaacttcattttcacaaaca

SEQ ID NO: 655 - DNA, 40 bp, Artificial Sequence
  synthetic sequence
taatctaattgccagaaatgcttgcccattgcaatgggag

SEQ ID NO: 656 - DNA, 40 bp, Artificial Sequence
  synthetic sequence
agttgacaatgactgcttagtttagggttttgaagtaaac

SEQ ID NO: 657 - DNA, 40 bp, Artificial Sequence
  synthetic sequence
cagatggcaggtattctgtgaattaacactgatgcttctg

SEQ ID NO: 658 - DNA, 40 bp, Artificial Sequence
  synthetic sequence
agtcaagttcagaaatgatctgttatgaccccatgaaacg

SEQ ID NO: 659 - DNA, 40 bp, Artificial Sequence
  synthetic sequence
gggatgctctgatacatcattcagtaaaatgatagaaaaa

SEQ ID NO: 660 - DNA, 40 bp, Artificial Sequence
  synthetic sequence
tagctgtattgcttgatagcttcatagcttgataaccatt

SEQ ID NO: 661 - DNA, 40 bp, Artificial Sequence
  synthetic sequence
ttttagcagggaattaacacaggtatataaatgaagaaaa

SEQ ID NO: 662 - DNA, 40 bp, Artificial Sequence
  synthetic sequence
ttgattgtttatgaagctgagattgtttactggtttcgag

SEQ ID NO: 663 - DNA, 40 bp, Artificial Sequence
  synthetic sequence
tctgtgtttttatgtttgggaacatgagggaatcagttct

SEQ ID NO: 664 - DNA, 40 bp, Artificial Sequence
  synthetic sequence
ttcttaagctttcatttttccagtggtgaatgtagagaga

SEQ ID NO: 665 - DNA, 40 bp, Artificial Sequence
  synthetic sequence
acggtaactgaataaacttaagaactgaggtaaagttttc

SEQ ID NO: 666 - DNA, 40 bp, Artificial Sequence
  synthetic sequence
tcaatatgtaaaattgatcaattcagacacctttatatgg

SEQ ID NO: 667 - DNA, 40 bp, Artificial Sequence
  synthetic sequence
tgtctctttcatgctgtaaatagagcattgcatgaaagat

SEQ ID NO: 668 - DNA, 40 bp, Artificial Sequence
  synthetic sequence
ttcatagcacagtttataaacctaagaaagcaaagatgaa

SEQ ID NO: 669 - DNA, 40 bp, Artificial Sequence
  synthetic sequence
aaccaagcaggattctatgactaaaaaagtgtatttgtat

SEQ ID NO: 670 - DNA, 40 bp, Artificial Sequence
  synthetic sequence
agatagagaatttcaaagaaaccatctttatcagctgcac

SEQ ID NO: 671 - DNA, 40 bp, Artificial Sequence
  synthetic sequence
ccaagaatgaaaagatgcactaattcgactgaaagccaag

SEQ ID NO: 672 - DNA, 40 bp, Artificial Sequence
  synthetic sequence
tcatagttgagacatataacaaccataaaggtccgcatat

SEQ ID NO: 673 - DNA, 40 bp, Artificial Sequence
  synthetic sequence
aggaaagggtggaaaggcaagcagcggggagtgttggctg

SEQ ID NO: 674 - DNA, 40 bp, Artificial Sequence
  synthetic sequence
ctataaattgacctatcctgtaaaaaaggatgtcacagca

SEQ ID NO: 675 - DNA, 40 bp, Artificial Sequence
  synthetic sequence
acaattgacctaagactgtaaattgtaaattgactataaa

SEQ ID NO: 676 - DNA, 40 bp, Artificial Sequence
  synthetic sequence
gcaagactgggtatactattaataggaaaaaatgaacttc

SEQ ID NO: 677 - DNA, 40 bp, Artificial Sequence
  synthetic sequence
attgctttgatattgattgaatcacagagaaaatcctaag

SEQ ID NO: 678 - DNA, 40 bp, Artificial Sequence
  synthetic sequence
tagattatgctggcaaatctcagtgatcagagaattatat

SEQ ID NO: 679 - DNA, 40 bp, Artificial Sequence
  synthetic sequence
attcagaaatggaataggaagatatttatgtgccatcctg

SEQ ID NO: 680 - DNA, 40 bp, Artificial Sequence
  synthetic sequence
gtttgaattattattcaaacagtgtatgtttgtttgtact

SEQ ID NO: 681 - DNA, 40 bp, Artificial Sequence
  synthetic sequence
aatgcaacagagacaggtatttatagcatctgttttccat

SEQ ID NO: 682 - DNA, 40 bp, Artificial Sequence
  synthetic sequence
tttaatatccaaatatgtatggacacatacaattgtacat

SEQ ID NO: 683 - DNA, 40 bp, Artificial Sequence
  synthetic sequence
acgtctaccgtcattttcgtaattattcggtttccctgtc

SEQ ID NO: 684 - DNA, 40 bp, Artificial Sequence
  synthetic sequence
ggagcgctcctgcgcgccttgttcgttaggatttattttt

SEQ ID NO: 685 - DNA, 40 bp, Artificial Sequence
  synthetic sequence
ggtggctccctaatgcctgctcgtttcaggtctcagctct

SEQ ID NO: 686 - DNA, 40 bp, Artificial Sequence
  synthetic sequence
ccttagtgtgttgaggacgctgcagaaggtacagaggaga

SEQ ID NO: 687 - DNA, 40 bp, Artificial Sequence
  synthetic sequence
gaccagatggtaggacagtcattctcctctgcgtctccgc

SEQ ID NO: 688 - DNA, 40 bp, Artificial Sequence
  synthetic sequence
cgtgaggcatggagtttttgtcctgcccctgcctggttag

SEQ ID NO: 689 - DNA, 40 bp, Artificial Sequence
  synthetic sequence
tttaagtctctggcaccgtgcatagcagaattggttggga

SEQ ID NO: 690 - DNA, 40 bp, Artificial Sequence
  synthetic sequence
tctttctccaagtgcctctatgttggcacatctctgaaat

SEQ ID NO: 691 - DNA, 40 bp, Artificial Sequence
  synthetic sequence
tgcgtcccggccaggtaagcagcttccctctcagctgcct

SEQ ID NO: 692 - DNA, 40 bp, Artificial Sequence
  synthetic sequence
gggtgtatgtagctggcagaagtgggacttggtcgcaacc

SEQ ID NO: 693 - DNA, 40 bp, Artificial Sequence
  synthetic sequence
cgtggcgagtgggcggtagctgctcgtagagcgtgtgaaa

SEQ ID NO: 694 - DNA, 40 bp, Artificial Sequence
  synthetic sequence
gttggccctaaaagttatcattcatgctagtttgaccaat

SEQ ID NO: 695 - DNA, 40 bp, Artificial Sequence
  synthetic sequence
aagtgggaggagctgggcaagaaagtccacccctttttct

SEQ ID NO: 696 - DNA, 40 bp, Artificial Sequence
  synthetic sequence
gccgagccgaagtcatctgccaatcaaaacagccacaggg

SEQ ID NO: 697 - DNA, 40 bp, Artificial Sequence
  synthetic sequence
cgcgtacctaatgggagacagacaggtgcctttaaagcgg

SEQ ID NO: 698 - DNA, 40 bp, Artificial Sequence
  synthetic sequence
tggggaaagcggaggaaggcatggagtgtgggcgttaggg

SEQ ID NO: 699 - DNA, 40 bp, Artificial Sequence
  synthetic sequence
gcatattctgccttgaagtcattggttggtcctggaagtg

SEQ ID NO: 700 - DNA, 40 bp, Artificial Sequence
  synthetic sequence
aattggtctgggggaggagctacgacagtccaggggcggg

SEQ ID NO: 701 - DNA, 40 bp, Artificial Sequence
  synthetic sequence
gtgtcgtgctgattggatgtatccgcccccctctcttaaa

SEQ ID NO: 702 - DNA, 40 bp, Artificial Sequence
  synthetic sequence
caacacgccagcgcgaggacccgaacgtcaatcaagagac

SEQ ID NO: 703 - DNA, 40 bp, Artificial Sequence
  synthetic sequence
gcgttcgattggcctcccgcgcaggctgctaggattggct

SEQ ID NO: 704 - DNA, 40 bp, Artificial Sequence
  synthetic sequence
ccctgccccctttcgcggattgggtgatcgctccaaggcg

SEQ ID NO: 705 - DNA, 40 bp, Artificial Sequence
  synthetic sequence
ctgacccttggaggctttctattggttcctggcagggatg

SEQ ID NO: 706 - DNA, 40 bp, Artificial Sequence
  synthetic sequence
tcccgaatataggccagtcattgctcctgctgaacgtcgc

SEQ ID NO: 707 - DNA, 40 bp, Artificial Sequence
  synthetic sequence
cccctcctctcttctcgtctctggcgccgacccgcccccg

SEQ ID NO: 708 - DNA, 40 bp, Artificial Sequence
  synthetic sequence
gctcaagggaggccgcggcgtctgccgatggctccgcgga

SEQ ID NO: 709 - DNA, 40 bp, Artificial Sequence
  synthetic sequence
tgggggagtgggcccggggttgttctgacgacgggggtcg

SEQ ID NO: 710 - DNA, 40 bp, Artificial Sequence
  synthetic sequence
cccgggcgctatcgcgatagcggcgcgaagcggaagtggg

SEQ ID NO: 711 - DNA, 40 bp, Artificial Sequence
  synthetic sequence
cgggggaggcgagcgcccgccgcctttttctcgcgccccg

SEQ ID NO: 712 - DNA, 40 bp, Artificial Sequence
  synthetic sequence
cacaggagctggcgccgccgctgaggagcgtatcgcgaca

SEQ ID NO: 713 - DNA, 40 bp, Artificial Sequence
  synthetic sequence
gttgccgactcgcgctctcggcttctgctccggggcttct

SEQ ID NO: 714 - DNA, 40 bp, Artificial Sequence
  synthetic sequence
actcggagctcggatcccagtgtggacctggactcgaatc

SEQ ID NO: 715 - DNA, 40 bp, Artificial Sequence
  synthetic sequence
ggctcctccttgttccgagcccgaaggcccgccccttcac

SEQ ID NO: 716 - DNA, 40 bp, Artificial Sequence
  synthetic sequence
ctttccggagcccgtctgttccccttcgggtccaaagctt

SEQ ID NO: 717 - DNA, 40 bp, Artificial Sequence
  synthetic sequence
gaccccgcctcattcctcacggcgagctccagaccccgcc

SEQ ID NO: 718 - DNA, 40 bp, Artificial Sequence
  synthetic sequence
agaactcaagctcccgattgtgcccgaaggaacccgaagg

SEQ ID NO: 719 - DNA, 40 bp, Artificial Sequence
  synthetic sequence
actattgccgaagtgagccgaagtttgtggccccgcttcc

SEQ ID NO: 720 - DNA, 40 bp, Artificial Sequence
  synthetic sequence
acatgtggctccgcccacactggcctcagctctccgttct

SEQ ID NO: 721 - DNA, 40 bp, Artificial Sequence
  synthetic sequence
acagtgaccctaaggactcgactacctccgaagaaagccg

SEQ ID NO: 722 - DNA, 40 bp, Artificial Sequence
  synthetic sequence
cttgtacccaactatctacgaagtaaaccgaagcttgtgg

SEQ ID NO: 723 - DNA, 40 bp, Artificial Sequence
  synthetic sequence
tatctggcgaacctgttgactccgcctatcatcctagcgt

SEQ ID NO: 724 - DNA, 40 bp, Artificial Sequence
  synthetic sequence
ggcaagtcgctttcgccccgcccccttgtaaatactcatg

SEQ ID NO: 725 - DNA, 40 bp, Artificial Sequence
  synthetic sequence
ctcctctacttgggaacttgaggatcgtcaccctggcccg

SEQ ID NO: 726 - DNA, 40 bp, Artificial Sequence
  synthetic sequence
ttggctccgccccactgagcgcacctccctctgccgcttc

SEQ ID NO: 727 - DNA, 40 bp, Artificial Sequence
  synthetic sequence
tccttgctccaccccctcatgccgacaccctcgtcaactt

SEQ ID NO: 728 - DNA, 40 bp, Artificial Sequence
  synthetic sequence
tccaccgatagaaccagcgagtcacctcataaacagtaat

SEQ ID NO: 729 - DNA, 40 bp, Artificial Sequence
  synthetic sequence
cgctcagtccgcctccttgcctcccttcagaatgtcccac

SEQ ID NO: 730 - DNA, 40 bp, Artificial Sequence
  synthetic sequence
gccgtccactctccgctcgggcgggctcaccccaattggg

SEQ ID NO: 731 - DNA, 40 bp, Artificial Sequence
  synthetic sequence
cgaccgaaccccacagccgaaagccccgccccctggacac

SEQ ID NO: 732 - DNA, 40 bp, Artificial Sequence
  synthetic sequence
ctccgagcgccagcgcaccccagttggggagttcccgccc

SEQ ID NO: 733 - DNA, 40 bp, Artificial Sequence
  synthetic sequence
agccccgcctcctcccggacgcaataggttcggcgttcgg

SEQ ID NO: 734 - DNA, 40 bp, Artificial Sequence
  synthetic sequence
agcaatttgacgttcgggtgttctcggctcggccgaatcc

SEQ ID NO: 735 - DNA, 40 bp, Artificial Sequence
  synthetic sequence
tgccccctcccgagcacaggaagttcggcgttcgggcgtc

SEQ ID NO: 736 - DNA, 40 bp, Artificial Sequence
  synthetic sequence
tttcggacctcctcgctctcagactcccacagtacaaaac

SEQ ID NO: 737 - DNA, 40 bp, Artificial Sequence
  synthetic sequence
cgagccttcgctcctcctctttccgaacgactgtgattcg

SEQ ID NO: 738 - DNA, 40 bp, Artificial Sequence
  synthetic sequence
gaggctaaggcaccgccgaggccacaccctcttccggacg

SEQ ID NO: 739 - DNA, 40 bp, Artificial Sequence
  synthetic sequence
gcgtcccccttcgggtgttcccgtcagcggtcagaagctc

SEQ ID NO: 740 - DNA, 40 bp, Artificial Sequence
  synthetic sequence
ccttacaaaggtccattttggcaccaccctcttgcaaagt

SEQ ID NO: 741 - DNA, 40 bp, Artificial Sequence
  synthetic sequence
ggagcgtgaaaaacaaacctccgcaagcgcggcgacacgc

SEQ ID NO: 742 - DNA, 40 bp, Artificial Sequence
  synthetic sequence
acccgctctgtgcccgcactgccgtacctaccattgcgcc

SEQ ID NO: 743 - DNA, 40 bp, Artificial Sequence
  synthetic sequence
ggtcctcagcatctgcatatgtagcccctcccgctggtca

SEQ ID NO: 744 - DNA, 40 bp, Artificial Sequence
  synthetic sequence
cccaacccctacccccaatccatcttagagctgattctct

SEQ ID NO: 745 - DNA, 40 bp, Artificial Sequence
  synthetic sequence
actccagtgattcttccttatgctagggactcgaggaccc

SEQ ID NO: 746 - DNA, 40 bp, Artificial Sequence
  synthetic sequence
gagaattgagaagtcagtgtgggaggggatgtcccagtac

SEQ ID NO: 747 - DNA, 40 bp, Artificial Sequence
  synthetic sequence
tttctggttcgcgttggctgcattgtggagctgagggatg

SEQ ID NO: 748 - DNA, 40 bp, Artificial Sequence
  synthetic sequence
tagcttcttaatctccttctttaggtcagcctcatacttt

SEQ ID NO: 749 - DNA, 40 bp, Artificial Sequence
  synthetic sequence
ttctccctgggacccagcagtccactctcccagttccctc

SEQ ID NO: 750 - DNA, 40 bp, Artificial Sequence
  synthetic sequence
aaagtcagacctcaggacccaggaactggggcccacagct

SEQ ID NO: 751 - DNA, 40 bp, Artificial Sequence
  synthetic sequence
tcttgatttggtccctcagccgctgcagatgggaaaagca

SEQ ID NO: 752 - DNA, 40 bp, Artificial Sequence
  synthetic sequence
taagctgcctcttgtccttgatctcgttggacgctaccca

SEQ ID NO: 753 - DNA, 40 bp, Artificial Sequence
  synthetic sequence
ggctctgggctcctaccgtctcaatgagcttgcggttgtc

SEQ ID NO: 754 - DNA, 40 bp, Artificial Sequence
  synthetic sequence
tgaggacctctggggtctggccgctctgcctccgcccctt

SEQ ID NO: 755 - DNA, 40 bp, Artificial Sequence
  synthetic sequence
ctgcctcttcacttcccttaggtgcagaaaccttacttct

SEQ ID NO: 756 - DNA, 40 bp, Artificial Sequence
  synthetic sequence
cgacctgagcctcgtgaccctactttctgagctctgagtc

SEQ ID NO: 757 - DNA, 40 bp, Artificial Sequence
  synthetic sequence
tcaaaggtgggaaaggagctgactaagggccagcagacac

SEQ ID NO: 758 - DNA, 40 bp, Artificial Sequence
  synthetic sequence
ccgttccatttgctgtagagagtgcagttggcaggggggc

SEQ ID NO: 759 - DNA, 40 bp, Artificial Sequence
  synthetic sequence
gctgtaagctttggttttggtctctcgttccacaactttg

SEQ ID NO: 760 - DNA, 40 bp, Artificial Sequence
  synthetic sequence
ccaactcaccgtgagccactggccaacctcttccttctcc

SEQ ID NO: 761 - DNA, 40 bp, Artificial Sequence
  synthetic sequence
ccagggctcaggatcctcagagttcacctcctcttctcta

SEQ ID NO: 762 - DNA, 40 bp, Artificial Sequence
  synthetic sequence
gtccacctgcatgttgagcgtgtcgatggtattctagggg

SEQ ID NO: 763 - DNA, 40 bp, Artificial Sequence
  synthetic sequence
gcgtgtctgcactgacagtgactccacttcactctcaaac

SEQ ID NO: 764 - DNA, 40 bp, Artificial Sequence
  synthetic sequence
tgtcgggtctccctcactcacatccttgtcgcccttcttc

SEQ ID NO: 765 - DNA, 40 bp, Artificial Sequence
  synthetic sequence
ctgctggccagcccattcccatgcccatccccatcccaaa

SEQ ID NO: 766 - DNA, 40 bp, Artificial Sequence
  synthetic sequence
gaatccaggccccaactcccaggagcataaatgactggcc

SEQ ID NO: 767 - DNA, 40 bp, Artificial Sequence
  synthetic sequence
tctcaaatccctaatcccggctgttggccctgtccgcctg

SEQ ID NO: 768 - DNA, 40 bp, Artificial Sequence
  synthetic sequence
cctgccccacgcgtgcagctgctaagccctcccaatcctg

SEQ ID NO: 769 - DNA, 40 bp, Artificial Sequence
  synthetic sequence
cccagacacccaggggaccctgagattctgtctgacctcc

SEQ ID NO: 770 - DNA, 40 bp, Artificial Sequence
  synthetic sequence
cttcccccaagtcgctcctcttcacaaaggccccacggtc

SEQ ID NO: 771 - DNA, 40 bp, Artificial Sequence
  synthetic sequence
cctctgggtgccaggaggcctcttgccatgggtgtccttc

SEQ ID NO: 772 - DNA, 40 bp, Artificial Sequence
  synthetic sequence
ctgccttgtctctacccactgtgctctccctaggaccagg

SEQ ID NO: 773 - DNA, 40 bp, Artificial Sequence
  synthetic sequence
ggcgagggggaggtcctgcagctgctcgcgtgggctgccc

SEQ ID NO: 774 - DNA, 40 bp, Artificial Sequence
  synthetic sequence
tgcgctcgatctcatccttcagttcgtagcccacctgggg

SEQ ID NO: 775 - DNA, 40 bp, Artificial Sequence
  synthetic sequence
tcacctgcttcacaggcggcggctcctgccacttgtcgaa

SEQ ID NO: 776 - DNA, 40 bp, Artificial Sequence
  synthetic sequence
ctcgcttcttccgctgtccatccaggggcgcaggcagcgg

SEQ ID NO: 777 - DNA, 40 bp, Artificial Sequence
  synthetic sequence
cccatgcctaccggacccccagggcccctcacctgcggcc

SEQ ID NO: 778 - DNA, 40 bp, Artificial Sequence
  synthetic sequence
agtcggctgggaggaggacgccggcttctcccctccatga

SEQ ID NO: 779 - DNA, 40 bp, Artificial Sequence
  synthetic sequence
atcttgcggtacctggggacgggtgggtgggcggcgccag

SEQ ID NO: 780 - DNA, 40 bp, Artificial Sequence
  synthetic sequence
ttggcctgcttccggatctccgtcagccccagccgctcct

SEQ ID NO: 781 - DNA, 40 bp, Artificial Sequence
  synthetic sequence
ggagggcgctctgggagtctgacctctccgaagctcatac

SEQ ID NO: 782 - DNA, 40 bp, Artificial Sequence
  synthetic sequence
aggaggcagagggcggtggcggctggctggctgtggggtt

SEQ ID NO: 783 - DNA, 40 bp, Artificial Sequence
  synthetic sequence
agacatgagccagggccacaggacgagaggaggggcggtg

SEQ ID NO: 784 - DNA, 40 bp, Artificial Sequence
  synthetic sequence
ccaagggccgcgagggtcgctttggggctgaatggatgga

SEQ ID NO: 785 - DNA, 40 bp, Artificial Sequence
  synthetic sequence
gatgggaagccgcgggggctctaagcagcggagacacagg

SEQ ID NO: 786 - DNA, 40 bp, Artificial Sequence
  synthetic sequence
ggagcctctgggcagggaggaaccggccaaggagcccggg

SEQ ID NO: 787 - DNA, 40 bp, Artificial Sequence
  synthetic sequence
ggcggggcccagggacggggcggccgtgcagcagggcact

SEQ ID NO: 788 - DNA, 40 bp, Artificial Sequence
  synthetic sequence
ctgcaggaccaaggggatgacgctgggataacagaggaga

SEQ ID NO: 789 - DNA, 40 bp, Artificial Sequence
  synthetic sequence
cagaacaggtttaataggatgaggtggcctctgagttcgg

SEQ ID NO: 790 - DNA, 40 bp, Artificial Sequence
  synthetic sequence
ccattccttccttactcgtgtgggtcgggggatgtcagga

SEQ ID NO: 791 - DNA, 40 bp, Artificial Sequence
  synthetic sequence
ggcccggtcccagcactgctctgtgagctcagagttggga

SEQ ID NO: 792 - DNA, 40 bp, Artificial Sequence
  synthetic sequence
tgggggcccacacacgcgggggatgccggggagcctgaga

SEQ ID NO: 793 - DNA, 40 bp, Artificial Sequence
  synthetic sequence
cacgggcacctgctccggtacccactcggcccggctgagg

SEQ ID NO: 794 - DNA, 40 bp, Artificial Sequence
  synthetic sequence
ctccaccagccggaagcccagcggtcaccagccggccggt

SEQ ID NO: 795 - DNA, 40 bp, Artificial Sequence
  synthetic sequence
aggcgtcctcctcgatctagggggaagaggaggcgccctg

SEQ ID NO: 796 - DNA, 40 bp, Artificial Sequence
  synthetic sequence
acttgcccaggtggcccaggctgaatcccaggtcctcctg

SEQ ID NO: 797 - DNA, 40 bp, Artificial Sequence
  synthetic sequence
tggcctcgtttacctgtgtctgccgcacacgcccactgcc

SEQ ID NO: 798 - DNA, 40 bp, Artificial Sequence
  synthetic sequence
gtctggcccatacctgcagcgtcttggagatcctggcctt

SEQ ID NO: 799 - DNA, 40 bp, Artificial Sequence
  synthetic sequence
gctccccccaccttgtgtccctcggtccccagccccacct

SEQ ID NO: 800 - DNA, 40 bp, Artificial Sequence
  synthetic sequence
tgcagggtccgctgtggggaggacagggaggctgcgatct

SEQ ID NO: 801 - DNA, 40 bp, Artificial Sequence
  synthetic sequence
tcgcggatggtggacttcccgccatatacgacgctctgct

SEQ ID NO: 802 - DNA, 40 bp, Artificial Sequence
  synthetic sequence
agtggggtgaaggccacgctggaggccgtgcccgaggagc

SEQ ID NO: 803 - DNA, 40 bp, Artificial Sequence
  synthetic sequence
cggctgctgagcctaaccacctcctgggcttctttccagc

SEQ ID NO: 804 - DNA, 40 bp, Artificial Sequence
  synthetic sequence
gctcatggtatccctaccgcaggcaatctgtggacagcac

SEQ ID NO: 805 - DNA, 40 bp, Artificial Sequence
  synthetic sequence
ctgaatgtcacctgaagggtcacagaagctactcacaggg

SEQ ID NO: 806 - DNA, 40 bp, Artificial Sequence
  synthetic sequence
ttaagtgttctcaatatgagattagctggagccgcctaat

SEQ ID NO: 807 - DNA, 40 bp, Artificial Sequence
  synthetic sequence
gaagatccatctgttggaagccagaggactagtgggaaac

SEQ ID NO: 808 - DNA, 40 bp, Artificial Sequence
  synthetic sequence
cccccacagggatctgacacacaacttaggttgtcagcca

SEQ ID NO: 809 - DNA, 40 bp, Artificial Sequence
  synthetic sequence
gcccagcttcccaagtcctgcctggacaccgccccatgga

SEQ ID NO: 810 - DNA, 40 bp, Artificial Sequence
  synthetic sequence
aatcaccttcatgcttaaaacactcacactgatttccagc

SEQ ID NO: 811 - DNA, 40 bp, Artificial Sequence
  synthetic sequence
cctcttggggacctgggtgaccttactcaccctcatggct

SEQ ID NO: 812 - DNA, 40 bp, Artificial Sequence
  synthetic sequence
gttgctgtggacaggcttggagccgtttttggctggagac

SEQ ID NO: 813 - DNA, 40 bp, Artificial Sequence
  synthetic sequence
ggaggggtaggtgggcggcacagctggggactgagggtgc

SEQ ID NO: 814 - DNA, 40 bp, Artificial Sequence
  synthetic sequence
gccaggagtggtgctcaaggcagaggcagcaggcgggggg

SEQ ID NO: 815 - DNA, 40 bp, Artificial Sequence
  synthetic sequence
cagggcacttgggggtgctgcgggggcggggaccccattg

SEQ ID NO: 816 - DNA, 40 bp, Artificial Sequence
  synthetic sequence
ggtgcccgagttgtggctgggagctggactggccttgggg

SEQ ID NO: 817 - DNA, 40 bp, Artificial Sequence
  synthetic sequence
ctgcttgccagcccctccaccggcactgctgttactactg

SEQ ID NO: 818 - DNA, 40 bp, Artificial Sequence
  synthetic sequence
gccccccaccccgctgcctcctcactcactggtggcgcca

SEQ ID NO: 819 - DNA, 40 bp, Artificial Sequence
  synthetic sequence
cgggctgtctgccacaactgagctgtaacctgggaacaaa

SEQ ID NO: 820 - DNA, 40 bp, Artificial Sequence
  synthetic sequence
gctggcattgttgcccccactgctgctcaaagccacctct

SEQ ID NO: 821 - DNA, 40 bp, Artificial Sequence
  synthetic sequence
aggtgggttgtgggggccggaaggggggcccaaggcctgg

SEQ ID NO: 822 - DNA, 40 bp, Artificial Sequence
  synthetic sequence
tcccaaccctgccgatggccgagacactcacgaggtgctg

SEQ ID NO: 823 - DNA, 40 bp, Artificial Sequence
  synthetic sequence
gggggtgaggcgcctgcgcctctctgtttcaaaaggctgc

SEQ ID NO: 824 - DNA, 40 bp, Artificial Sequence
  synthetic sequence
attcccagcagcaagggcggggggttcagaacccaccgat

SEQ ID NO: 825 - DNA, 40 bp, Artificial Sequence
  synthetic sequence
gggggtgtaacacccgagggagatggaggatagcgcttgg

SEQ ID NO: 826 - DNA, 40 bp, Artificial Sequence
  synthetic sequence
caaagcagggaggctgatgtagtttccttgctggaaagaa

SEQ ID NO: 827 - DNA, 40 bp, Artificial Sequence
  synthetic sequence
cttccacttagatgagaacgtattttagaatgttctgaag

SEQ ID NO: 828 - DNA, 40 bp, Artificial Sequence
  synthetic sequence
taacagaaatggggaggaaagggtatggggctcttgagaa

SEQ ID NO: 829 - DNA, 40 bp, Artificial Sequence
  synthetic sequence
aaacagtgaccctccggtggcagtcaattggcctcaggca

SEQ ID NO: 830 - DNA, 40 bp, Artificial Sequence
  synthetic sequence
gcagaggaataaggacttcgggacaattcactttgaaaag

SEQ ID NO: 831 - DNA, 40 bp, Artificial Sequence
  synthetic sequence
gacccagtggaatggtctgagctaagatttgaaggagtgg

SEQ ID NO: 832 - DNA, 40 bp, Artificial Sequence
  synthetic sequence
tgcacactgatctttcttagggcattcttcgggaaacagg

SEQ ID NO: 833 - DNA, 40 bp, Artificial Sequence
  synthetic sequence
ggctcaggatgaacagcaacaggggttgggatgatcactg

SEQ ID NO: 834 - DNA, 40 bp, Artificial Sequence
  synthetic sequence
gatcatggagatgtgatctagggaacaaagccagagaagg

SEQ ID NO: 835 - DNA, 40 bp, Artificial Sequence
  synthetic sequence
aggcattcccacggtgtgaggtcagattgggcagggccta

SEQ ID NO: 836 - DNA, 40 bp, Artificial Sequence
  synthetic sequence
agagccagcacttgctgttccacacatactagatcagtct

SEQ ID NO: 837 - DNA, 40 bp, Artificial Sequence
  synthetic sequence
tggacaaccccctcccacacccagagctgtggaaggggag

SEQ ID NO: 838 - DNA, 40 bp, Artificial Sequence
  synthetic sequence
cacctagatgctgaccaaggccctccccatgctgctggag

SEQ ID NO: 839 - DNA, 40 bp, Artificial Sequence
  synthetic sequence
ataaagccttcattctccaggaccccgcccttgccctgtt

SEQ ID NO: 840 - DNA, 40 bp, Artificial Sequence
  synthetic sequence
aggtggtgagtttggggctggggggcctccctgaggagcc

SEQ ID NO: 841 - DNA, 40 bp, Artificial Sequence
  synthetic sequence
gagagaaccaggtcccacatgctgacacaggtgtccacgg

SEQ ID NO: 842 - DNA, 40 bp, Artificial Sequence
  synthetic sequence
atccccccaatctcaccagtgcaccccacagacaaggcga

SEQ ID NO: 843 - DNA, 40 bp, Artificial Sequence
  synthetic sequence
aagggcttcagcataagagtcagaacccgccccccttcct

SEQ ID NO: 844 - DNA, 40 bp, Artificial Sequence
  synthetic sequence
tgtgggctgaagggacgaggctggggcactgggtgggagg

SEQ ID NO: 845 - DNA, 40 bp, Artificial Sequence
  synthetic sequence
ttgcaatgtggaagagtcaggggcacattgtctgggctga

SEQ ID NO: 846 - DNA, 40 bp, Artificial Sequence
  synthetic sequence
taagtgggagggagcggggacctagtgtgggcatgaggac

SEQ ID NO: 847 - DNA, 40 bp, Artificial Sequence
  synthetic sequence
ggagcagggatttggctgggcaatggagagaaaggtctga

SEQ ID NO: 848 - DNA, 40 bp, Artificial Sequence
  synthetic sequence
acacagagatgcccaggaacttgctctttagtaaagcagc

SEQ ID NO: 849 - DNA, 40 bp, Artificial Sequence
  synthetic sequence
tggagagaggtccttgaaaggttttgaaccccataaagag

SEQ ID NO: 850 - DNA, 40 bp, Artificial Sequence
  synthetic sequence
tcaggaggcagcccagtgatagggtccaaggaaccagtgg

SEQ ID NO: 851 - DNA, 40 bp, Artificial Sequence
  synthetic sequence
acagtctactgacttttcctattcagctgtgagcattcaa

SEQ ID NO: 852 - DNA, 40 bp, Artificial Sequence
  synthetic sequence
ctgtcccctggaccttgacacctggctccccaaccctgtc

SEQ ID NO: 853 - DNA, 40 bp, Artificial Sequence
  synthetic sequence
aggaaacccagattccaccagacacttccttcttcccccc

SEQ ID NO: 854 - DNA, 40 bp, Artificial Sequence
  synthetic sequence
ggctatctggcctgagacaacaaatgctgcctcccaccct

SEQ ID NO: 855 - DNA, 40 bp, Artificial Sequence
  synthetic sequence
gtctggcactgggactttcagaactcctccttccctgact

SEQ ID NO: 856 - DNA, 40 bp, Artificial Sequence
  synthetic sequence
ttgccccagacccgtcattcaatggctagctttttccatg

SEQ ID NO: 857 - DNA, 40 bp, Artificial Sequence
  synthetic sequence
aaaaacacgagcacccccaaccacaacggccagttctctg

SEQ ID NO: 858 - DNA, 40 bp, Artificial Sequence
  synthetic sequence
ttaaccttggacatggtaaaccatccaaaaccttcctctc

SEQ ID NO: 859 - DNA, 40 bp, Artificial Sequence
  synthetic sequence
agcaactaaacctctccactgggcacttatccttggtttc

SEQ ID NO: 860 - DNA, 40 bp, Artificial Sequence
  synthetic sequence
gaacctcttattctcttagaacccacagctgccaccacag

SEQ ID NO: 861 - DNA, 40 bp, Artificial Sequence
  synthetic sequence
tcccttctcccagtgtaagaccccaaatcactccaaatga

SEQ ID NO: 862 - DNA, 40 bp, Artificial Sequence
  synthetic sequence
caacccccaacccgatgcctgcttcagatgtttcccatgt

SEQ ID NO: 863 - DNA, 40 bp, Artificial Sequence
  synthetic sequence
cataaacctggctcctaaaggctaaatattttgttggaga

SEQ ID NO: 864 - DNA, 40 bp, Artificial Sequence
  synthetic sequence
ctgctgacctgccctcccaggtcagaatcatcctcatgca

SEQ ID NO: 865 - DNA, 40 bp, Artificial Sequence
  synthetic sequence
tgttctccagacctgtgcactctatctgtgcaacagagat

SEQ ID NO: 866 - DNA, 40 bp, Artificial Sequence
  synthetic sequence
cgtgcagcaaacaatgtggaattccaataaccccccactc

SEQ ID NO: 867 - DNA, 40 bp, Artificial Sequence
  synthetic sequence
aaatatgagtctcccaaagttccctagcatttcaaaatcc

SEQ ID NO: 868 - DNA, 40 bp, Artificial Sequence
  synthetic sequence
catcataaaaagatcttgtggtccacagatcctctagccc

SEQ ID NO: 869 - DNA, 40 bp, Artificial Sequence
  synthetic sequence
ctcccaacccagaatccagctccacagatacattgctact

SEQ ID NO: 870 - DNA, 40 bp, Artificial Sequence
  synthetic sequence
cactctgagaccagaaactagaacttttattcctcatgct

SEQ ID NO: 871 - DNA, 40 bp, Artificial Sequence
  synthetic sequence
caccagcactcaggagattgtgagactccctgatccctgc

SEQ ID NO: 872 - DNA, 40 bp, Artificial Sequence
  synthetic sequence
tgcctagatcctttgcactccaagacccagtgtgccctaa

SEQ ID NO: 873 - DNA, 40 bp, Artificial Sequence
  synthetic sequence
gggggtgggtacgatccccgattcttcatacaaagcctca

SEQ ID NO: 874 - DNA, 40 bp, Artificial Sequence
  synthetic sequence
ggacaaaggcagaggagacacgcccaggatgaaacagaaa

SEQ ID NO: 875 - DNA, 40 bp, Artificial Sequence
  synthetic sequence
tggatgcaccaggccctgtagctcatggagacttcatcta

SEQ ID NO: 876 - DNA, 40 bp, Artificial Sequence
  synthetic sequence
gggagagctagcacttgctgttctgcaattactagatcac

SEQ ID NO: 877 - DNA, 40 bp, Artificial Sequence
  synthetic sequence
ggctggacaaccccctcccacacccagagctgtggaaggg

SEQ ID NO: 878 - DNA, 40 bp, Artificial Sequence
  synthetic sequence
tggcacccagaggctgaccaaggccctccccatgctgctg

SEQ ID NO: 879 - DNA, 40 bp, Artificial Sequence
  synthetic sequence
cctataaaaccttcattccccaggactccgcccctgccct

SEQ ID NO: 880 - DNA, 40 bp, Artificial Sequence
  synthetic sequence
tgcaggtggtaagcttggggctggggagcctcccccagga

SEQ ID NO: 881 - DNA, 40 bp, Artificial Sequence
  synthetic sequence
aggaagacaaccgggacccacatggtgacacagctctccg

SEQ ID NO: 882 - DNA, 40 bp, Artificial Sequence
  synthetic sequence
caaccatggcccctctcaccaatccacgtcacggacaggg

SEQ ID NO: 883 - DNA, 40 bp, Artificial Sequence
  synthetic sequence
tcagcttgacagtcagggctggctccctctcctgcatccc

SEQ ID NO: 884 - DNA, 40 bp, Artificial Sequence
  synthetic sequence
tccctgtctgggctggggtgctgggttgggggggaaagag

SEQ ID NO: 885 - DNA, 40 bp, Artificial Sequence
  synthetic sequence
tgtgggagtgaggactgttgcaatatggaggggctggggg

SEQ ID NO: 886 - DNA, 40 bp, Artificial Sequence
  synthetic sequence
gggagaaagttctggggtaagtgggagggagcggggacct

SEQ ID NO: 887 - DNA, 40 bp, Artificial Sequence
  synthetic sequence
ttgtggggctcaaaacctccaaggacctctctcaatgcca

SEQ ID NO: 888 - DNA, 40 bp, Artificial Sequence
  synthetic sequence
tgcccaaccctatcccagagaccttgatgcttggcctccc

SEQ ID NO: 889 - DNA, 40 bp, Artificial Sequence
  synthetic sequence
tcttgccctaggatacccagatgccaaccagacacctcct

SEQ ID NO: 890 - DNA, 40 bp, Artificial Sequence
  synthetic sequence
ttcctagccaggctatctggcctgagacaacaaatgggtc

SEQ ID NO: 891 - DNA, 40 bp, Artificial Sequence
  synthetic sequence
tcttagccccagactcttcattcagtggcccacattttcc

SEQ ID NO: 892 - DNA, 40 bp, Artificial Sequence
  synthetic sequence
aggaaaaacatgagcatccccagccacaactgccagctct

SEQ ID NO: 893 - DNA, 40 bp, Artificial Sequence
  synthetic sequence
ccccttcagagttactgacaaacaggtgggcactgagact

SEQ ID NO: 894 - DNA, 40 bp, Artificial Sequence
  synthetic sequence
tggaaagttagcttatttgtttgcaagtcagtaaaatgtc

SEQ ID NO: 895 - DNA, 40 bp, Artificial Sequence
  synthetic sequence
gactcaggagtctcatggactctgccagcattcacaaaac

SEQ ID NO: 896 - DNA, 40 bp, Artificial Sequence
  synthetic sequence
atgctgtctgctaagctgtgagcagtaaaagcctttgcct

SEQ ID NO: 897 - DNA, 40 bp, Artificial Sequence
  synthetic sequence
gatttggggggggcaaggtgtactaatgtgaacatgaacc

SEQ ID NO: 898 - DNA, 40 bp, Artificial Sequence
  synthetic sequence
gtgtgcacagcatccacctagactgctctggtcaccctac

SEQ ID NO: 899 - DNA, 40 bp, Artificial Sequence
  synthetic sequence
aggattcctaatctcaggtttctcaccagtggcacaaacc

SEQ ID NO: 900 - DNA, 40 bp, Artificial Sequence
  synthetic sequence
caaaggctgagcaggtttgcaagttgtcccagtataagat

SEQ ID NO: 901 - DNA, 40 bp, Artificial Sequence
  synthetic sequence
gtcaaggacaatcgatacaatatgttcctccagagtaggt

SEQ ID NO: 902 - DNA, 40 bp, Artificial Sequence
  synthetic sequence
gcaagatgatatctctctcagatccaggcttgcttactgt

SEQ ID NO: 903 - DNA, 40 bp, Artificial Sequence
  synthetic sequence
tctgtgtgtcttctgagcaaagacagcaacaccttttttt

SEQ ID NO: 904 - DNA, 40 bp, Artificial Sequence
  synthetic sequence
aacgttgagactgtcctgcagacaagggtggaaggctctg

SEQ ID NO: 905 - DNA, 40 bp, Artificial Sequence
  synthetic sequence
cataaataagcaggatgtgacagaagaagtatttaatggt

SEQ ID NO: 906 - DNA, 40 bp, Artificial Sequence
  synthetic sequence
gctgccagacacagtcgatcgggacctagaaccttggtta

SEQ ID NO: 907 - DNA, 40 bp, Artificial Sequence
  synthetic sequence
gggatcctgagcgctgccttattctgggtttggcagtgga

SEQ ID NO: 908 - DNA, 40 bp, Artificial Sequence
  synthetic sequence
tcactcaaacccagaagttctgatccccagccatgcccct

SEQ ID NO: 909 - DNA, 40 bp, Artificial Sequence
  synthetic sequence
agcctcttcctcctttgaaattcaagagggtggacccact

SEQ ID NO: 910 - DNA, 40 bp, Artificial Sequence
  synthetic sequence
ggagctgggaccttaccagtctcctccctcattgacctaa

SEQ ID NO: 911 - DNA, 40 bp, Artificial Sequence
  synthetic sequence
gaggatatgagattcttaggccattcccacatcagtacct

SEQ ID NO: 912 - DNA, 40 bp, Artificial Sequence
  synthetic sequence
tacccagaactctacccctcaggattccagcaccttcttc

SEQ ID NO: 913 - DNA, 40 bp, Artificial Sequence
  synthetic sequence
gcctctgcccttcaggggccaaagagccttaagccacaaa

SEQ ID NO: 914 - DNA, 40 bp, Artificial Sequence
  synthetic sequence
atcccattactatcaccccaaaccctggacctaatggttc

SEQ ID NO: 915 - DNA, 40 bp, Artificial Sequence
  synthetic sequence
aatgggcaaccctcgatcctcagactcttgaggaatcaag

SEQ ID NO: 916 - DNA, 40 bp, Artificial Sequence
  synthetic sequence
gataccctcaagtggagtaaggattaggtggcaagatgga

SEQ ID NO: 917 - DNA, 40 bp, Artificial Sequence
  synthetic sequence
gtgcttgcccaggggcaccttcatggagctagaagggctg

SEQ ID NO: 918 - DNA, 40 bp, Artificial Sequence
  synthetic sequence
gatgacacccaaggcctctggggcatctttcatgctcaga

SEQ ID NO: 919 - DNA, 40 bp, Artificial Sequence
  synthetic sequence
tgctggccacaccctcagagtgtggatgctggatgatgag

SEQ ID NO: 920 - DNA, 40 bp, Artificial Sequence
  synthetic sequence
gaggcacgctgcagggatagtcacagcaacatgacgtcat

SEQ ID NO: 921 - DNA, 40 bp, Artificial Sequence
  synthetic sequence
agaggaggatgtcggcagctctacggttggcaggtggctg

SEQ ID NO: 922 - DNA, 40 bp, Artificial Sequence
  synthetic sequence
gacactaggcctcagcctggcaccatgcaggccactccca

SEQ ID NO: 923 - DNA, 40 bp, Artificial Sequence
  synthetic sequence
acttttgagtcctggatccctatgattccaggctccctgt

SEQ ID NO: 924 - DNA, 40 bp, Artificial Sequence
  synthetic sequence
ccttgagatttcatggatggtgacatatggccattctcta

SEQ ID NO: 925 - DNA, 40 bp, Artificial Sequence
  synthetic sequence
aaaacccataagttcaggtccctgtgccctccacccagaa

SEQ ID NO: 926 - DNA, 40 bp, Artificial Sequence
  synthetic sequence
tcgtatctgggagactcacttgggagagcaatagacttgg

SEQ ID NO: 927 - DNA, 40 bp, Artificial Sequence
  synthetic sequence
tacaagatgtggtggagataaggctgatgctggcacagtg

SEQ ID NO: 928 - DNA, 40 bp, Artificial Sequence
  synthetic sequence
gtacacaccatggtgttcatcagggccctgggtagtccct

SEQ ID NO: 929 - DNA, 40 bp, Artificial Sequence
  synthetic sequence
gctgtgacctcacaggagtccgtgcctccaccccctactc

SEQ ID NO: 930 - DNA, 40 bp, Artificial Sequence
  synthetic sequence
ttgttgcgccggatcccttatcgtcatcgtctttgtaatc

SEQ ID NO: 931 - DNA, 40 bp, Artificial Sequence
  synthetic sequence
gattctcttcgacatctccggcttgtttcagcagagagaa

SEQ ID NO: 932 - DNA, 40 bp, Artificial Sequence
  synthetic sequence
gggtggattcttcttgagacaaaggcttggccatcggtcc

SEQ ID NO: 933 - DNA, 40 bp, Artificial Sequence
  synthetic sequence
agatggggatgctgttgattgtagccgttgctctttcaat

SEQ ID NO: 934 - DNA, 40 bp, Artificial Sequence
  synthetic sequence
cgtcgctagagagagctgcgctggcgacgctgtagtcttc

SEQ ID NO: 935 - DNA, 40 bp, Artificial Sequence
  synthetic sequence
ccccagtaaaatgatatacattgacaccagtgaagatgcg

SEQ ID NO: 936 - DNA, 40 bp, Artificial Sequence
  synthetic sequence
cagcagcagcagtgcccagcaccacgagttctgcacaagg

SEQ ID NO: 937 - DNA, 40 bp, Artificial Sequence
  synthetic sequence
catttccgatcgcgacgatacaagtcaggttgccagctgc

SEQ ID NO: 938 - DNA, 40 bp, Artificial Sequence
  synthetic sequence
cctgtcggcaccgtccgcaggggctcaagatgcccctgtt

SEQ ID NO: 939 - DNA, 40 bp, Artificial Sequence
  synthetic sequence
ccttcactatggctttgatcccaggatgcagatcgagaag

SEQ ID NO: 940 - DNA, 40 bp, Artificial Sequence
  synthetic sequence
gcaattcacgaatcccaactgccgtcggctgtccatcact

SEQ ID NO: 941 - DNA, 40 bp, Artificial Sequence
  synthetic sequence
tgatatcgaattcttagccctcccacacataaccagaggg

SEQ ID NO: 942 - DNA, 40 bp, Artificial Sequence
  synthetic sequence
atagcgtaaaaggagcaacatagttaagaataccagtcaa

SEQ ID NO: 943 - DNA, 40 bp, Artificial Sequence
  synthetic sequence
aagcaatagcatgatacaaaggcattaaagcagcgtatcc

SEQ ID NO: 944 - DNA, 40 bp, Artificial Sequence
  synthetic sequence
accaggatttatacaaggaggagaaaatgaaagccatacg

SEQ ID NO: 945 - DNA, 40 bp, Artificial Sequence
  synthetic sequence
gttgcctgacaacgggccacaactcctcataaagagacag

SEQ ID NO: 946 - DNA, 40 bp, Artificial Sequence
  synthetic sequence
cagtgggggttgcgtcagcaaacacagtgcacaccacgcc

SEQ ID NO: 947 - DNA, 40 bp, Artificial Sequence
  synthetic sequence
aagtcccggaaaggagctgacaggtggtggcaatgcccca

SEQ ID NO: 948 - DNA, 40 bp, Artificial Sequence
  synthetic sequence
cggcgatgagttccgccgtggcaatagggagggggaaagc

SEQ ID NO: 949 - DNA, 40 bp, Artificial Sequence
  synthetic sequence
tgcccaacagccgagcccctgtccagcagcgggcaaggca

SEQ ID NO: 950 - DNA, 40 bp, Artificial Sequence
  synthetic sequence
gaaaggacgatgatttccccgacaacaccacggaattgtc

SEQ ID NO: 951 - DNA, 40 bp, Artificial Sequence
  synthetic sequence
tcccgcgcagaatccaggtggcaacacaggcgagcagcca

SEQ ID NO: 952 - DNA, 40 bp, Artificial Sequence
  synthetic sequence
ggtccgctggattgagggccgaagggacgtagcagaagga

SEQ ID NO: 953 - DNA, 40 bp, Artificial Sequence
  synthetic sequence
gcggaagaggccgcagagccggcagcaggccgcgggaagg

SEQ ID NO: 954 - DNA, 40 bp, Artificial Sequence
  synthetic sequence
cccaaagggagatccgactcgtctgagggcgaaggcgaag

SEQ ID NO: 955 - DNA, 40 bp, Artificial Sequence
  synthetic sequence
ttgctccatgtttttctaggtctcgaggtcgacggtatcg

SEQ ID NO: 956 - DNA, 40 bp, Artificial Sequence
  synthetic sequence
aggcacaatcagcattggtagctgctgtattgctacttgt

SEQ ID NO: 957 - DNA, 40 bp, Artificial Sequence
  synthetic sequence
cagctgccttgtaagtcattggtcttaaaggtacctgagg

SEQ ID NO: 958 - DNA, 40 bp, Artificial Sequence
  synthetic sequence
acagatcaaggatatcttgtcttcgttgggagtgaattag

SEQ ID NO: 959 - DNA, 40 bp, Artificial Sequence
  synthetic sequence
agttctgccaatcagggaagtagccttgtgtgtggtagat

SEQ ID NO: 960 - DNA, 40 bp, Artificial Sequence
  synthetic sequence
atccaaaggtcagtggatatctgatccctggccctggtgt

SEQ ID NO: 961 - DNA, 40 bp, Artificial Sequence
  synthetic sequence
cttctaccttctcttgctcaactggtactagcttgtagca

SEQ ID NO: 962 - DNA, 40 bp, Artificial Sequence
  synthetic sequence
tcacagggtgtaacaagcgggtgttctctccttcattggc

SEQ ID NO: 963 - DNA, 40 bp, Artificial Sequence
  synthetic sequence
actctaatacttctctctccgggtcatccatcccatgcag

SEQ ID NO: 964 - DNA, 40 bp, Artificial Sequence
  synthetic sequence
ctcgggccatgtgatgaaatgctaggcggctgtcaaacct

SEQ ID NO: 965 - DNA, 40 bp, Artificial Sequence
  synthetic sequence
gcgcgcttcagcaagccgagtcctgcgtcgagagagctcc

SEQ ID NO: 966 - DNA, 40 bp, Artificial Sequence
  synthetic sequence
ttttggcgtactcaccagtcgccgcccctcgcctcttgcc

SEQ ID NO: 967 - DNA, 40 bp, Artificial Sequence
  synthetic sequence
ctcgcacccatctctctccttctagcctccgctagtcaaa

SEQ ID NO: 968 - DNA, 40 bp, Artificial Sequence
  synthetic sequence
cccatagtgcttcctgctgctcccaagaacccaaggaaca

SEQ ID NO: 969 - DNA, 40 bp, Artificial Sequence
  synthetic sequence
aataattgtctggcctgtaccgtcagcgtcattgacgctg

SEQ ID NO: 970 - DNA, 40 bp, Artificial Sequence
  synthetic sequence
atagccctcagcaaattgttctgctgctgcactataccag

SEQ ID NO: 971 - DNA, 40 bp, Artificial Sequence
  synthetic sequence
atgccccagactgtgagttgcaacagatgctgttgcgcct

SEQ ID NO: 972 - DNA, 40 bp, Artificial Sequence
  synthetic sequence
aggtatctttccacagccaggattcttgcctggagctgct

SEQ ID NO: 973 - DNA, 40 bp, Artificial Sequence
  synthetic sequence
tttccagagcaaccccaaatccccaggagctgttgatcct

SEQ ID NO: 974 - DNA, 40 bp, Artificial Sequence
  synthetic sequence
ttcccatcgcgatctaattctcccccgcttaatactgacg

SEQ ID NO: 975 - DNA, 40 bp, Artificial Sequence
  synthetic sequence
tgcgaatcgttctagctccctgcttgcccatactatatgt

SEQ ID NO: 976 - DNA, 40 bp, Artificial Sequence
  synthetic sequence
ttgtctacagccttctgatgtttctaacaggccaggatta

SEQ ID NO: 977 - DNA, 40 bp, Artificial Sequence
  synthetic sequence
ttctgatcctgtctgaagggatggttgtagctgtcccagt

SEQ ID NO: 978 - DNA, 40 bp, Artificial Sequence
  synthetic sequence
taaagcttccttggtgtcttttatctctatcctttgatgc

SEQ ID NO: 979 - DNA, 40 bp, Artificial Sequence
  synthetic sequence
atatctcctcctccaggtctgaagatcagcggccgcttgc

SEQ ID NO: 980 - DNA, 40 bp, Artificial Sequence
  synthetic sequence
ctctttgccttggtgggtgctactcctaatggttcaattt

SEQ ID NO: 981 - DNA, 40 bp, Artificial Sequence
  synthetic sequence
ctccaactagcattccaaggcacagcagtggtgcaaatga

SEQ ID NO: 982 - DNA, 40 bp, Artificial Sequence
  synthetic sequence
atccaggtcgtgtgattccaaatctgttccagagatttat

SEQ ID NO: 983 - DNA, 40 bp, Artificial Sequence
  synthetic sequence
tgtattaagcttgtgtaattgttaatttctctgtcccact

SEQ ID NO: 984 - DNA, 40 bp, Artificial Sequence
  synthetic sequence
tcattcttttcttgctggttttgcgattcttcaattaagg

SEQ ID NO: 985 - DNA, 40 bp, Artificial Sequence
  synthetic sequence
gaatatccctgcctaactctattcactatagaaagtacag

SEQ ID NO: 986 - DNA, 40 bp, Artificial Sequence
  synthetic sequence
ggtcccctcggggttgggaggtgggtctgaaacgataatg

SEQ ID NO: 987 - DNA, 40 bp, Artificial Sequence
  synthetic sequence
cgcagtgccgatccgttcactaatcgaatggatctgtctc

SEQ ID NO: 988 - DNA, 40 bp, Artificial Sequence
  synthetic sequence
aattgtggatgaatactgccatttgtctgcagaattggcg

SEQ ID NO: 989 - DNA, 40 bp, Artificial Sequence
  synthetic sequence
tgataattttcagcagatcgtggtatgtgcccagggaggc

SEQ ID NO: 990 - DNA, 40 bp, Artificial Sequence
  synthetic sequence
ccagattggcaatgtgctcgtgcaggctatcgccctggcc

SEQ ID NO: 991 - DNA, 40 bp, Artificial Sequence
  synthetic sequence
ttggctgacctgattgctgtgtcctgtgtcagctgctgct

SEQ ID NO: 992 - DNA, 40 bp, Artificial Sequence
  synthetic sequence
atgtaccatttgcccctggatgttctgcactatagggtaa

SEQ ID NO: 993 - DNA, 40 bp, Artificial Sequence
  synthetic sequence
tacttttacccatgcatttaaagttctaggtgatatggcc

SEQ ID NO: 994 - DNA, 40 bp, Artificial Sequence
  synthetic sequence
aaacatgggtatcacttctgggctgaaagccttctcttct

SEQ ID NO: 995 - DNA, 40 bp, Artificial Sequence
  synthetic sequence
ggtgtttaaatcttgtggggtggctccttctgataatgct

SEQ ID NO: 996 - DNA, 40 bp, Artificial Sequence
  synthetic sequence
catttgcatggctgcttgatgtccccccactgtgtttagc

SEQ ID NO: 997 - DNA, 40 bp, Artificial Sequence
  synthetic sequence
catctggcctggtgcaataggccctgcatgcactggatgc

SEQ ID NO: 998 - DNA, 40 bp, Artificial Sequence
  synthetic sequence
ggtactagtagttcctgctatgtcacttccccttggttct

SEQ ID NO: 999 - DNA, 40 bp, Artificial Sequence
  synthetic sequence
gataggtggattatttgtcatccatcctatttgttcctga

SEQ ID NO: 1000 - DNA, 40 bp, Artificial Sequence
  synthetic sequence
gtccagaatgctggtagggctatacattcttactatttta

SEQ ID NO: 1001 - DNA, 40 bp, Artificial Sequence
  synthetic sequence
gtctacatagtctctaaagggttcctttggtccttgtctt

SEQ ID NO: 1002 - DNA, 40 bp, Artificial Sequence
  synthetic sequence
ctcctgtgaagcttgctcggctcttagagttttatagaac

SEQ ID NO: 1003 - DNA, 40 bp, Artificial Sequence
  synthetic sequence
cgcattttggaccaacaaggtttctgtcatccaatttttt

SEQ ID NO: 1004 - DNA, 40 bp, Artificial Sequence
  synthetic sequence
tcctactccctgacatgctgtcatcatttcttctagtgta

SEQ ID NO: 1005 - DNA, 40 bp, Artificial Sequence
  synthetic sequence
gctcattgcttcagccaaaactcttgccttatggccgggt

SEQ ID NO: 1006 - DNA, 40 bp, Artificial Sequence
  synthetic sequence
attgcctctctgcatcattatggtagctgaatttgttact

SEQ ID NO: 1007 - DNA, 40 bp, Artificial Sequence
  synthetic sequence
gccacaattgaaacacttaacaatctttctttggttccta

SEQ ID NO: 1008 - DNA, 40 bp, Artificial Sequence
  synthetic sequence
tttcctaggggccctgcaatttctggctgtgtgcccttct

SEQ ID NO: 1009 - DNA, 40 bp, Artificial Sequence
  synthetic sequence
cccagacctgaagctctcttctggtggggctgttggctct

SEQ ID NO: 1010 - DNA, 40 bp, Artificial Sequence
  synthetic sequence
gtctatcggctcctgcttctgagggggagttgttgtctct

SEQ ID NO: 1011 - DNA, 40 bp, Artificial Sequence
  synthetic sequence
gccaaagagtgacctgagggaagttaaaggatacagttcc

SEQ ID NO: 1012 - DNA, 40 bp, Artificial Sequence
  synthetic sequence
cctttagttgcccccctatctttattgtgacgaggggtcg

SEQ ID NO: 1013 - DNA, 40 bp, Artificial Sequence
  synthetic sequence
cttctaatactgtatcatctgctcctgtatctaatagagc

SEQ ID NO: 1014 - DNA, 40 bp, Artificial Sequence
  synthetic sequence
gtatctgatcatactgtcttactttgataaaacctccaat

SEQ ID NO: 1015 - DNA, 40 bp, Artificial Sequence
  synthetic sequence
ctaatactgtacctatagctttatgtccacagatttctat

SEQ ID NO: 1016 - DNA, 40 bp, Artificial Sequence
  synthetic sequence
tcaacagatttcttccaattatgttgacaggtgtaggtcc

SEQ ID NO: 1017 - DNA, 40 bp, Artificial Sequence
  synthetic sequence
ttgggccatccattcctggctttaattttactggtacagt

SEQ ID NO: 1018 - DNA, 40 bp, Artificial Sequence
  synthetic sequence
caaatactggagtattgtatggattttcaggcccaatttt

SEQ ID NO: 1019 - DNA, 40 bp, Artificial Sequence
  synthetic sequence
cttcccagaagtcttgagttctcttattaagttctctgaa

SEQ ID NO: 1020 - DNA, 40 bp, Artificial Sequence
  synthetic sequence
ctgaaaaatatgcatcacccacatccagtactgttactga

SEQ ID NO: 1021 - DNA, 40 bp, Artificial Sequence
  synthetic sequence
tggtaaatgcagtatacttcctgaagtcttcatctaaggg

SEQ ID NO: 1022 - DNA, 40 bp, Artificial Sequence
  synthetic sequence
actgatatctaatccctggtgtctcattgtttatactagg

SEQ ID NO: 1023 - DNA, 40 bp, Artificial Sequence
  synthetic sequence
atattgctggtgatcctttccatccctgtggaagcacatt

SEQ ID NO: 1024 - DNA, 40 bp, Artificial Sequence
  synthetic sequence
gttttctaaaaggctctaagatttttgtcatgctactttg

SEQ ID NO: 1025 - DNA, 40 bp, Artificial Sequence
  synthetic sequence
acaaatcatccatgtattgatagataactatgtctggatt

SEQ ID NO: 1026 - DNA, 40 bp, Artificial Sequence
  synthetic sequence
tttttgttctatgctgccctatttctaagtcagatcctac

SEQ ID NO: 1027 - DNA, 40 bp, Artificial Sequence
  synthetic sequence
tggtaagtccccacctcaacagatgttgtctcagctcctc

SEQ ID NO: 1028 - DNA, 40 bp, Artificial Sequence
  synthetic sequence
taggctgtactgtccatttatcaggatggagttcataacc

SEQ ID NO: 1029 - DNA, 40 bp, Artificial Sequence
  synthetic sequence
gtatgtcattgacagtccagctgtctttttctggcagcac

SEQ ID NO: 1030 - DNA, 40 bp, Artificial Sequence
  synthetic sequence
ggtaaatctgacttgcccaattcaatttccccactaactt

SEQ ID NO: 1031 - DNA, 40 bp, Artificial Sequence
  synthetic sequence
ttcctctaaggagtttacataattgccttactttaatccc

SEQ ID NO: 1032 - DNA, 40 bp, Artificial Sequence
  synthetic sequence
ctgcttcttctgttagtggtattacttctgttagtgcttt

SEQ ID NO: 1033 - DNA, 40 bp, Artificial Sequence
  synthetic sequence
ctgctattaagtcttttgatgggtcataatacactccatg

SEQ ID NO: 1034 - DNA, 40 bp, Artificial Sequence
  synthetic sequence
aaatttgatatgtccattggccttgcccctgcttctgtat

SEQ ID NO: 1035 - DNA, 40 bp, Artificial Sequence
  synthetic sequence
ctgttaattgttttacatcattagtgtgggcacccctcat

SEQ ID NO: 1036 - DNA, 40 bp, Artificial Sequence
  synthetic sequence
atgtttccttttgtatgggcagtttaaatttaggagtctt

SEQ ID NO: 1037 - DNA, 40 bp, Artificial Sequence
  synthetic sequence
gaatccaggtggcttgccaatactctgtccaccatgtttc

SEQ ID NO: 1038 - DNA, 40 bp, Artificial Sequence
  synthetic sequence
ataatttcactaagggaggggtattaacaaactcccactc

SEQ ID NO: 1039 - DNA, 40 bp, Artificial Sequence
  synthetic sequence
aggtttctgctcctactatgggttctttctctaactggta

SEQ ID NO: 1040 - DNA, 40 bp, Artificial Sequence
  synthetic sequence
ttcctaatttagtctccctgttagctgccccatctacata

SEQ ID NO: 1041 - DNA, 40 bp, Artificial Sequence
  synthetic sequence
ttgcttgtaactcagtcttctgatttgttgtgtcagttag

SEQ ID NO: 1042 - DNA, 40 bp, Artificial Sequence
  synthetic sequence
ctatgtttacttctaatcccgaatcctgcaaagctagata

SEQ ID NO: 1043 - DNA, 40 bp, Artificial Sequence
  synthetic sequence
gttgtgcttgaatgattcctaatgcatattgtgagtctgt

SEQ ID NO: 1044 - DNA, 40 bp, Artificial Sequence
  synthetic sequence
gctctattatttgattgactaactctgattcactttgatc

SEQ ID NO: 1045 - DNA, 40 bp, Artificial Sequence
  synthetic sequence
tccaattactgtgatatttctcatgttcatcttgggcctt

SEQ ID NO: 1046 - DNA, 40 bp, Artificial Sequence
  synthetic sequence
ttgctactacaggtggcaggttaaaatcactagccattgc

SEQ ID NO: 1047 - DNA, 40 bp, Artificial Sequence
  synthetic sequence
ctccttttagctgacatttatcacagctggctactatttc

SEQ ID NO: 1048 - DNA, 40 bp, Artificial Sequence
  synthetic sequence
ctaccaggataacttttccttctaaatgtgtacaatctag

SEQ ID NO: 1049 - DNA, 40 bp, Artificial Sequence
  synthetic sequence
gaataacttctgcttctatatatccactggctacatgaac

SEQ ID NO: 1050 - DNA, 40 bp, Artificial Sequence
  synthetic sequence
accaacaggcggccctaaccgtagcaccggtgaaattgct

SEQ ID NO: 1051 - DNA, 40 bp, Artificial Sequence
  synthetic sequence
ggggattgtagggaattccaaattcctgcttgattcccgc

SEQ ID NO: 1052 - DNA, 40 bp, Artificial Sequence
  synthetic sequence
tcttaagatgttcagcctgatctcttacctgtcctataat

SEQ ID NO: 1053 - DNA, 40 bp, Artificial Sequence
  synthetic sequence
ctactattctttcccctgcactgtaccccccaatcccccc

SEQ ID NO: 1054 - DNA, 40 bp, Artificial Sequence
  synthetic sequence
tccagaggagctttgctggtcctttccaaagtggatttct

SEQ ID NO: 1055 - DNA, 40 bp, Artificial Sequence
  synthetic sequence
ttatgtcactattatcttgtattactactgccccttcacc

SEQ ID NO: 1056 - DNA, 40 bp, Artificial Sequence
  synthetic sequence
cctgtctacttgccacacaatcatcacctgccatctgttt

SEQ ID NO: 1057 - DNA, 40 bp, Artificial Sequence
  synthetic sequence
catatggtgttttactaaacttttccatgttctaatcctc

SEQ ID NO: 1058 - DNA, 40 bp, Artificial Sequence
  synthetic sequence
gtgatgtctataaaaccatcccctagctttccctgaaaca

SEQ ID NO: 1059 - DNA, 40 bp, Artificial Sequence
  synthetic sequence
gatgtgtacttctgaacttattcttggatgagggctttca

SEQ ID NO: 1060 - DNA, 40 bp, Artificial Sequence
  synthetic sequence
accccaatatgttgttattaccaatctagcatcccctagt

SEQ ID NO: 1061 - DNA, 40 bp, Artificial Sequence
  synthetic sequence
gtcaaagtaatacagatgaattagttggtctgctagttca

SEQ ID NO: 1062 - DNA, 40 bp, Artificial Sequence
  synthetic sequence
gtgtcctaataaggcctttcttatagcagagtctgaaaaa

SEQ ID NO: 1063 - DNA, 40 bp, Artificial Sequence
  synthetic sequence
cttgttatgtcctgcttgatattcacacctagggctaact

SEQ ID NO: 1064 - DNA, 40 bp, Artificial Sequence
  synthetic sequence
tgttattaatgctgctagtgccaagtattgtagagatcct

SEQ ID NO: 1065 - DNA, 40 bp, Artificial Sequence
  synthetic sequence
cagtttcgtaacactaggcaaaggtggctttatctttttt

SEQ ID NO: 1066 - DNA, 40 bp, Artificial Sequence
  synthetic sequence
gtggcccttggtcttctggggcttgttccatctatcctct

SEQ ID NO: 1067 - DNA, 40 bp, Artificial Sequence
  synthetic sequence
cctctaaaagctctagtgtccattcattgtgtggctccct

SEQ ID NO: 1068 - DNA, 40 bp, Artificial Sequence
  synthetic sequence
gccaaatcctaggaaaatgtctaacagcttcattcttaag

SEQ ID NO: 1069 - DNA, 40 bp, Artificial Sequence
  synthetic sequence
tatccccataagtttcatagatatgttgccctaagccatg

SEQ ID NO: 1070 - DNA, 40 bp, Artificial Sequence
  synthetic sequence
gttgttgcagaattcttattatggcttccactcctgccca

SEQ ID NO: 1071 - DNA, 40 bp, Artificial Sequence
  synthetic sequence
tctgctatgtcgacacccaattctgaaaatggataaacag

SEQ ID NO: 1072 - DNA, 40 bp, Artificial Sequence
  synthetic sequence
actggctccatttcttgctctcctctgtcgagtaacgcct

SEQ ID NO: 1073 - DNA, 40 bp, Artificial Sequence
  synthetic sequence
ggctgacttcctggatgcttccagggctctagtctaggat

SEQ ID NO: 1074 - DNA, 40 bp, Artificial Sequence
  synthetic sequence
gagatgcctaaggcttttgttatgaaacaaacttggcaat

SEQ ID NO: 1075 - DNA, 40 bp, Artificial Sequence
  synthetic sequence
tgatgagctcttcgtcgctgtctccgcttcttcctgccat

SEQ ID NO: 1076 - DNA, 40 bp, Artificial Sequence
  synthetic sequence
acttactgctttgatagagaagcttgatgagtctgactgt

SEQ ID NO: 1077 - DNA, 40 bp, Artificial Sequence
  synthetic sequence
gctactattgctactattggtataggttgcattacatgta

SEQ ID NO: 1078 - DNA, 40 bp, Artificial Sequence
  synthetic sequence
ctgtcttctgctctttctattagtctatcaattaacctgt

SEQ ID NO: 1079 - DNA, 40 bp, Artificial Sequence
  synthetic sequence
tcatcaacatcccaaggagcatggtgccccatctccaccc

SEQ ID NO: 1080 - DNA, 40 bp, Artificial Sequence
  synthetic sequence
cataatagactgtgacccacaatttttctgtagcactaca

SEQ ID NO: 1081 - DNA, 40 bp, Artificial Sequence
  synthetic sequence
cacaaaatagagtggtggttgcttccttccacacaggtac

SEQ ID NO: 1082 - DNA, 40 bp, Artificial Sequence
  synthetic sequence
aaacattatgtacctctgtatcatatgctttagcatctga

SEQ ID NO: 1083 - DNA, 40 bp, Artificial Sequence
  synthetic sequence
cttgtgggttggggtctgtgggtacacaggcatgtgtggc

SEQ ID NO: 1084 - DNA, 40 bp, Artificial Sequence
  synthetic sequence
aactgattatatcctcatgcatctgttctaccatgtcatt

SEQ ID NO: 1085 - DNA, 40 bp, Artificial Sequence
  synthetic sequence
gtggggttaattttacacatggctttaggctttgatccca

SEQ ID NO: 1086 - DNA, 40 bp, Artificial Sequence
  synthetic sequence
tagtatcattcttcaaatcagtgcactttaaactaacaca

SEQ ID NO: 1087 - DNA, 40 bp, Artificial Sequence
  synthetic sequence
ctcctttctccattatcattctcccgctactactattggt

SEQ ID NO: 1088 - DNA, 40 bp, Artificial Sequence
  synthetic sequence
ttgtcaacttatagctggtagtatcattatctattggtat

SEQ ID NO: 1089 - DNA, 40 bp, Artificial Sequence
  synthetic sequence
atacctttggacaggcctgtgtaatgactgaggtgttaca

SEQ ID NO: 1090 - DNA, 40 bp, Artificial Sequence
  synthetic sequence
ttccatgtgtacattgtactgtgctgacatttgtacatgg

SEQ ID NO: 1091 - DNA, 40 bp, Artificial Sequence
  synthetic sequence
gactgccatttaacagcagttgagttgatactactggcct

SEQ ID NO: 1092 - DNA, 40 bp, Artificial Sequence
  synthetic sequence
ccgtgaaattgacagatctaattactacctcttcttctgc

SEQ ID NO: 1093 - DNA, 40 bp, Artificial Sequence
  synthetic sequence
ctacagatgtgttcagctgtactattatggttttagcatt

SEQ ID NO: 1094 - DNA, 40 bp, Artificial Sequence
  synthetic sequence
ctattgtaacaaatgctctccctggtcctctctggatacg

SEQ ID NO: 1095 - DNA, 40 bp, Artificial Sequence
  synthetic sequence
tactaatgttacaatgtgcttgtctcatatttcctatttt

SEQ ID NO: 1096 - DNA, 40 bp, Artificial Sequence
  synthetic sequence
atttgctagctatctgttttaaagtgttattccattttgc

SEQ ID NO: 1097 - DNA, 40 bp, Artificial Sequence
  synthetic sequence
taaaactgtgcgttacaatttctgggtcccctcctgagga

SEQ ID NO: 1098 - DNA, 40 bp, Artificial Sequence
  synthetic sequence
acagttgtgttgaattacagtagaaaaattcccctccaca

SEQ ID NO: 1099 - DNA, 40 bp, Artificial Sequence
  synthetic sequence
acccttcagtactccaagtactattaaaccaagtactatt

SEQ ID NO: 1100 - DNA, 40 bp, Artificial Sequence
  synthetic sequence
tgcatgggagggtgattgtgtcacttccttcagtgttatt

SEQ ID NO: 1101 - DNA, 40 bp, Artificial Sequence
  synthetic sequence
atgaacatctaatttgtccactgatgggaggggcatacat

SEQ ID NO: 1102 - DNA, 40 bp, Artificial Sequence
  synthetic sequence
tattaccaccatctcttgttaatagcagccctgtaatatt

SEQ ID NO: 1103 - DNA, 40 bp, Artificial Sequence
  synthetic sequence
tatctcctcctccaggtctgaagatctcggactcattgtt

SEQ ID NO: 1104 - DNA, 40 bp, Artificial Sequence
  synthetic sequence
gtggtagctgaagaggcacaggctccgcagatcgtcccag

SEQ ID NO: 1105 - DNA, 40 bp, Artificial Sequence
  synthetic sequence
ttccacaatcctcgttacaatcaagagtaagtctctcaag

SEQ ID NO: 1106 - DNA, 40 bp, Artificial Sequence
  synthetic sequence
ccaccaatatttgagggcttcccaccccctgcgtcccaga

SEQ ID NO: 1107 - DNA, 40 bp, Artificial Sequence
  synthetic sequence
agcactattctttagttcctgactccaatactgtaggaga

SEQ ID NO: 1108 - DNA, 40 bp, Artificial Sequence
  synthetic sequence
cccctcagctactgctatggctgtggcattgagcaagcta

SEQ ID NO: 1109 - DNA, 40 bp, Artificial Sequence
  synthetic sequence
agctctacaagctccttgtactacttctataaccctatct

SEQ ID NO: 1110 - DNA, 40 bp, Artificial Sequence
  synthetic sequence
acactactttttgaccacttgccacccatcttatagcaaa

SEQ ID NO: 1111 - DNA, 40 bp, Artificial Sequence
  synthetic sequence
tcagctcgtctcattctttcccttacagtaggccatccaa

SEQ ID NO: 1112 - DNA, 40 bp, Artificial Sequence
  synthetic sequence
tccaggtctcgagatgctgctcccaccctatctgctgctg

SEQ ID NO: 1113 - DNA, 40 bp, Artificial Sequence
  synthetic sequence
ttggtagctgctgtattgctacttgtgattgctccatgtt

SEQ ID NO: 1114 - DNA, 40 bp, Artificial Sequence
  synthetic sequence
gtcattggtcttaaaggtacctgaggtgtgactggaaaac

SEQ ID NO: 1115 - DNA, 40 bp, Artificial Sequence
  synthetic sequence
tcttgtcttctttgggagtgaattagcccttccagtcccc

SEQ ID NO: 1116 - DNA, 40 bp, Artificial Sequence
  synthetic sequence
gggaagtagccttgtgtgtggtagatccacagatcaagga

SEQ ID NO: 1117 - DNA, 40 bp, Artificial Sequence
  synthetic sequence
ggatatctgacccctggccctggtgtgtagttctgctaat

SEQ ID NO: 1118 - DNA, 40 bp, Artificial Sequence
  synthetic sequence
ggctcaactggtactagcttgtagcaccatccaaaggtca

SEQ ID NO: 1119 - DNA, 40 bp, Artificial Sequence
  synthetic sequence
aagctggtgttctctcctttattggcctcttctatcttat

SEQ ID NO: 1120 - DNA, 40 bp, Artificial Sequence
  synthetic sequence
ctctccgggtcatccatcccatgcaggctcacagggtgta

SEQ ID NO: 1121 - DNA, 40 bp, Artificial Sequence
  synthetic sequence
tgaaatgctaggcggctgtcaaacctccactctaacactt

SEQ ID NO: 1122 - DNA, 40 bp, Artificial Sequence
  synthetic sequence
cagttcttgaagtactccggatgcagctctcgggccacgt

SEQ ID NO: 1123 - DNA, 40 bp, Artificial Sequence
  synthetic sequence
tttcccctgcactgtaccccccaatccccccttttctttt

SEQ ID NO: 1124 - DNA, 40 bp, Artificial Sequence
  synthetic sequence
tggtgccgatgtccaggccgatgctgtacttcttgtccat

SEQ ID NO: 1125 - DNA, 40 bp, Artificial Sequence
  synthetic sequence
gcaccttgtactcgtcggtgatcacggcccagcccacaga

SEQ ID NO: 1126 - DNA, 40 bp, Artificial Sequence
  synthetic sequence
tgtgccggtcggtgttgcccagcaccttgaatttcttgct

SEQ ID NO: 1127 - DNA, 40 bp, Artificial Sequence
  synthetic sequence
cgctgtcgaacagcagggctccgatcaggttcttcttgat

SEQ ID NO: 1128 - DNA, 40 bp, Artificial Sequence
  synthetic sequence
ttctggcggttctcttcagccgggtggcctcggctgtttc

SEQ ID NO: 1129 - DNA, 40 bp, Artificial Sequence
  synthetic sequence
cttgcagatagcagatccggttcttccgtctggtgtatct

SEQ ID NO: 1130 - DNA, 40 bp, Artificial Sequence
  synthetic sequence
agaagctgtcgtccaccttggccatctcgttgctgaagat

SEQ ID NO: 1131 - DNA, 40 bp, Artificial Sequence
  synthetic sequence
cctcgtccacgatgttgccgaagatggggtgccgctcgtg

SEQ ID NO: 1132 - DNA, 40 bp, Artificial Sequence
  synthetic sequence
ttctcaggtggtagatggtggggtacttctcgtggtaggc

SEQ ID NO: 1133 - DNA, 40 bp, Artificial Sequence
  synthetic sequence
tcagccgcaggtcggccttgtcggtgctgtccaccagttt

SEQ ID NO: 1134 - DNA, 40 bp, Artificial Sequence
  synthetic sequence
agtggccccggaacttgatcatgtgggccagggccagata

SEQ ID NO: 1135 - DNA, 40 bp, Artificial Sequence
  synthetic sequence
ccacgtcgctgttgtcggggttcaggtcgccctcgatcag

SEQ ID NO: 1136 - DNA, 40 bp, Artificial Sequence
  synthetic sequence
acagctggttgtaggtctgcaccagctggatgaacagctt

SEQ ID NO: 1137 - DNA, 40 bp, Artificial Sequence
  synthetic sequence
ccttggcgtccacgccgctggcgttgatggggttttcctc

SEQ ID NO: 1138 - DNA, 40 bp, Artificial Sequence
  synthetic sequence
tttccagccgtctgctcttgctcagtctggcagacaggat

SEQ ID NO: 1139 - DNA, 40 bp, Artificial Sequence
  synthetic sequence
acaggccattcttcttctcgccgggcagctgggcgatcag

SEQ ID NO: 1140 - DNA, 40 bp, Artificial Sequence
  synthetic sequence
gctgcagtttggcatcctcggccaggtcgaagttgctctt

SEQ ID NO: 1141 - DNA, 40 bp, Artificial Sequence
  synthetic sequence
ccagcaggttgtccaggtcgtcgtcgtaggtgtccttgct

SEQ ID NO: 1142 - DNA, 40 bp, Artificial Sequence
  synthetic sequence
tggcggccagaaacaggtcggcgtactggtcgccgatctg

SEQ ID NO: 1143 - DNA, 40 bp, Artificial Sequence
  synthetic sequence
ctctcaggatgtcgctcagcaggatggcgtcggacaggtt

SEQ ID NO: 1144 - DNA, 40 bp, Artificial Sequence
  synthetic sequence
tcatagaggcgctcaggggggccttggtgatctcggtgtt

SEQ ID NO: 1145 - DNA, 40 bp, Artificial Sequence
  synthetic sequence
tcagcagggtcaggtcctggtggtgctcgtcgtatctctt

SEQ ID NO: 1146 - DNA, 40 bp, Artificial Sequence
  synthetic sequence
caatgtagccggcgtagccgttcttgctctggtcgaagaa

SEQ ID NO: 1147 - DNA, 40 bp, Artificial Sequence
  synthetic sequence
gcttgatgaacttgtagaactcttcctggctggctccgcc

SEQ ID NO: 1148 - DNA, 40 bp, Artificial Sequence
  synthetic sequence
tcacgagcagttcctcggtgccgtccatcttttccaggat

SEQ ID NO: 1149 - DNA, 40 bp, Artificial Sequence
  synthetic sequence
gcagctctcccaggtggatctggtgggggatgctgccgtt

SEQ ID NO: 1150 - DNA, 40 bp, Artificial Sequence
  synthetic sequence
tcaggaatgggtaaaaatcttcctgccgccgcagaatggc

SEQ ID NO: 1151 - DNA, 40 bp, Artificial Sequence
  synthetic sequence
tgcggaaggtcaggatcttctcgatcttttcccggttgtc

SEQ ID NO: 1152 - DNA, 40 bp, Artificial Sequence
  synthetic sequence
atctgctgtttcccctggccagagggcccacgtagtaggg

SEQ ID NO: 1153 - DNA, 40 bp, Artificial Sequence
  synthetic sequence
agggggtgatggtttcctcgctctttctggtcatccaggc

SEQ ID NO: 1154 - DNA, 40 bp, Artificial Sequence
  synthetic sequence
tctgggcggaagcgcccttgtccaccacttcctcgaagtt

SEQ ID NO: 1155 - DNA, 40 bp, Artificial Sequence
  synthetic sequence
tgggcaggttcttatcgaagttggtcatccgctcgatgaa

SEQ ID NO: 1156 - DNA, 40 bp, Artificial Sequence
  synthetic sequence
agtactcgtacagcaggctgtgcttgggcagcaccttctc

SEQ ID NO: 1157 - DNA, 40 bp, Artificial Sequence
  synthetic sequence
cggtcacgtatttcactttggtcagctcgttatacacggt

SEQ ID NO: 1158 - DNA, 40 bp, Artificial Sequence
  synthetic sequence
ttttctgctcgccgctcaggaaggcgggctttctcattcc

SEQ ID NO: 1159 - DNA, 40 bp, Artificial Sequence
  synthetic sequence
tcactttccggttggtcttgaacagcaggtccacgatggc

SEQ ID NO: 1160 - DNA, 40 bp, Artificial Sequence
  synthetic sequence
actcgattttcttgaagtagtcctctttcagctgcttcac

SEQ ID NO: 1161 - DNA, 40 bp, Artificial Sequence
  synthetic sequence
tgaaccgatcttccacgccggagatttccacggagtcgaa

SEQ ID NO: 1162 - DNA, 40 bp, Artificial Sequence
  synthetic sequence
gaatgtcctcgttttcctcattgtccaggaagtccttgtc

SEQ ID NO: 1163 - DNA, 40 bp, Artificial Sequence
  synthetic sequence
ctctgtcctcaaacagtgtcagggtcagcacgatatcttc

SEQ ID NO: 1164 - DNA, 40 bp, Artificial Sequence
  synthetic sequence
cgaacaggtgggcataggttttcagccgttcctcgatcat

SEQ ID NO: 1165 - DNA, 40 bp, Artificial Sequence
  synthetic sequence
cggtgtatctccgccgcttcagctgcttcatcactttgtc

SEQ ID NO: 1166 - DNA, 40 bp, Artificial Sequence
  synthetic sequence
cccggatgccgttgatcagcttccggctcagcctgcccca

SEQ ID NO: 1167 - DNA, 40 bp, Artificial Sequence
  synthetic sequence
cggacttcaggaaatccaggattgtcttgccggactgctt

SEQ ID NO: 1168 - DNA, 40 bp, Artificial Sequence
  synthetic sequence
cgtcgtggatcagctgcatgaagtttctgttggcgaagcc

SEQ ID NO: 1169 - DNA, 40 bp, Artificial Sequence
  synthetic sequence
acacctgggctttctggatgtcctctttaaaggtcaggct

SEQ ID NO: 1170 - DNA, 40 bp, Artificial Sequence
  synthetic sequence
tcactgtctgcaggatgcccttcttaatggcggggctgcc

SEQ ID NO: 1171 - DNA, 40 bp, Artificial Sequence
  synthetic sequence
gcttgtgccggcccatcactttcacgagctcgtccaccac

SEQ ID NO: 1172 - DNA, 40 bp, Artificial Sequence
  synthetic sequence
tggtctggttctctctggccatttcgatcacgatgttctc

SEQ ID NO: 1173 - DNA, 40 bp, Artificial Sequence
  synthetic sequence
tccgcttcattctctcgcggctgttcttctgtcccttctg

SEQ ID NO: 1174 - DNA, 40 bp, Artificial Sequence
  synthetic sequence
ctttcaggatctggctgcccagctctttgatgccctcttc

SEQ ID NO: 1175 - DNA, 40 bp, Artificial Sequence
  synthetic sequence
acagcttctcgttctgcagctgggtgttttccacggggtg

SEQ ID NO: 1176 - DNA, 40 bp, Artificial Sequence
  synthetic sequence
ggtccacgtacatatcccgcccattctgcaggtagtacag

SEQ ID NO: 1177 - DNA, 40 bp, Artificial Sequence
  synthetic sequence
ggtccacatcgtagtcggacagccggttgatgtccagttc

SEQ ID NO: 1178 - DNA, 40 bp, Artificial Sequence
  synthetic sequence
tgtcgatggagtcgtccttcagaaagctctgaggcacgat

SEQ ID NO: 1179 - DNA, 40 bp, Artificial Sequence
  synthetic sequence
cgctcttgccccggttcttgtcgcttctggtcagcacctt

SEQ ID NO: 1180 - DNA, 40 bp, Artificial Sequence
  synthetic sequence
agttcttcatcttcttcacgacctcttcggagggcacgtt

SEQ ID NO: 1181 - DNA, 40 bp, Artificial Sequence
  synthetic sequence
ttctctgggtaatcagcttggcgttcagcagctgccgcca

SEQ ID NO: 1182 - DNA, 40 bp, Artificial Sequence
  synthetic sequence
cgctcaggccgcctctctcggccttggtcagattgtcgaa

SEQ ID NO: 1183 - DNA, 40 bp, Artificial Sequence
  synthetic sequence
tttccaccagctgtctcttgatgaagccggccttatccag

SEQ ID NO: 1184 - DNA, 40 bp, Artificial Sequence
  synthetic sequence
gggagtccaggatctgtgccacgtgctttgtgatctgccg

SEQ ID NO: 1185 - DNA, 40 bp, Artificial Sequence
  synthetic sequence
cccggatcagcttgtcattctcgtcgtacttagtgttcat

SEQ ID NO: 1186 - DNA, 40 bp, Artificial Sequence
  synthetic sequence
aatcggacaccagcttggacttcagggtgatcactttcac

SEQ ID NO: 1187 - DNA, 40 bp, Artificial Sequence
  synthetic sequence
ccacgacggcgttcaggtaggcgtcgtgggcgtggtggta

SEQ ID NO: 1188 - DNA, 40 bp, Artificial Sequence
  synthetic sequence
actcgctttccagcttagggtactttttgatcagggcggt

SEQ ID NO: 1189 - DNA, 40 bp, Artificial Sequence
  synthetic sequence
tcatcttccgcacgtcgtacaccttgtagtcgccgtacac

SEQ ID NO: 1190 - DNA, 40 bp, Artificial Sequence
  synthetic sequence
acttggcggtagccttgccgatttcctgctcgctcttggc

SEQ ID NO: 1191 - DNA, 40 bp, Artificial Sequence
  synthetic sequence
tctcggtcttgaaaaagttcatgatgttgctgtagaagaa

SEQ ID NO: 1192 - DNA, 40 bp, Artificial Sequence
  synthetic sequence
cgatcagaggccgcttccggatctcgccgttggccagggt

SEQ ID NO: 1193 - DNA, 40 bp, Artificial Sequence
  synthetic sequence
ggcccttatcccacacgatctccccggtttcgccgtttgt

SEQ ID NO: 1194 - DNA, 40 bp, Artificial Sequence
  synthetic sequence
cttggggcatgctcagcactttccgcacggtggcaaaatc

SEQ ID NO: 1195 - DNA, 40 bp, Artificial Sequence
  synthetic sequence
tgaagccgcctgtctgcacctcggtctttttcacgatatt

SEQ ID NO: 1196 - DNA, 40 bp, Artificial Sequence
  synthetic sequence
tcagcttatcgctgttcctcttgggcaggatagactcttt

SEQ ID NO: 1197 - DNA, 40 bp, Artificial Sequence
  synthetic sequence
agccgccgtacttcttagggtcccagtccttctttctggc

SEQ ID NO: 1198 - DNA, 40 bp, Artificial Sequence
  synthetic sequence
tctcgaagctgcttctttccatgatggtgatccccagtag

SEQ ID NO: 1199 - DNA, 40 bp, Artificial Sequence
  synthetic sequence
cttctttgtagcccttggcttccagaaagtcgatgggatt

SEQ ID NO: 1200 - DNA, 40 bp, Artificial Sequence
  synthetic sequence
acagggagtacttaggcagcttgatgatcaggtccttttt

SEQ ID NO: 1201 - DNA, 40 bp, Artificial Sequence
  synthetic sequence
cggcagaggccagcattctcttccggccgttttccagctc

SEQ ID NO: 1202 - DNA, 40 bp, Artificial Sequence
  synthetic sequence
atttggagggcagggccagttcgtttcccttctgcagttc

SEQ ID NO: 1203 - DNA, 40 bp, Artificial Sequence
  synthetic sequence
tcagcttctcatagtggctggccaggtacaggaagttcac

SEQ ID NO: 1204 - DNA, 40 bp, Artificial Sequence
  synthetic sequence
ccacaaacagctgtttctgctcattatcctcgggggagcc

SEQ ID NO: 1205 - DNA, 40 bp, Artificial Sequence
  synthetic sequence
tgatctgctcgatgatctcgtccaggtagtgcttgtgctg

SEQ ID NO: 1206 - DNA, 40 bp, Artificial Sequence
  synthetic sequence
ccagattagcgtcggccaggatcactctcttggagaactc

SEQ ID NO: 1207 - DNA, 40 bp, Artificial Sequence
  synthetic sequence
tgggcttatcccggtgcttgttgtaggcggacagcacttt

SEQ ID NO: 1208 - DNA, 40 bp, Artificial Sequence
  synthetic sequence
tcagggtaaacaggtggatgatattctcggcctgctctct

SEQ ID NO: 1209 - DNA, 40 bp, Artificial Sequence
  synthetic sequence
tggtgtcaaagtacttgaaggcggcaggggctcccagatt

SEQ ID NO: 1210 - DNA, 40 bp, Artificial Sequence
  synthetic sequence
ccagcacctctttggtgctggtgtacctcttccggtcgat

SEQ ID NO: 1211 - DNA, 40 bp, Artificial Sequence
  synthetic sequence
tctcgtacaggccggtgatgctctggtggatcagggtggc

SEQ ID NO: 1212 - DNA, 40 bp, Artificial Sequence
  synthetic sequence
agtcgccgcccctcgcctcttgccgtgcgcgcttcagcaa

SEQ ID NO: 1213 - DNA, 40 bp, Artificial Sequence
  synthetic sequence
aatactgacgctctcgcacccatctctctccttctagcct

SEQ ID NO: 1214 - DNA, 40 bp, Artificial Sequence
  synthetic sequence
gatgtttctaacaggccaggattaactgcgaatcgttcta

SEQ ID NO: 1215 - DNA, 40 bp, Artificial Sequence
  synthetic sequence
tgatctaagttcttctgatcctgtctgaagggatggttgt

SEQ ID NO: 1216 - DNA, 40 bp, Artificial Sequence
  synthetic sequence
aagcttccttggtgtcttttatctctatcctttgatgcac

SEQ ID NO: 1217 - DNA, 40 bp, Artificial Sequence
  synthetic sequence
gaagatcagcggccggccgcttgctgtgcggtggtcttac

SEQ ID NO: 1218 - DNA, 40 bp, Artificial Sequence
  synthetic sequence
cgtcagcgtcattgacgctgcgcccatagtgcttcctgct

SEQ ID NO: 1219 - DNA, 40 bp, Artificial Sequence
  synthetic sequence
gcgcctcaatagccctcagcaaattgttctgctgctgcac

SEQ ID NO: 1220 - DNA, 40 bp, Artificial Sequence
  synthetic sequence
ctttccacagccaggattcttgcctggagctgcttgatgc

SEQ ID NO: 1221 - DNA, 40 bp, Artificial Sequence
  synthetic sequence
cacagcagtggtgcaaatgagttttccagagcaaccccaa

SEQ ID NO: 1222 - DNA, 40 bp, Artificial Sequence
  synthetic sequence
cccactccatccaggtcgtgtgattccaaatctgttccag

SEQ ID NO: 1223 - DNA, 40 bp, Artificial Sequence
  synthetic sequence
ttttcttgctggttttgcgattcttcaattaaggagtgta

SEQ ID NO: 1224 - DNA, 40 bp, Artificial Sequence
  synthetic sequence
ccaatttgttatgttaaaccaattccacaaacttgcccat

SEQ ID NO: 1225 - DNA, 40 bp, Artificial Sequence
  synthetic sequence
gtacagcaaaaactattcttaaacctaccaagcctcctac

SEQ ID NO: 1226 - DNA, 40 bp, Artificial Sequence
  synthetic sequence
ctcggggttgggaggtgggtctgaaacgataatggtgaat

SEQ ID NO: 1227 - DNA, 40 bp, Artificial Sequence
  synthetic sequence
tctttcccctgcactgtaccccccaatccccccttttctt

SEQ ID NO: 1228 - DNA, 40 bp, Artificial Sequence
  synthetic sequence
gtaatccagaggttgattgttccagacgcggtctagatta

SEQ ID NO: 1229 - DNA, 40 bp, Artificial Sequence
  synthetic sequence
aagcagcgtatccacatagcgtaaaaggagcaacatagtt

SEQ ID NO: 1230 - DNA, 40 bp, Artificial Sequence
  synthetic sequence
aaccaggatttatacaaggaggagaaaatgaaagccatac

SEQ ID NO: 1231 - DNA, 40 bp, Artificial Sequence
  synthetic sequence
gtcagcaaacacagtgcacaccacgccacgttgcctgaca

SEQ ID NO: 1232 - DNA, 40 bp, Artificial Sequence
  synthetic sequence
ggagggggaaagcgaaagtcccggaaaggagctgacaggt

SEQ ID NO: 1233 - DNA, 40 bp, Artificial Sequence
  synthetic sequence
gtgcccaacagccgagcccctgtccagcagcgggcaaggc

SEQ ID NO: 1234 - DNA, 40 bp, Artificial Sequence
  synthetic sequence
ccaggtggcaacacaggcgagcagccatggaaaggacgtc

SEQ ID NO: 1235 - DNA, 40 bp, Artificial Sequence
  synthetic sequence
ggccgcgggaaggaaggtccgctggattgagggccgaagg

SEQ ID NO: 1236 - DNA, 40 bp, Artificial Sequence
  synthetic sequence
gcccaaagggagatccgactcgtctgagggcgaaggcgaa

SEQ ID NO: 1237 - DNA, 40 bp, Artificial Sequence
  synthetic sequence
tattgctacttgtgattgctccatgtttttctaggtctcg

SEQ ID NO: 1238 - DNA, 40 bp, Artificial Sequence
  synthetic sequence
gaaaccagaggagctctctcgacgcaggactcggcttgct

SEQ ID NO: 1239 - DNA, 40 bp, Artificial Sequence
  synthetic sequence
cgactggtgagtacgccaaaaattttgactagcggaggct

SEQ ID NO: 1240 - DNA, 40 bp, Artificial Sequence
  synthetic sequence
gtattaagcgggggagaattagatcgcgatgggaaaaaat

SEQ ID NO: 1241 - DNA, 40 bp, Artificial Sequence
  synthetic sequence
taaattaaaacatatagtatgggcaagcagggagctagaa

SEQ ID NO: 1242 - DNA, 40 bp, Artificial Sequence
  synthetic sequence
acatcagaaggctgtagacaaatactgggacagctacaac

SEQ ID NO: 1243 - DNA, 40 bp, Artificial Sequence
  synthetic sequence
gatcattatataatacagtagcaaccctctattgtgtgca

SEQ ID NO: 1244 - DNA, 40 bp, Artificial Sequence
  synthetic sequence
tcttcagacctggaggaggagatatgagggacaattggag

SEQ ID NO: 1245 - DNA, 40 bp, Artificial Sequence
  synthetic sequence
aattgaaccattaggagtagcacccaccaaggcaaagaga

SEQ ID NO: 1246 - DNA, 40 bp, Artificial Sequence
  synthetic sequence
ggaataggagctttgttccttgggttcttgggagcagcag

SEQ ID NO: 1247 - DNA, 40 bp, Artificial Sequence
  synthetic sequence
tgacggtacaggccagacaattattgtctggtatagtgca

SEQ ID NO: 1248 - DNA, 40 bp, Artificial Sequence
  synthetic sequence
ggcgcaacagcatctgttgcaactcacagtctggggcatc

SEQ ID NO: 1249 - DNA, 40 bp, Artificial Sequence
  synthetic sequence
gaaagatacctaaaggatcaacagctcctggggatttggg

SEQ ID NO: 1250 - DNA, 40 bp, Artificial Sequence
  synthetic sequence
ctgtgccttggaatgctagttggagtaataaatctctgga

SEQ ID NO: 1251 - DNA, 40 bp, Artificial Sequence
  synthetic sequence
gtgggacagagaaattaacaattacacaagcttaatacac

SEQ ID NO: 1252 - DNA, 40 bp, Artificial Sequence
  synthetic sequence
tgtactttctatagtgaatagagttaggcagggatattca

SEQ ID NO: 1253 - DNA, 40 bp, Artificial Sequence
  synthetic sequence
ccgaggggacccgacaggcccgaaggaatagaagaagaag

SEQ ID NO: 1254 - DNA, 40 bp, Artificial Sequence
  synthetic sequence
gattagtgaacggatctcgacggtatcgcctttaaaagaa

SEQ ID NO: 1255 - DNA, 40 bp, Artificial Sequence
  synthetic sequence
aaagaatagtagacataatagcaacagacatacaaactaa

SEQ ID NO: 1256 - DNA, 40 bp, Artificial Sequence
  synthetic sequence
aaattttcgggtttattacagggacagcagagatccagtt

SEQ ID NO: 1257 - DNA, 40 bp, Artificial Sequence
  synthetic sequence
attacaaaatttgtgaaagattgactggtattcttaacta

SEQ ID NO: 1258 - DNA, 40 bp, Artificial Sequence
  synthetic sequence
tgctttaatgcctttgtatcatgctattgcttcccgtatg

SEQ ID NO: 1259 - DNA, 40 bp, Artificial Sequence
  synthetic sequence
tggttgctgtctctttatgaggagttgtggcccgttgtca

SEQ ID NO: 1260 - DNA, 40 bp, Artificial Sequence
  synthetic sequence
ctgacgcaacccccactggttggggcattgccaccacctg

SEQ ID NO: 1261 - DNA, 40 bp, Artificial Sequence
  synthetic sequence
cctccctattgccacggcggaactcatcgccgcctgcctt

SEQ ID NO: 1262 - DNA, 40 bp, Artificial Sequence
  synthetic sequence
ggcactgacaattccgtggtgttgtcggggaagctgacgt

SEQ ID NO: 1263 - DNA, 40 bp, Artificial Sequence
  synthetic sequence
cctggattctgcgcgggacgtccttctgctacgtcccttc

SEQ ID NO: 1264 - DNA, 40 bp, Artificial Sequence
  synthetic sequence
cggcctgctgccggctctgcggcctcttccgcgtcttcgc

SEQ ID NO: 1265 - DNA, 40 bp, Artificial Sequence
  synthetic sequence
tgggccgcctccccgcctggaattaattctgcagtcgaga

SEQ ID NO: 1266 - DNA, 40 bp, Artificial Sequence
  synthetic sequence
caatacagcagctaccaatgctgattgtgcctggctagaa

SEQ ID NO: 1267 - DNA, 40 bp, Artificial Sequence
  synthetic sequence
gtcacacctcaggtacctttaagaccaatgacttacaagg

SEQ ID NO: 1268 - DNA, 40 bp, Artificial Sequence
  synthetic sequence
cagtttaccccgcgccaccttctctaggcaccggttcaat

SEQ ID NO: 1269 - DNA, 40 bp, Artificial Sequence
  synthetic sequence
tgtggggaaactccatcgcataaaacccctccccccaacc

SEQ ID NO: 1270 - DNA, 40 bp, Artificial Sequence
  synthetic sequence
ccatggtggcggcgaattcgaatcacgacacctgaaatgg

SEQ ID NO: 1271 - DNA, 40 bp, Artificial Sequence
  synthetic sequence
gcagcaaggccagcggcaggagcaaggcggtcactggtaa

SEQ ID NO: 1272 - DNA, 40 bp, Artificial Sequence
  synthetic sequence
gggctggacttcgcctgtgatttctgggtgctggtcgttg

SEQ ID NO: 1273 - DNA, 40 bp, Artificial Sequence
  synthetic sequence
gggtcatgttcatgtagtcgctgtgcagcagtctgctccg

SEQ ID NO: 1274 - DNA, 40 bp, Artificial Sequence
  synthetic sequence
tgccccgtttgctccggtaggcggcgaaatccctgggagg

SEQ ID NO: 1275 - DNA, 40 bp, Artificial Sequence
  synthetic sequence
atcggcagctacagccatcttcctcttgagtagtttgtac

SEQ ID NO: 1276 - DNA, 40 bp, Artificial Sequence
  synthetic sequence
gaaggaggatgtgaactgagagtgaagttcagcaggagcg

SEQ ID NO: 1277 - DNA, 40 bp, Artificial Sequence
  synthetic sequence
ccatctcagggtcccggccacgtctcttgtccaaaacatc

SEQ ID NO: 1278 - DNA, 40 bp, Artificial Sequence
  synthetic sequence
ctctgccctcgcgagggggcagggcctgcatgtgaagggc

SEQ ID NO: 1279 - DNA, 40 bp, Artificial Sequence
  synthetic sequence
ggccagggttctcttccacgtcgccacatgtcagcaggct

SEQ ID NO: 1280 - DNA, 40 bp, Artificial Sequence
  synthetic sequence
tgcacttgtccacgcattccctgcctcggctgacattccg

SEQ ID NO: 1281 - DNA, 40 bp, Artificial Sequence
  synthetic sequence
ggcaggtcttgacgcagtgggggccgtcaatgtagtgggc

SEQ ID NO: 1282 - DNA, 8755 bp, Unknown
  lentivirus sequence
gtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattagctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagagcgctgccaccaagcgacctgccgccacaaagaaggctggacaggctaagaagaagaaagattacaaagacgatgacgataagggatccggcgcaacaaacttctctctgctgaaacaagccggagatgtcgaagagaatcctggaccgatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagaattcgatatcaagcttatcggtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgac

SEQ ID NO: 1283 - DNA, 9181 bp, Human immunodeficiency virus
ggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacaaataatccacctatcccagtaggagaaatttataaaagatggataatcctgggattaaataaaatagtaagaatgtatagccctaccagcattctggacataagacaaggaccaaaggaaccctttagagactatgtagaccggttctataaaactctaagagccgagcaagcttcacaggaggtaaaaaattggatgacagaaaccttgttggtccaaaatgcgaacccagattgtaagactattttaaaagcattgggaccagcggctacactagaagaaatgatgacagcatgtcagggagtaggaggacccggccataaggcaagagttttggctgaagcaatgagccaagtaacaaattcagctaccataatgatgcagagaggcaattttaggaaccaaagaaagattgttaagtgtttcaattgtggcaaagaagggcacacagccagaaattgcagggcccctaggaaaaagggctgttggaaatgtggaaaggaaggacaccaaatgaaagattgtactgagagacaggctaattttttagggaagatctggccttcctacaagggaaggccagggaattttcttcagagcagaccagagccaacagccccaccagaagagagcttcaggtctggggtagagacaacaactccccctcagaagcaggagccgatagacaaggaactgtatcctttaacttccctcaggtcactctttggcaacgacccctcgtcacaataaagataggggggcaactaaaggaagctctattagatacaggagcagatgatacagtattagaagaaatgagtttgccaggaagatggaaaccaaaaatgatagggggaattggaggttttatcaaagtaagacagtatgatcagatactcatagaaatctgtggacataaagctataggtacagtattagtaggacctacacctgtcaacataattggaagaaatctgttgactcagattggttgcactttaaattttcccattagccctattgagactgtaccagtaaaattaaagccaggaatggatggcccaaaagttaaacaatggccattgacagaagaaaaaataaaagcattagtagaaatttgtacagagatggaaaaggaagggaaaatttcaaaaattgggcctgaaaatccatacaatactccagtatttgccataaagaaaaaagacagtactaaatggagaaaattagtagatttcagagaacttaataagagaactcaagacttctgggaagttcaattaggaataccacatcccgcagggttaaaaaagaaaaaatcagtaacagtactggatgtgggtgatgcatatttttcagttcccttagatgaagacttcaggaagtatactgcatttaccatacctagtataaacaatgagacaccagggattagatatcagtacaatgtgcttccacagggatggaaaggatcaccagcaatattccaaagtagcatgacaaaaatcttagagccttttagaaaacaaaatccagacatagttatctatcaatacatggatgatttgtatgtaggatctgacttagaaatagggcagcatagaacaaaaatagaggagctgagacaacatctgttgaggtggggacttaccacaccagacaaaaaacatcagaaagaacctccattcctttggatgggttatgaactccatcctgataaatggacagtacagcctatagtgctgccagaaaaagacagctggactgtcaatgacatacagaagttagtggggaaattgaattgggcaagtcagatttacccagggattaaagtaaggcaattatgtaaactccttagaggaaccaaagcactaacagaagtaataccactaacagaagaagcagagctagaactggcagaaaacagagagattctaaaagaaccagtacatggagtgtattatgacccatcaaaagacttaatagcagaaatacagaagcaggggcaaggccaatggacatatcaaatttatcaagagccatttaaaaatctgaaaacaggaaaatatgcaagaatgaggggtgcccacactaatgatgtaaaacaattaacagaggcagtgcaaaaaataaccacagaaagcatagtaatatggggaaagactcctaaatttaaactgcccatacaaaaggaaacatgggaaacatggtggacagagtattggcaagccacctggattcctgagtgggagtttgttaatacccctcccttagtgaaattatggtaccagttagagaaagaacccatagtaggagcagaaaccttctatgtagatggggcagctaacagggagactaaattaggaaaagcaggatatgttactaatagaggaagacaaaaagttgtcaccctaactgacacaacaaatcagaagactgagttacaagcaatttatctagctttgcaggattcgggattagaagtaaacatagtaacagactcacaatatgcattaggaatcattcaagcacaaccagatcaaagtgaatcagagttagtcaatcaaataatagagcagttaataaaaaaggaaaaggtctatctggcatgggtaccagcacacaaaggaattggaggaaatgaacaagtagataaattagtcagtgctggaatcaggaaagtactatttttagatggaatagataaggcccaagatgaacatgagaaatatcacagtaattggagagcaatggctagtgattttaacctgccacctgtagtagcaaaagaaatagtagccagctgtgataaatgtcagctaaaaggagaagccatgcatggacaagtagactgtagtccaggaatatggcaactagattgtacacatttagaaggaaaagttatcctggtagcagttcatgtagccagtggatatatagaagcagaagttattccagcagaaacagggcaggaaacagcatattttcttttaaaattagcaggaagatggccagtaaaaacaatacatactgacaatggcagcaatttcaccggtgctacggttagggccgcctgttggtgggcgggaatcaagcaggaatttggaattccctacaatccccaaagtcaaggagtagtagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggaaaggaccagcaaagctcctctggaaaggtgaaggggcagtagtaatacaagataatagtgacataaaagtagtgccaagaagaaaagcaaagatcattagggattatggaaaacagatggcaggtgatgattgtgtggcaagtagacaggatgaggattagaacatggaaaagtttagtaaaacaccatatgtatgtttcagggaaagctaggggatggttttatagacatcactatgaaagccctcatccaagaataagttcagaagtacacatcccactaggggatgctagattggtaataacaacatattggggtctgcatacaggagaaagagactggcatttgggtcagggagtctccatagaatggaggaaaaagagatatagcacacaagtagaccctgaactagcagaccaactaattcatctgtattactttgactgtttttcagactctgctataagaaaggccttattaggacacatagttagccctaggtgtgaatatcaagcaggacataacaaggtaggatctctacaatacttggcactagcagcattaataacaccaaaaaagataaagccacctttgcctagtgttacgaaactgacagaggatagatggaacaagccccagaagaccaagggccacagagggagccacacaatgaatggacactagagcttttagaggagcttaagaatgaagctgttagacattttcctaggatttggctccatggcttagggcaacatatctatgaaacttatggggatacttgggcaggagtggaagccataataagaattctgcaacaactgctgtttatccattttcagaattgggtgtcgacatagcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcataacaaaagccttaggcatctcctatggcaggaagaagcggagacagcgacgaagagctcatcagaacagtcagactcatcaagcttctctatcaaagcagtaagtagtacatgtaatgcaacctataccaatagtagcaatagtagcattagtagtagcaataataatagcaatagttgtgtggtccatagtaatcatagaatataggaaaatattaagacaaagaaaaatagacaggttaattgatagactaatagaaagagcagaagacagtggcaatgagagtgaaggagaaatatcagcacttgtggagatgggggtggagatggggcaccatgctccttgggatgttgatgatctgtagtgctacagaaaaattgtgggtcacagtctattatggggtacctgtgtggaaggaagcaaccaccactctattttgtgcatcagatgctaaagcatatgatacagaggtacataatgtttgggccacacatgcctgtgtacccacagaccccaacccacaagaagtagtattggtaaatgtgacagaaaattttaacatgtggaaaaatgacatggtagaacagatgcatgaggatataatcagtttatgggatcaaagcctaaagccatgtgtaaaattaaccccactctgtgttagtttaaagtgcactgatttgaagaatgatactaataccaatagtagtagcgggagaatgataatggagaaaggagagataaaaaactgctctttcaatatcagcacaagcataagaggtaaggtgcagaaagaatatgcatttttttataaacttgatataataccaatagataatgatactaccagctataagttgacaagttgtaacacctcagtcattacacaggcctgtccaaaggtatcctttgagccaattcccatacattattgtgccccggctggttttgcgattctaaaatgtaataataagacgttcaatggaacaggaccatgtacaaatgtcagcacagtacaatgtacacatggaattaggccagtagtatcaactcaactgctgttaaatggcagtctagcagaagaagaggtagtaattagatctgtcaatttcacggacaatgctaaaaccataatagtacagctgaacacatctgtagaaattaattgtacaagacccaacaacaatacaagaaaaagaatccgtatccagagaggaccagggagagcatttgttacaataggaaaaataggaaatatgagacaagcacattgtaacattagtagagcaaaatggaataacactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaatagtacttggagtactgaagggtcaaataacactgaaggaagtgacacaatcaccctcccatgcagaataaaacaaattataaacatgtggcagaaagtaggaaaagcaatgtatgcccctcccatcagtggacaaattagatgttcatcaaatattacagggctgctattaacaagagatggtggtaatagcaacaatgagtccgagatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattggagtcaggaactaaagaatagtgctgttagcttgctcaatgccacagccatagcagtagctgaggggacagatagggttatagaagtagtacaaggagcttgtagagctattcgccacatacctagaagaataagacagggcttggaaaggattttgctataagatgggtggcaagtggtcaaaaagtagtgtgattggatggcctactgtaagggaaagaatgagacgagctgagccagcagcagatagggtgggagcagcatctcgagacctggaaaaacatggagcaatcacaagtagcaatacagcagctaccaatgctgcttgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataagatagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttc

SEQ ID NO: 1284 - DNA, 12838 bp, Artificial Sequence
  synthetic sequence
gttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattagctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagagcgctgccaccatggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctactggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaagcgacctgccgccacaaagaaggctggacaggctaagaagaagaaagattacaaagacgatgacgataagggatccggcgcaacaaacttctctctgctgaaacaagccggagatgtcgaagagaatcctggaccgatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagaattcgatatcaagcttatcggtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgctt

SEQ ID NO: 1285 - DNA, 10342 bp, Artificial Sequence
  synthetic sequence
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgatgagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgattcgaattcgccgccaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgagggcagaggcagcctgctgacatgtggcgacgtggaagagaaccctggccccatgtggctgcagagcctgctgctcttgggcactgtggcctgcagcatctctcgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgtaataatctagaccgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggactggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggccttgacattgctagcgttttaccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcaacttgtttattgcagcttataatggttacaaataaagcaatagcatcacaaatttcacaaataaagcatttttttcactgcattctagttgtggtttgtccaaactcatcaatgtatcttatcatgtctggatcaactggataactcaagctaaccaaaatcatcccaaacttcccaccccataccctattaccactgccaattacctgtggtttcatttactctaaacctgtgattcctctgaattattttcattttaaagaaattgtatttgttaaatatgtactacaaacttagtagtttttaaagaaattgtatttgttaaatatgtactacaaacttagtagt

SEQ ID NO: 1286 - DNA, 16 bp, Artificial Sequence
  synthetic sequence
ttcccaagcgtcatct

SEQ ID NO: 1287 - DNA, 16 bp, Artificial Sequence
  synthetic sequence
agatgacgcttgggaa

SEQ ID NO: 1288 - DNA, 22 bp, Artificial Sequence
  synthetic sequence
tcgctctctgctcctcctgttc

SEQ ID NO: 1289 - DNA, 20 bp, Artificial Sequence
  synthetic sequence
cgcccaatacgaccaaatcc

SEQ ID NO: 1290 - DNA, 21 bp, Artificial Sequence
  synthetic sequence
gtcaaccccaccgtgttcttc

SEQ ID NO: 1291 - DNA, 23 bp, Artificial Sequence
  synthetic sequence
tttctgctgtctttgggaccttg

SEQ ID NO: 1292 - DNA, 16 bp, Artificial Sequence
  synthetic sequence
cgtcgcaccaagaaat

SEQ ID NO: 1293 - DNA, 16 bp, Artificial Sequence
  synthetic sequence
tagacttgccatacgt

SEQ ID NO: 1294 - DNA, 16 bp, Artificial Sequence
  synthetic sequence
aattcttgagaccagg

SEQ ID NO: 1295 - DNA, 16 bp, Artificial Sequence
  synthetic sequence
atctgcccaaactcca

SEQ ID NO: 1296 - DNA, 16 bp, Artificial Sequence
  synthetic sequence
ttcccaagcgtcatct

SEQ ID NO: 1297 - DNA, 16 bp, Artificial Sequence
  synthetic sequence
tctatcggacgctgta

SEQ ID NO: 1298 - DNA, 26 bp, Artificial Sequence
  synthetic sequence
aaaaaaaaaaatttcttggtgcgacg

SEQ ID NO: 1299 - DNA, 26 bp, Artificial Sequence
  synthetic sequence
aaaaaaaaaaacgtatggcaagtcta

SEQ ID NO: 1300 - DNA, 26 bp, Artificial Sequence
  synthetic sequence
aaaaaaaaaacctggtctcaagaatt

SEQ ID NO: 1301 - DNA, 26 bp, Artificial Sequence
  synthetic sequence
aaaaaaaaaatggagtttgggcagat

SEQ ID NO: 1302 - DNA, 26 bp, Artificial Sequence
  synthetic sequence
aaaaaaaaaaagatgacgcttgggaa

SEQ ID NO: 1303 - DNA, 26 bp, Artificial Sequence
  synthetic sequence
aaaaaaaaaatacagcgtccgataga

SEQ ID NO: 1304 - DNA, 41 bp, Artificial Sequence
  synthetic sequence
atttatagaaaccgggggcgaaaaaacgtatggcaagtcta

SEQ ID NO: 1305 - DNA, 41 bp, Artificial Sequence
  synthetic sequence
cgaacaggaggagcagagagaaaaaacgtatggcaagtcta

SEQ ID NO: 1306 - DNA, 41 bp, Artificial Sequence
  synthetic sequence
gctggcgacgcaaaagaagaaaaaaacgtatggcaagtcta

SEQ ID NO: 1307 - DNA, 41 bp, Artificial Sequence
  synthetic sequence
catggtgtctgagcgatgtgaaaaaacgtatggcaagtcta

SEQ ID NO: 1308 - DNA, 41 bp, Artificial Sequence
  synthetic sequence
tacgaccaaatccgttgactaaaaaacgtatggcaagtcta

SEQ ID NO: 1309 - DNA, 41 bp, Artificial Sequence
  synthetic sequence
cagagttaaaagcagccctgaaaaaacgtatggcaagtcta

SEQ ID NO: 1310 - DNA, 41 bp, Artificial Sequence
  synthetic sequence
gggtcattgatggcaacaataaaaaacgtatggcaagtcta

SEQ ID NO: 1311 - DNA, 41 bp, Artificial Sequence
  synthetic sequence
aaccatgtagttgaggtcaaaaaaaacgtatggcaagtcta

SEQ ID NO: 1312 - DNA, 41 bp, Artificial Sequence
  synthetic sequence
gggtggaatcatattggaacaaaaaacgtatggcaagtcta

SEQ ID NO: 1313 - DNA, 41 bp, Artificial Sequence
  synthetic sequence
ttgacggtgccatggaatttaaaaaacgtatggcaagtcta

SEQ ID NO: 1314 - DNA, 41 bp, Artificial Sequence
  synthetic sequence
cattgatgacaagcttcccgaaaaaacgtatggcaagtcta

SEQ ID NO: 1315 - DNA, 41 bp, Artificial Sequence
  synthetic sequence
tcctggaagatggtgatgggaaaaaacgtatggcaagtcta

SEQ ID NO: 1316 - DNA, 41 bp, Artificial Sequence
  synthetic sequence
ccacttgattttggagggataaaaaacgtatggcaagtcta

SEQ ID NO: 1317 - DNA, 41 bp, Artificial Sequence
  synthetic sequence
ggactccacgacgtactcagaaaaaacgtatggcaagtcta

SEQ ID NO: 1318 - DNA, 41 bp, Artificial Sequence
  synthetic sequence
ttctccatggtggtgaagacaaaaaacgtatggcaagtcta

SEQ ID NO: 1319 - DNA, 41 bp, Artificial Sequence
  synthetic sequence
agagatgatgacccttttggaaaaaacgtatggcaagtcta

SEQ ID NO: 1320 - DNA, 41 bp, Artificial Sequence
  synthetic sequence
gacgaacatgggggcatcagaaaaaacgtatggcaagtcta

SEQ ID NO: 1321 - DNA, 41 bp, Artificial Sequence
  synthetic sequence
catacttctcatggttcacaaaaaaacgtatggcaagtcta

SEQ ID NO: 1322 - DNA, 41 bp, Artificial Sequence
  synthetic sequence
attgctgatgatcttgaggcaaaaaacgtatggcaagtcta

SEQ ID NO: 1323 - DNA, 41 bp, Artificial Sequence
  synthetic sequence
ctaagcagttggtggtgcagaaaaaacgtatggcaagtcta

SEQ ID NO: 1324 - DNA, 41 bp, Artificial Sequence
  synthetic sequence
ccacgataccaaagttgtcaaaaaaacgtatggcaagtcta

SEQ ID NO: 1325 - DNA, 41 bp, Artificial Sequence
  synthetic sequence
tcttctgggtggcagtgatgaaaaaacgtatggcaagtcta

SEQ ID NO: 1326 - DNA, 41 bp, Artificial Sequence
  synthetic sequence
tagaggcagggatgatgttcaaaaaacgtatggcaagtcta

SEQ ID NO: 1327 - DNA, 41 bp, Artificial Sequence
  synthetic sequence
tcagctcagggatgaccttgaaaaaacgtatggcaagtcta

SEQ ID NO: 1328 - DNA, 41 bp, Artificial Sequence
  synthetic sequence
cactgacacgttggcagtggaaaaaacgtatggcaagtcta

SEQ ID NO: 1329 - DNA, 41 bp, Artificial Sequence
  synthetic sequence
caggtttttctagacggcagaaaaaacgtatggcaagtcta

SEQ ID NO: 1330 - DNA, 41 bp, Artificial Sequence
  synthetic sequence
caccttcttgatgtcatcataaaaaacgtatggcaagtcta

SEQ ID NO: 1331 - DNA, 41 bp, Artificial Sequence
  synthetic sequence
gctgttgaagtcagaggagaaaaaaacgtatggcaagtcta

SEQ ID NO: 1332 - DNA, 41 bp, Artificial Sequence
  synthetic sequence
cgtcaaaggtggaggagtggaaaaaacgtatggcaagtcta

SEQ ID NO: 1333 - DNA, 41 bp, Artificial Sequence
  synthetic sequence
agtggtcgttgagggcaatgaaaaaacgtatggcaagtcta

SEQ ID NO: 1334 - DNA, 41 bp, Artificial Sequence
  synthetic sequence
tcataccaggaaatgagcttaaaaaacgtatggcaagtcta

SEQ ID NO: 1335 - DNA, 41 bp, Artificial Sequence
  synthetic sequence
cctgttgctgtagccaaattaaaaaacgtatggcaagtcta

SEQ ID NO: 1336 - DNA, 41 bp, Artificial Sequence
  synthetic sequence
tgaggaggggagattcagtgaaaaaacgtatggcaagtcta

SEQ ID NO: 1337 - DNA, 41 bp, Artificial Sequence
  synthetic sequence
ctcttcaaggggtctacatgaaaaaacgtatggcaagtcta

SEQ ID NO: 1338 - DNA, 41 bp, Artificial Sequence
  synthetic sequence
tacatgacaaggtgcggctcaaaaaacgtatggcaagtcta

SEQ ID NO: 1339 - DNA, 41 bp, Artificial Sequence
  synthetic sequence
tgagcacagggtactttattaaaaaacgtatggcaagtcta

SEQ ID NO: 1340 - DNA, 41 bp, Artificial Sequence
  synthetic sequence
aggagtatgattgtcaacccaaaaatggagtttgggcagat

SEQ ID NO: 1341 - DNA, 40 bp, Artificial Sequence
  synthetic sequence
cctatataaggcgaagcacaaaaatggagtttgggcagat

SEQ ID NO: 1342 - DNA, 41 bp, Artificial Sequence
  synthetic sequence
gagtgactcgagagagctacaaaaatggagtttgggcagat

SEQ ID NO: 1343 - DNA, 41 bp, Artificial Sequence
  synthetic sequence
atagtgagcaacgtaggcttaaaaatggagtttgggcagat

SEQ ID NO: 1344 - DNA, 41 bp, Artificial Sequence
  synthetic sequence
ggacatgagttgggcaatttaaaaatggagtttgggcagat

SEQ ID NO: 1345 - DNA, 41 bp, Artificial Sequence
  synthetic sequence
gagatcaactcccgaaggaaaaaaatggagtttgggcagat

SEQ ID NO: 1346 - DNA, 41 bp, Artificial Sequence
  synthetic sequence
aatcttgtccaaggcatcagaaaaatggagtttgggcagat

SEQ ID NO: 1347 - DNA, 41 bp, Artificial Sequence
  synthetic sequence
aacttcgaagggtctgtcagaaaaatggagtttgggcagat

SEQ ID NO: 1348 - DNA, 41 bp, Artificial Sequence
  synthetic sequence
ggttggggatgatgtcaattaaaaatggagtttgggcagat

SEQ ID NO: 1349 - DNA, 41 bp, Artificial Sequence
  synthetic sequence
taccaaagtcagggtacgttaaaaatggagtttgggcagat

SEQ ID NO: 1350 - DNA, 41 bp, Artificial Sequence
  synthetic sequence
tgagatcagctttggtcatgaaaaatggagtttgggcagat

SEQ ID NO: 1351 - DNA, 41 bp, Artificial Sequence
  synthetic sequence
ttggcaatggttcccaaattaaaaatggagtttgggcagat

SEQ ID NO: 1352 - DNA, 41 bp, Artificial Sequence
  synthetic sequence
ctgaagagcctccatgaatgaaaaatggagtttgggcagat

SEQ ID NO: 1353 - DNA, 41 bp, Artificial Sequence
  synthetic sequence
ccaccaagtaggcagaataaaaaaatggagtttgggcagat

SEQ ID NO: 1354 - DNA, 41 bp, Artificial Sequence
  synthetic sequence
tgctttgtgatcacaaccacaaaaatggagtttgggcagat

SEQ ID NO: 1355 - DNA, 41 bp, Artificial Sequence
  synthetic sequence
cagaagactcccaagcatacaaaaatggagtttgggcagat

SEQ ID NO: 1356 - DNA, 41 bp, Artificial Sequence
  synthetic sequence
agcacgcacagtgaaggaacaaaaatggagtttgggcagat

SEQ ID NO: 1357 - DNA, 41 bp, Artificial Sequence
  synthetic sequence
tctaggtactctgtctgatcaaaaatggagtttgggcagat

SEQ ID NO: 1358 - DNA, 41 bp, Artificial Sequence
  synthetic sequence
taaagggtgatgggatagccaaaaatggagtttgggcagat

SEQ ID NO: 1359 - DNA, 41 bp, Artificial Sequence
  synthetic sequence
tgtttagttcttcctgatcaaaaaatggagtttgggcagat

SEQ ID NO: 1360 - DNA, 41 bp, Artificial Sequence
  synthetic sequence
agggtttctggtccaaatagaaaaatggagtttgggcagat

SEQ ID NO: 1361 - DNA, 41 bp, Artificial Sequence
  synthetic sequence
tcattagtgaggctcttgtaaaaaatggagtttgggcagat

SEQ ID NO: 1362 - DNA, 41 bp, Artificial Sequence
  synthetic sequence
aaagtgcttgactgccaagtaaaaatggagtttgggcagat

SEQ ID NO: 1363 - DNA, 41 bp, Artificial Sequence
  synthetic sequence
tgaattccaactgaccttctaaaaatggagtttgggcagat

SEQ ID NO: 1364 - DNA, 41 bp, Artificial Sequence
  synthetic sequence
gagcccgacgaggaataaataaaaatggagtttgggcagat

SEQ ID NO: 1365 - DNA, 41 bp, Artificial Sequence
  synthetic sequence
tgaacacacggcggacatagaaaaatggagtttgggcagat

SEQ ID NO: 1366 - DNA, 41 bp, Artificial Sequence
  synthetic sequence
atcaactcatcacagctgtcaaaaatggagtttgggcagat

SEQ ID NO: 1367 - DNA, 41 bp, Artificial Sequence
  synthetic sequence
aagattttgctctgctggagaaaaatggagtttgggcagat

SEQ ID NO: 1368 - DNA, 41 bp, Artificial Sequence
  synthetic sequence
agagaagagctcaaggcactaaaaatggagtttgggcagat

SEQ ID NO: 1369 - DNA, 41 bp, Artificial Sequence
  synthetic sequence
gtggattccaagcttgagataaaaatggagtttgggcagat

SEQ ID NO: 1370 - DNA, 41 bp, Artificial Sequence
  synthetic sequence
agactgggaggtatgatagcaaaaatggagtttgggcagat

SEQ ID NO: 1371 - DNA, 41 bp, Artificial Sequence
  synthetic sequence
ctctgacagagatgtcatctaaaaatggagtttgggcagat

SEQ ID NO: 1372 - DNA, 41 bp, Artificial Sequence
  synthetic sequence
tagatggacttctgtgtctcaaaaatggagtttgggcagat

SEQ ID NO: 1373 - DNA, 41 bp, Artificial Sequence
  synthetic sequence
gctccacaaaagctgagttgaaaaatggagtttgggcagat

SEQ ID NO: 1374 - DNA, 41 bp, Artificial Sequence
  synthetic sequence
catatataccacctcgaagcaaaaatggagtttgggcagat

SEQ ID NO: 1375 - DNA, 41 bp, Artificial Sequence
  synthetic sequence
acacagtactcgtcaatgggaaaaatggagtttgggcagat

SEQ ID NO: 1376 - DNA, 41 bp, Artificial Sequence
  synthetic sequence
ttcccatcaaattccttgagaaaaatggagtttgggcagat

SEQ ID NO: 1377 - DNA, 41 bp, Artificial Sequence
  synthetic sequence
gagattgtcaccttctcaacaaaaatggagtttgggcagat

SEQ ID NO: 1378 - DNA, 41 bp, Artificial Sequence
  synthetic sequence
tgcagcaaggtgaagacacaaaaaatggagtttgggcagat

SEQ ID NO: 1379 - DNA, 41 bp, Artificial Sequence
  synthetic sequence
gctttttggccatcatatagaaaaatggagtttgggcagat

SEQ ID NO: 1380 - DNA, 41 bp, Artificial Sequence
  synthetic sequence
aactgccttatcattcttgtaaaaatggagtttgggcagat

SEQ ID NO: 1381 - DNA, 41 bp, Artificial Sequence
  synthetic sequence
atcctcaagggaaaagccagaaaaatggagtttgggcagat

SEQ ID NO: 1382 - DNA, 41 bp, Artificial Sequence
  synthetic sequence
tgatcatgcgatagatgcggaaaaatggagtttgggcagat

SEQ ID NO: 1383 - DNA, 41 bp, Artificial Sequence
  synthetic sequence
catcaggaactgcagcattgaaaaatggagtttgggcagat

SEQ ID NO: 1384 - DNA, 41 bp, Artificial Sequence
  synthetic sequence
caagggcacaagttttccaaaaaaatggagtttgggcagat

SEQ ID NO: 1385 - DNA, 41 bp, Artificial Sequence
  synthetic sequence
tactgccttcaacacaaggaaaaaatggagtttgggcagat

SEQ ID NO: 1386 - DNA, 41 bp, Artificial Sequence
  synthetic sequence
agagtagagagggaatggggaaaaatggagtttgggcagat

SEQ ID NO: 1387 - DNA, 41 bp, Artificial Sequence
  synthetic sequence
tacacaacatccaatcctgcaaaaatggagtttgggcagat

SEQ ID NO: 1388 - DNA, 40 bp, Artificial Sequence
  synthetic sequence
cccttgctcaccatgtcgacgaattcccggccgccctata

SEQ ID NO: 1389 - DNA, 40 bp, Artificial Sequence
  synthetic sequence
agctcgaccaggatgggcaccaccccggtgaacagctcct

SEQ ID NO: 1390 - DNA, 40 bp, Artificial Sequence
  synthetic sequence
tcgccggacacgctgaacttgtggccgtttacgtcgccgt

SEQ ID NO: 1391 - DNA, 40 bp, Artificial Sequence
  synthetic sequence
aacttcagggtcagcttgccgtaggtggcatcgccctcgc

SEQ ID NO: 1392 - DNA, 40 bp, Artificial Sequence
  synthetic sequence
tagcggctgaagcactgcacgccgtaggtcagggtggtca

SEQ ID NO: 1393 - DNA, 40 bp, Artificial Sequence
  synthetic sequence
atggcggacttgaagaagtcgtgctgcttcatgtggtcgg

SEQ ID NO: 1394 - DNA, 40 bp, Artificial Sequence
  synthetic sequence
tccttgaagaagatggtgcgctcctggacgtagccttcgg

SEQ ID NO: 1395 - DNA, 40 bp, Artificial Sequence
  synthetic sequence
ccctcgaacttcacctcggcgcgggtcttgtagttgccgt

SEQ ID NO: 1396 - DNA, 40 bp, Artificial Sequence
  synthetic sequence
aagtcgatgcccttcagctcgatgcggttcaccagggtgt

SEQ ID NO: 1397 - DNA, 40 bp, Artificial Sequence
  synthetic sequence
ttctgcttgtcggccatgatatagacgttgtggctgttgt

SEQ ID NO: 1398 - DNA, 40 bp, Artificial Sequence
  synthetic sequence
tcgatgttgtggcggatcttgaagttcaccttgatgccgt

SEQ ID NO: 1399 - DNA, 40 bp, Artificial Sequence
  synthetic sequence
gtgttctgctggtagtggtcggcgagctgcacgctgccgt

SEQ ID NO: 1400 - DNA, 40 bp, Artificial Sequence
  synthetic sequence
tagtggttgtcgggcagcagcacggggccgtcgccgatgg

SEQ ID NO: 1401 - DNA, 40 bp, Artificial Sequence
  synthetic sequence
ttctcgttggggtctttgctcagggcggactgggtgctca

SEQ ID NO: 1402 - DNA, 40 bp, Artificial Sequence
  synthetic sequence
ccggcggcggtcacgaactccagcaggaccatgtgatcgc

SEQ ID NO: 1403 - DNA, 40 bp, Artificial Sequence
  synthetic sequence
tcctcggtacccttgtacagctcgtccatgccgagagtga

SEQ ID NO: 1404 - DNA, 10 bp, Artificial Sequence
  synthetic sequence
aaaaaaaaaa

SEQ ID NO: 1405 - DNA, 8425 bp, Artificial Sequence
  synthetic sequence
gtacaagtaaagcggccgcgtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcatggtatatgtgtatatatatatatatatattcaggaaataatatattctagaatatgtcacattctgtctcaggcatccattttctttatgatgccgtttgaggtggagttttagtcaggtggtcagcttctccttttttttgccatctgccctgtaagcatcctgctggggacccagataggagtcatcactctaggctgagaacatctgggcacacaccctaagcctcagcatgactcatcatgactcagcattgctgtgcttgagccagaaggtttgcttagaaggttacacagaaccagaaggcgggggtggggcactgaccccgacaggggcctggccagaactgctcatgcttggactatgggaggtcactaatggagacacacagaaatgtaacaggaactaaggaaaaactgaagcttatttaatcagagatgagatgctggaagggatagagggagctgagcttgtaaaaagtatagtaatcattcagcaaatggttttgaagcacctgctggatgctaaacactattttcagtgcttgaatcataaataagaataaaacatgtatcttattccccacaagagtccaagtaaaaaataacagttaattataatgtgctctgtcccccaggctggagtgcagtggcacgatctcagctcactgcaacctccgcctcccgggttcaagcaattctcctgcctcagccaccctaatagctgggattacaggtgcacaccaccatgccaggctaatttttgtactttttgtagaggcagggtatcaccatgttgtccaagatggtcttgaactcctgagctccaagcagtccacccacctcagcctcccaaagtgctatctctttaagaccaatgacttacaaggcagctgtagatcttagccactttttaaaagaaaaggggggactggaagggctaattcactcccaacgaagacaagatctacgtctgaatggtggccgtagtttgcagagccctggtttcttcttgcctctcagcttccaacttccccgtgagtgcctgctccttgatggactggactctaagcccttctttgcagcaagcacgatatcaagctttgtcagtagagggcgccggagggacactgtggaggaaggggccttttcatggtccacagagctctgttgtgcaatttcttgttcctgttgcatcttctcttagggtatgaacgcggggggacatcctctggggcttttcctcagctgtgcacccagaatgcatggtccctcgaccacctcatagcccatcctgtatgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagctgtgtgtggaactgctgaagggtgcttccttttattcttcatccctagccagccgccggcccctggcctcactggatactctaagactattggtcaagtttgccttgtcaaggctattggtcaaggcaaggctggccaacccatgggtggagtttagccagggaccgtttcagacagatatttgcattgagatagtgtggggaaggggcccccaagaggatactgctaattttttttatagcctttgccttgttccgattcagtcattccagtttttctctaatttattcttccctttagctagtttccttctcccatcatagaggataccaggacttcttttgtcagccgttttttaccttcttgtctctagctccagtgaggaagcggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagct

SEQ ID NO: 1406 - DNA, 4718 bp, Adeno-associated virus 1
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 1407 - DNA, 4726 bp, Adeno-associated virus 2
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 1408 - DNA, 4726 bp, Adeno-associated virus 3; identical to SEQ ID NO: 1407

SEQ ID NO: 1409 - DNA, 4767 bp, Adeno-associated virus 4
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccagatgatggagttggccacattagctatgcgcgctcgctcactcactcggccctggagaccaaaggtctccagactgccggcctctggccggcagggccgagtgagtgagcgagcgcgcatagagggagtggccaa

SEQ ID NO: 1410 - DNA, 4642 bp, Adeno-associated virus 5
ctctcccccctgtcgcgttcgctcgctcgctggctcgtttgggggggtggcagctcaaagagctgccagacgacggccctctggccgtcgcccccccaaacgagccagcgagcgagcgaacgcgacaggggggagagtgccacactctcaagcaagggggttttgtaagcagtgatgtcataatgatgtaatgcttattgtcacgcgatagttaatgattaacagtcatgtgatgtgttttatccaataggaagaaagcgcgcgtatgagttctcgcgagacttccggggtataaaagaccgagtgaacgagcccgccgccattctttgctctggactgctagaggaccctcgctgccatggctaccttctatgaagtcattgttcgcgtcccatttgacgtggaggaacatctgcctggaatttctgacagctttgtggactgggtaactggtcaaatttgggagctgcctccagagtcagatttaaatttgactctggttgaacagcctcagttgacggtggctgatagaattcgccgcgtgttcctgtacgagtggaacaaattttccaagcaggagtccaaattctttgtgcagtttgaaaagggatctgaatattttcatctgcacacgcttgtggagacctccggcatctcttccatggtcctcggccgctacgtgagtcagattcgcgcccagctggtgaaagtggtcttccagggaattgaaccccagatcaacgactgggtcgccatcaccaaggtaaagaagggcggagccaataaggtggtggattctgggtatattcccgcctacctgctgccgaaggtccaaccggagcttcagtgggcgtggacaaacctggacgagtataaattggccgccctgaatctggaggagcgcaaacggctcgtcgcgcagtttctggcagaatcctcgcagcgctcgcaggaggcggcttcgcagcgtgagttctcggctgacccggtcatcaaaagcaagacttcccagaaatacatggcgctcgtcaactggctcgtggagcacggcatcacttccgagaagcagtggatccaggaaaatcaggagagctacctctccttcaactccaccggcaactctcggagccagatcaaggccgcgctcgacaacgcgaccaaaattatgagtctgacaaaaagcgcggtggactacctcgtggggagctccgttcccgaggacatttcaaaaaacagaatctggcaaatttttgagatgaatggctacgacccggcctacgcgggatccatcctctacggctggtgtcagcgctccttcaacaagaggaacaccgtctggctctacggacccgccacgaccggcaagaccaacatcgcggaggccatcgcccacactgtgcccttttacggctgcgtgaactggaccaatgaaaactttccctttaatgactgtgtggacaaaatgctcatttggtgggaggagggaaagatgaccaacaaggtggttgaatccgccaaggccatcctggggggctcaaaggtgcgggtcgatcagaaatgtaaatcctctgttcaaattgattctacccctgtcattgtaacttccaatacaaacatgtgtgtggtggtggatgggaattccacgacctttgaacaccagcagccgctggaggaccgcatgttcaaatttgaactgactaagcggctcccgccagattttggcaagattactaagcaggaagtcaaggacttttttgcttgggcaaaggtcaatcaggtgccggtgactcacgagtttaaagttcccagggaattggcgggaactaaaggggcggagaaatctctaaaacgcccactgggtgacgtcaccaatactagctataaaagtctggagaagcgggccaggctctcatttgttcccgagacgcctcgcagttcagacgtgactgttgatcccgctcctctgcgaccgctcaattggaattcaaggtatgattgcaaatgtgactatcatgctcaatttgacaacatttctaacaaatgtgatgaatgtgaatatttgaatcggggcaaaaatggatgtatctgtcacaatgtaactcactgtcaaatttgtcatgggattcccccctgggaaaaggaaaacttgtcagattttggggattttgacgatgccaataaagaacagtaaataaagcgagtagtcatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctcttgtggtcattcaatgaataacagcttacaacatctacaaaacctccttgcttgagagtgtggcactctcccccctgtcgcgttcgctcgctcgctggctcgtttgggggggtggcagctcaaagagctgccagacgacggccctctggccgtcgcccccccaaacgagccagcgagcgagcgaacgcgacaggggggagag

SEQ ID NO: 1411 - DNA, 4683 bp, Adeno-associated virus 6
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 1412 - DNA, 4721 bp, Adeno-associated virus 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 1413 - DNA, 4393 bp, Adeno-associated virus 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 1414 - DNA, 2211 bp, Adeno-associated virus 9
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 1415 - DNA, 4102 bp, Adeno-associated virus 10
atgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccactggcgccgcgtgagtaaggccccggaggccctcttctttgttcagttcgagaagggcgagtcctactttcacctgcacgttctggtcgagaccacgggggtcaagtccatggtcctgggccgcttcctgagtcagatcagagacaggctggtgcagaccatctaccgcggggtagagcccacgctgcccaactggttcgcggtgaccaagacgcgaaatggcgccggcggggggaacaaggtggtggacgagtgctacatccccaactacctcctgcccaagacgcagcccgagctgcagtgggcgtggactaacatggaggagtatataagcgcgtgtctgaacctcgcggagcgtaaacggctcgtggcgcagcacctgacccacgtcagccagacgcaggagcagaacaaggagaatctgaacccgaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggaaagatcatggcgctgaccaaatccgcgcccgactacctggtaggcccgtccttacccgcggacattaaggccaaccgcatctaccgcatcctggagctcaacggctacgaccccgcctacgccggctccgtcttcctgggctgggcgcagaaaaagttcggtaaaaggaatacaatttggctgttcgggcccgccaccaccggcaagaccaacatcgcggaagccatcgcccacgccgtgcccttctacggctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtcgaccaaaagtgcaagtcctcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtgacgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacctgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttgggcagactggcgagtcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatctccaacgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggatgtcttcatgattccccagtacggctacctgacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcattgaccagtacctgtactacttatccagaactcagtccacaggaggaactcaaggtacccagcaattgttattttctcaagctgggcctgcaaacatgtcggctcaggccaagaactggctgcctggaccttgctaccggcagcagcgagtctccacgacactgtcgcaaaacaacaacagcaactttgcttggactggtgccaccaaatatcacctgaacggaagagactctctggtgaatcccggtgtcgccatggcaacccacaaggacgacgaggaacgcttcttcccgtcgagcggagtcctgatgtttggaaaacagggtgctggaagagacaatgtggactacagcagcgttatgctaacaagcgaagaagaaattaaaaccactaaccctgtagccacagaacaatacggcgtggtggctgacaacttgcagcaagccaatacagggcctattgtgggaaatgtcaacagccaaggagccttacctggcatggtctggcagaaccgagacgtgtacctgcagggtcccatctgggccaagattcctcacacggacggcaactttcacccgtctcctctgatgggcggctttggacttaaacacccgcctccacagatcctgatcaagaacacgccggtacctgcggatcctccaacaacgttcagccaggcgaaattggcttccttcatcacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttatctgacacgtaatctgtaa

SEQ ID NO: 1416 - DNA, 4087 bp, Adeno-associated virus 11
atgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccactggcgccgcgtgagtaaggccccggaggccctcttctttgttcagttcgagaagggcgagtcctacttccacctccacgttctcgtcgagaccacgggggtcaagtccatggtcctgggccgcttcctgagtcagatcagagacaggctggtgcagaccatctaccgcggggtcgagcccacgctgcccaactggttcgcggtgaccaagacgcgaaatggcgccggcggggggaacaaggtggtggacgagtgctacatccccaactacctcctgcccaagacccagcccgagctgcagtgggcgtggactaacatggaggagtatataagcgcgtgtctaaacctcgcggagcgtaaacggctcgtggcgcagcacctgacccacgtcagccagacgcaggagcagaacaaggagaatctgaacccgaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggaaagatcatggcgctgaccaaatccgcgcccgactacctggtaggcccgtccttacccgcggacattaaggccaaccgcatctaccgcatcctggagctcaacggctacgaccccgcctacgccggctccgtcttcctgggctgggcgcagaaaaagttcggtaaacgcaacaccatctggctgtttgggcccgccaccaccggcaagaccaacatcgcggaagccatagcccacgccgtgcccttctacggctgcgtgaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcctcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttccggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagccccgaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaaaacggctcctggaaagaagagaccgttagagtcaccacaagagcccgactcctcctcgggcatcggcaaaaaaggcaaacaaccagccagaaagaggctcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcgtctcggaacaacatcaagcagcaacacctacaacggattctccaccccctggggatattttgacttcaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagaggggagcctgcctcctttccccaatgacgtgttcatggtgcctcaatatggctactgtggcatcgtgactggcgagaatcagaaccaaacggacagaaacgctttctactgcctggagtattttccttcgcaaatgttgagaactggcaacaactttgaaatggcttacaactttgagaaggtgccgttccactcaatgtatgctcacagccagagcctggacagactgatgaatcccctcctggaccagtacctgtggcacttacagtcgactacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatcgcgcccggacctccaatggccacagccggaccttcggatggggacttcagtaacgcccagcttatattccctggaccatctgttaccggaaatacaacaacttcagccaacaatctgttgtttacatcagaagaagaaattgctgccaccaacccaagagacacggacatgtttggccagattgctgacaataatcagaatgctacaactgctcccataaccggcaacgtgactgctatgggagtgctgcctggcatggtgtggcaaaacagagacatttactaccaagggccaatttgggccaagatcccacacgcggacggacattttcatccttcaccgctgattggtgggtttggactgaaacacccgcctccccagatattcatcaagaacactcccgtacctgccaatcctgcgacaaccttcactgcagccagagtggactctttcatcacacaatacagcaccggccaggtcgctgttcagattgaatgggaaattgaaaaggaacgctccaaacgctggaatcctgaagtgcagtttacttcaaactatgggaaccagtcttctatgttgtgggctcctgatacaactgggaagtatacagagccgcgggttattggctctcgttatttgactaatcatttgtaa

SEQ ID NO: 1417 - DNA, 4213 bp, Adeno-associated virus 12
ttgcgacagtttgcgacaccatgtggtcacaagaggtatataaccgcgagtgagccagcgaggagctccattttgcccgcgaagtttgaacgagcagcagccatgccggggttctacgaggtggtgatcaaggtgcccagcgacctggacgagcacctgcccggcatttctgactcctttgtgaactgggtggccgagaaggaatgggagttgcccccggattctgacatggatcagaatctgattgagcaggcacccctgaccgtggccgagaagctgcagcgcgagttcctggtggaatggcgccgagtgagtaaatttctggaggccaagttttttgtgcagtttgaaaagggggactcgtactttcatttgcatattctgattgaaattaccggcgtgaaatccatggtggtgggccgctacgtgagtcagattagggataaactgatccagcgcatctaccgcggggtcgagccccagctgcccaactggttcgcggtcacaaagacccgaaatggcgccggaggcgggaacaaggtggtggacgagtgctacatccccaactacctgctccccaaggtccagcccgagcttcagtgggcgtggactaacatggaggagtatataagcgcctgtttgaacctcgcggagcgtaaacggctcgtggcgcagcacctgacgcacgtctcccagacccaggagggcgacaaggagaatctgaacccgaattctgacgcgccggtgatccggtcaaaaacctccgccaggtacatggagctggtcgggtggctggtggacaagggcatcacgtccgagaagcagtggatccaggaggaccaggcctcgtacatctccttcaacgcggcctccaactcccggtcgcagatcaaggcggccctggacaatgcctccaaaatcatgagcctcaccaaaacggctccggactatctcatcgggcagcagcccgtgggggacattaccaccaaccggatctacaaaatcctggaactgaacgggtacgacccccagtacgccgcctccgtctttctcggctgggcccagaaaaagtttggaaagcgcaacaccatctggctgtttgggcccgccaccaccggcaagaccaacatcgcggaagccatcgcccacgcggtccccttctacggctgcgtcaactggaccaatgagaactttcccttcaacgactgcgtcgacaaaatggtgatttggtgggaggagggcaagatgaccgccaaggtcgtagagtccgccaaggccattctgggcggcagcaaggtgcgcgtggaccaaaaatgcaaggcctctgcgcagatcgaccccacccccgtgatcgtcacctccaacaccaacatgtgcgccgtgattgacgggaacagcaccaccttcgagcaccagcagcccctgcaggaccggatgttcaagtttgaactcacccgccgcctcgaccacgactttggcaaggtcaccaagcaggaagtcaaggactttttccggtgggcggctgatcacgtgactgacgtggctcatgagttttacgtcacaaagggtggagctaagaaaaggcccgccccctctgacgaggatataagcgagcccaagcggccgcgcgtgtcatttgcgcagccggagacgtcagacgcggaagctcccggagacttcgccgacaggtaccaaaacaaatgttctcgtcacgcgggtatgctgcagatgctctttccctgcaagacgtgcgagagaatgaatcagaattccaacgtctgcttcacgcacggtcagaaagattgcggggagtgctttcccgggtcagaatctcaaccggtttctgtcgtcagaaaaacgtatcagaaactgtgcatccttcatcagctccggggggcacccgagatcgcctgctctgcttgcgaccaactcaaccccgatttggacgattgccaatttgagcaataaatgactgaaatcaggtatggctgctgacggttatcttccagattggctcgaggacaacctctctgaaggcattcgcgagtggtgggcgctgaaacctggagctccacaacccaaggccaaccaacagcatcaggacaacggcaggggtcttgtgcttcctgggtacaagtacctcggacccttcaacggactcgacaagggagagccggtcaacgaggcagacgccgcggccctcgagcacgacaaggcctacgacaagcagctcgagcagggggacaacccgtatctcaagtacaaccacgccgacgccgagttccagcagcgcttggcgaccgacacctcttttgggggcaacctcgggcgagcagtcttccaggccaaaaagaggattctcgagcctctgggtctggttgaagagggcgttaaaacggctcctggaaagaaacgcccattagaaaagactccaaatcggccgaccaacccggactctgggaaggccccggccaagaaaaagcaaaaagacggcgaaccagccgactctgctagaaggacactcgactttgaagactctggagcaggagacggaccccctgagggatcatcttccggagaaatgtctcatgatgctgagatgcgtgcggcgccaggcggaaatgctgtcgaggcgggacaaggtgccgatggagtgggtaatgcctccggtgattggcattgcgattccacctggtcagagggccgagtcaccaccaccagcacccgaacctgggtcctacccacgtacaacaaccacctgtacctgcgaatcggaacaacggccaacagcaacacctacaacggattctccaccccctggggatactttgactttaaccgcttccactgccacttttccccacgcgactggcagcgactcatcaacaacaactggggactcaggccgaaatcgatgcgtgttaaaatcttcaacatacaggtcaaggaggtcacgacgtcaaacggcgagactacggtcgctaataaccttaccagcacggttcagatctttgcggattcgacgtatgaactcccatacgtgatggacgccggtcaggaggggagctttcctccgtttcccaacgacgtctttatggttccccaatacggatactgcggagttgtcactggaaaaaaccagaaccagacagacagaaatgccttttactgcctggaatactttccatcccaaatgctaagaactggcaacaattttgaagtcagttaccaatttgaaaaagttcctttccattcaatgtacgcgcacagccagagcctggacagaatgatgaatcctttactggatcagtacctgtggcatctgcaatcgaccactaccggaaattcccttaatcaaggaacagctaccaccacgtacgggaaaattaccactggagactttgcctactacaggaaaaactggttgcctggagcctgcattaaacaacaaaaattttcaaagaatgccaatcaaaactacaagattcccgccagcgggggagacgcccttttaaagtatgacacgcataccactctaaatgggcgatggagtaacatggctcctggacctccaatggcaaccgcaggtgccggggactcggattttagcaacagccagctgatctttgccggacccaatccgagcggtaacacgaccacatcttcaaacaatttgttgtttacctcagaagaggagattgccacaacaaacccacgagacacggacatgtttggacagattgcagataataatcaaaatgccaccaccgcccctcacatcgctaacctggacgctatgggaattgttcccggaatggtctggcaaaacagagacatctactaccagggccctatttgggccaaggtccctcacacggacggacactttcacccttcgccgctgatgggaggatttggactgaaacacccgcctccacagattttcatcaaaaacacccccgtacccgccaatcccaatactacctttagcgctgcaaggattaattcttttctgacgcagtacagcaccggacaagttgccgttcagatcgactgggaaattcagaaggagcattccaaacgctggaatcccgaagttcaatttacttcaaactacggcactcaaaattctatgctgtgggctcccgacaatgctggcaactaccacgaactccgggctattgggtcccgtttcctcacccaccacttgtaa

SEQ ID NO: 1418 - DNA, 4180 bp, Adeno-associated virus 13
ccgcgagtgagcgaaccaggagctccattttgcccgcgaattttgaacgagcagcagccatgccgggattctacgagattgtcctgaaggtgcccagcgacctggacgagcacctgcctggcatttctgactcttttgtaaactgggtggcggagaaggaatgggagctgccgccggattctgacatggatctgaatctgattgagcaggcacccctaaccgtggccgaaaagctgcaacgcgaattcctggtcgagtggcgccgcgtgagtaaggccccggaggccctcttctttgttcagttcgagaagggggacagctacttccacctacacattctggtggagaccgtgggcgtgaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaatatggaccagtatttaagcgcctgtttgaatctcgcggagcgtaaacggctggtggcgcagcatctgacgcacgtgtcgcagacgcaggagcagaacaaagagaaccagaatcccaattctgacgcgccggtgatcagatcaaaaacctccgcgaggtacatggagctggtcgggtggctggtggaccgcgggatcacgtcagaaaagcaatggatccaggaggaccaggcctcttacatctccttcaacgccgcctccaactcgcggtcacaaatcaaggccgcactggacaatgcctccaaatttatgagcctgacaaaaacggctccggactacctggtgggaaacaacccgccggaggacattaccagcaaccggatctacaaaatcctcgagatgaacgggtacgatccgcagtacgcggcctccgtcttcctgggctgggcgcaaaagaagttcgggaagaggaacaccatctggctctttgggccggccacgacgggtaaaaccaacatcgctgaagctatcgcccacgccgtgcccttttacggctgcgtgaactggaccaatgagaactttccgttcaacgattgcgtcgacaagatggtgatctggtgggaggagggcaagatgacggccaaggtcgtggagtccgccaaggccattctgggcggaagcaaggtgcgcgtggaccaaaagtgcaagtcatcggcccagatcgacccaactcccgtcatcgtcacctccaacaccaacatgtgcgcggtcatcgacggaaattccaccaccttcgagcaccaacaaccactccaagaccggatgttcaagttcgagctcaccaagcgcctggagcacgactttggcaaggtcaccaagcaggaagtcaaggactttttccggtgggcgtcagatcacgtgactgaggtgtctcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggcatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacatatcagaaactgtgtccgattcatcacatcatggggagggcgcccgaggtggcttgttcggcctgcgatctggccaatgtggacttggatgactgtgacatggagcaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggacttgacaagggggaacccgtcaacgcagcggacgcggcagccctcgaacacgacaaggcctacgaccagcagctcaaggccggtgacaacccctacctcaagtacaaccacgccgacgccgagtttcaggagcgtcttcaagaagatacgtcttttgggggcaacctcggacgagcagtcttccaggccaaaaagaggatccttgagcctctgggtctggttgaggaagcggctaagacggctcctggaaaaaagagacctgtagagcaatctccagcagaaccggactcctcttcgggcatcggcaaatcaggccagcagcccgctagaaaaagactgaattttggtcagactggcgacacagagtcagtcccagaccctcaaccactcggacaacctcccgcagccccctctggtgtgggatctactacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccctgcccacctacaacaatcacctctacaagcaaatctccagccaatcaggagccaccaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactccgagtaccagctcccgtacgtcctcggctcggcgcatcagggatgcctcccgccgttcccagcagacgtcttcatggtcccacagtatggatacctcaccctgaacaacgggagtcaggcggtaggacgctcttccttttactgcctggagtactttccttctcagatgctgcgtactggaaacaactttcagtttagctacacttttgaagacgtgcctttccacagcagctacgctcacagccaaagtctggaccgtctcatgaatcctctgatcgaccagtacctgtactatctgaacaggacacaaacagccagtggaactcagcagtctcggctactgtttagccaagctggacccaccagtatgtctcttcaagctaaaaactggctgcctggaccttgctacagacagcagcgtctgtcaaagcaggcaaacgacaacaacaacagcaactttccctggactggtgccaccaaatatcatctgaatggccgggactcattggtgaacccgggccctgctatggccagtcacaaggatgacaaagaaaagtttttccccatgcatggaaccctgatatttggtaaagaaggaacaaatgccaacaacgcggatttggaaaatgtcatgattacagatgaagaagaaatccgcaccaccaatcccgtggctacggagcagtacgggactgtgtcaaataatttgcaaaactcaaacgctggtccaactactggaactgtcaatcaccaaggagcgttacctggtatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaactttagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccggttaattcg

SEQ ID NO: 1419 - DNA, 7333 bp, Artificial Sequence
  synthetic sequence
ccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcactctcctgtggagccagactcctcctcgggaaccggaaaggcgggccagcagcctgcaagaaaaagattgaattttggtcagactggagacgcagactcagtcccagaccctcaaccaatcggagaacctcccgcagccccctcaggtgtgggatctcttacaatggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacctgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcag

SEQ ID NO: 1420 - DNA, 32767 bp, Human mastadenovirus D
catcatcaataatataccccacaaagtaaacaaaagttaatatgcaaatgagcttttgaattttaacggttgtggggcggagccaacgctgattggacgagaagcggtgatgcaaataacgtcacgacgcacggctaatggccggcgcggaggcgtggcctaggccggaagcaagtcgcggggctgatgacgtataaaaaagcggactttagacccggaaacggccgattttcccgcggccacgcccggatatgaggtaattctgggcggatgcaagtgaaattaggtcattttggcgccaaaactgaatgaggaagtgaaaagtgaaaaatacctgtcccgcccagggcggaatatttaccgagggccgagagactttgaccgattacgtggggtttcgattgcggtgtttttttcgcgaatttccgcgtccgtgtgaaagtccggtgtttatgtcacagatcagctgatccacagggtatttaaaccagttgagcccgtcaagaggccactcttgagtgccagcgagtagagatttctctgagctctgctcccagagtctaaaaaaaatgagacacctgcgccttctgtcttcaactgtgcctattaacatggccgcattattgctggaggactatgtgagtacagtattggaggacgaactacatccatctccatttgagctgggacctacacttcaggacctttatgatttggaggtagatgcccatgatgacgacccaaacgaagaggctgtgaatttaatatttccagaatctctgattcttcaggctaacatagccagcgaagctgtacctacaccacttcatacaccgactctgtcacccatacctgaattggaagaggaggacgagctagacctccgatgttatgaggaaggttttcctcccagcgattcagaggacgaacagggtgagcagagcatggctgtaatctcagaatatgcttgtgtggttgtggaagagcattttgtgttggacaatcctgaggtgcccgggcaaggctgtagatcctgccagtaccaccgggataagaccggagacacgaacgcctcctgcgctctgtgttacatgaaaaagaacttcagctttatttacagtaagtggagtgaatgtgagagaggcgagtgcttaacacataactgggtgatgcttaaacagctgtgctaagtgtggtttatttttgtttctaggtccggtgtcagaggatgagtcatcaccctcagaagaagaccacccgtgtccccctgagctgtcaggcgaaacgcccctgcaagtgcacagacccaccccagtcagacccagtggcgagaggcgagcagctgttgaaaaaattgaggacttgttacatgacatgggtggggatgaacctttggacctgagcttgaaacgccccaggaactaggctcagctgtgcttagtcatgtgtaaataaagttgtacaataaaagtatatgtgacgcatgcaaggtgtggttcatgattcatgggcggggcttattcctatataagtggcaacacctgggcactggggcacagacctttagggagttcctgatggatgtgtggactatccttgcagactttagcaagacacgccgacttgtagaggatagttcagacgggtgctccgggttctggagacactggtttggaactcctctatctcgtctggtgtacacagttaagaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggactttgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcttgtacccagagcttagcaaggtgctgacatccatggccaggggagtgaagagggagaggagcgatgggggcaataccgggatgatgaccgagctgacggccagcctgatgaatcgcaagcgcccagagcgcattacctggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggctttaacaatatgtgcgccgaggtctggggcgcttccaagatcaggggatgtaagttttatggctgctggatgggcgtggtcggaagacccaagagcgagatgtctgtaaagcagtgtgtgtttgagaaatgctacctgggagtctctaccgagggcaatgctagagtgagacactgctcttccctggatacgggctgcttctgcctggtgaagggtacggcctctctaaagcataatatggtgaagggctgcacagatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaatgtgagtataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggaactcgtcgctcgacagcaccgccgcagccgcggcagccgcagccgccatgacagcgacgagactggcctcgagctacatgcccagcagcagcagtagcccctctgtgcccagttccatcatcgccgaggagaaactgctggccctgctggccgagctggaagccctgagccgtcagctggccgccctgacccagcaggtgtccgagctccgcgaacagcagcagcagcaaaataaatgattcaataaacacagattctaattcaaacagcaaagtatctttattatttattttttcgcgcgcgataggccctggtccacctctcccgatcattgagagtgcggtggattttttccaggacccggtagaggtgggattggatgttaaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactaatggccacggggagccccttggtgtaggtgttggcgaagcggttgagctgggagggatgcatgcggggggagatgatgtgcagtttggcctggatcttgaggttggcgatgttgccacccagatcccgccgggggttcatgttgtgcaggaccaccagaacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagagacatcataattatgctcctgggtgagatcatcataagacattttaatgaatttggggcggagggtgccagattgggggacgatggttccctcgggccccggggcgaagttcccctcgcagatctgcatctcccaggctttcatctcggagggggggatcatgtccacctgcggggcgatgaaaaaaacggtttccggggcgggggtgattagctgcgaggagagcaggtttctcaacagctgggacttgccgcacccggtcgggccgtagatgaccccgatgactggttgcaggtggtagttcaaggagatgcagctgccgtcgtcccggagaaggggggccacctcgttgagcatgtccctgacttggaggttttcccggacgagctcgccaaggaggcggtccccgcccagcgagagcagctcttgcagggaagcaaagtttttcagtggcttgagcccgtcggccatgggcatcttggcgagggtctgcgagaggagctcgaggcggtcccaaagctcggtgacgtgctctacggcatctcgatccagcagacttcctcgtttcgggggttgggacgactgcgactgtagggcacgagacgatgggcgtccagcgctgccaacgtcatgtccttccagggtctcagggtccgcgtgagcgtggtctccgtcacggtgaaggggtgggccccgggctgggcgcttgcaagggtgcgcttgagactcatcctgctggtgctgaaacgggcacggtcttcgccctgcgcgtcggcgagatagcagttgaccataagctcgtagttaagggcctcggcggcgtggcccttggcgcggagcttgcccttggaagagtgaccgcaggcgggacagaggatggattgcagggcgtagagcttgggtgcaagaaagacggactcgggggcgaaggcgtccgctccgcagtgggcgcagacggtctcgcactcgacgagccaggtgagctcggggtgttcggggtcaaaaaccagttttcccccgttctttttgatgcgcttcttacctcgcgtctccatgagtctgtgtccgcgctcggtgacaaacaggctgtctgtgtccccgtagacggacttgatgggcctgtcctgcaggggcgtcccgcggtcctcctcgtagagaaactcggaccactctgagacgaaggcgcgcgtccacgccaagacaaaggaggccacgtgcgaggggtagcggtcgttgtccaccagggggtccaccttttccaccgtgtgcagacacatgtccccctcctccgcattcaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcaatgctttttaggagactttcatccatctggtcagaaaaaactatttttttattgtcaagcttggtggcgaaggagccatagagggcgttggagagaagcttggcgatggatctcatggtctgatttttgtcacggtcggcgcgctccttggccgcgatgttgagctggacatattcgcgcgcgacacacttccattcgggaaagacggtggtgcgctcgtcgggcacgatcctgacgcgccagccgcggttatgcagggtgaccaggtcaacgctggtggccacctcgccgcgcaggggctcgttggtccagcagagtctgccgcccttgcgcgagcagaaagggggcagtacatcaagtagatgctcgtcaggggggtccgcatcgatggtgaagataccgggacagagttccttgtcaaaatagtctatttttgaggatgcatcatccaaggccatctgccactcgcgggcggccatcgctcgctcgtaggggttgaggggcggaccccagggcatgggatgcgtgagggcggaggcgtacatgccgcagatgtcatagacatagatgggctccgagaggatgccgatgtaggtgggataacagcgccccccgcggatgctggcgcgcacatagtcatacaactcgtgcgagggggccaagaaggcggggccgagattggtgcgctggggctgctcggcgcggaagacgatctggcgaaagatggcatgcgagttggaggagatggtgggccgttggaagatgttaaagtgggcgtgcggcagtcggaccgagtcgcggataaagtgcgcgtaggagtcttgcagcttggcgacgagctcggcggtgacaaggacgtccatggcgcagtagtccagcgtttcgcggatgatgtcataacccgcctctcctttcttctcccacagctcgcggttgagagcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccggaacggaggctcggttgttgatgacctgggcggcgaggacgatctcgtcgaagccgttgatgttgtgcccgacgatgtagagttccatgaatcgcgggcggcctttgatgtgcggcagctttttgagctcatcgtaggtgaggtcctcggggcattgcaggccgtgctgttcgagcgccaactcctggagatgtgggttggcttgcatgaaggaagcccagagctcgcgggccatgagggtctggagctcgtcgcgaaagaggcggaactgctggcccacggccatcttttcgggtgtgacgcagtagaaggtgagggggtcccgctcccagcgatcccagcgtaagcgcgcggcgagatcgcgagcgagggcgaccagctcggggtcccccgagaatttcatgaccagcatgaaggggacgagctgcttgccgaaggaccccatccaggtgtaggtttctacatcgtaggtgacaaagagccgctccgtgcgaggatgagagccgattgggaagaattggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggaatggcggccctggctggtggttttcatgttcgcctgcgtgggactcaccctggggctcctcgaggacggagaggctgacgagcccgcgcggcagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccactggccccgtgactttgaacctgaaagacagttcaacagaatcaatctcggcgtcattgacggcggcctgacgcaggatttcttgcacgtcgcccgagttgtcctggtaggcgatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgcgaagacggcatagttgcgcaggcgttggaagaggtagttgagggtggtggcgatgtgctcggtgacgaagaagtacataatccagcggcgcaggggcatttcgctgatgtcgccaatggcctccagcctttccatggcctcgtagaaatccacggcgaagttgaaaaactgggcgttgcgggccgagaccgtgagctcgtcttccaggagcctgatgagttcggcgatggtggcgcgcacctcgcgctcgaaatccccgggggcctcctcctcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccaccggtcatctcccggtaatggggtgggtccccgttgggcagcgatagggcgctgacaatgcatcttatcaattgcggtgtagggcacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgaacggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccataagcgaccagttgacggtctgcaggccgggttgcacgacctcggagtacctgagccgcgagaaggcgcgcgagtcgaagacatagtcgttgcaggtgcgcacaaggtactggtatccgactagaaagtgcggcggcggctggcggtagagcggccagcgctgggtggccggcgcgcccggggccaggtcctcaagcatgagtcggtggtagccgtagaggtagcgggacatccaggtgatgccggcggcggtggtggaggcgcgcgggaactcgcggacgcggttccagatgttgcgcaggggcaggaaatagtccatggacggcacggtctggccggtgagacgcgcgcagtcattgatgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccaagcccgatagccgccaggatacggcggagagccctttttgtcggccgaggggagtcgctagacttgaaagcggccgaaaaccctgccgggtagtggctcgcgcccgtagtctggagaagcatcgccagggttgagtcgcggcagaacccggttcaaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcacagctgttcctggtggtgcagcacagcagggacaacgaggcgttcagggaggcactgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtatgtgcccatagacaaggaggtgaagatagacagcttttacatgcgcatggcgctcaaggtgctgacgctgagcgacgacctgggcgtgtaccgcaacgaccgcatccacaaggccgtgagcacaagccggcggcgcgagctgagcgaccgcgagctgatgctgagtctgcgccgggcgctggtaggaggcgccaccggcggtgaggagtcctactttgacatgggggcggacctgcattggcagccgagccgacgcgccttggaggccgcctacggtccagaggacttggatgaggaagaggaagaggaggaggatgcacccgttgcggggtactgacgcctccgtgatgtgtttttagatgcagcaagccccggaccccgccataagggcggcgctgcaaagtcagccgtccggtctagcatcggacgactgggaggccgcgatgcaacgcatcatggccctgacgacccgcaaccccgagtcctttagacaacagccgcaggccaacagactctcggccattctggaggcggtggttccttctcggaccaaccccacgcacgagaaggtgctggcgatcgtgaacgcgctggcggagaacaaggccatccgtcccgacgaggccgggctagtgtacaacgccctgctggagcgcgtgggccgctacaacagcacaaacgtgcagtccaacctggaccggctggtgacggacgtgcgcgaggccgtggcgcagcgcgagcggttcaagaacgagggcctgggttcgctggtggcgctgaacgccttcctggcgacgcagccggcgaacgtgccgcgcgggcaggatgattataccaactttataagcgcgctgcggctgatggtgaccgaggtgccccagagcgaggtgtaccagtcgggcccggactactttttccagacgagcagacagggcctgcagacggtgaacctgagtcaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtgaaccgcaactcgtacctgggtcacctgctgacgctgtaccgcgaggccataggccaggcgcaggtggatgagcagaccttccaggagatcactagcgtaagccgcgcgctgggtcagaacgacaccgacagtctgagggccaccctgaacttcttgctgaccaatagacagcagaagatcccggcgcagtacgcgctgtcggccgaggaggagcgcgtcctgagatatgtgcagcagagcgtagggctgttcctgatgcaggagggggccacccccagcgccgcgctggacatgaccgcgcgcaacatggaacctagcatgtacgccgccaaccggccgtttattaataagctgatggactacctgcaccgcgcggcgtccatgaactcggactactttaccaatgccatcttgaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcgagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggtcaataacgggatagagagtctggtggacaaactgaaccgctggaaaacctacgctcaggaccatagggaacctgcgcccgcgccgcggcgacagcgtcacgaccggcagcggggcctggtgtgggacgacgaggactcggccgacgatagcagcgtgttggacttgggcggaagcggtggggccaacccgttcgcgcatctgcaacccagactggggcgacggatgttttgaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtatttggtggacaacaagtcggcggacatcgcttccctgaactaccaaaacgaccacagcaacttcctgaccacggtggtgcagaacaacgatttcacccctgccgaggccagcacgcagacgataaattttgacgagcggtcgcggtggggcggtgatctgaagaccattctgcacaccaacatgcctaatgtgaacgagtacatgttcaccagcaagtttaaggcgcgggtgatggtggctagaaaaaaggcggaaggggctgatgcaaatgataggagcaaggatatcttagagtatcagtggtttgagtttaccctgcccgagggcaacttttccgagaccatgaccatagacctaatgaacaacgccatcttggaaaactacttgcaagtggggcggcaaaatggcgtgctggagagtgatatcggagtcaagtttgacagcagaaatttcaagctgggctgggacccggtgaccaagctggtgatgccaggggtctacacctacgaggccttccacccggacgtggtgctgctgccgggctgcggggtggatttcaccgagagccgcctgagcaacctcctgggcattcgcaagaagcaaccttttcaagagggcttcagaatcatgtatgaggacctagtagggggcaacatccccgctctcctgaatgtcaaggagtatctgaaggataaggaagaagctggcaaagcagatgcaaatactattaaggctcagaatgatgccgtcccaagaggagataactatgcatcagcggcagaagccaaagcagcaggaaaagaaattgagttgaaggccattttgaaagatgattcagacagaagctacaatgtgatcgagggaaccacagacaccctgtaccgcagttggtacctgtcctatacctacggggatcccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctttgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtcttactaggcccagcaccatgtacggaggagccaagaaacgctcccagcagcaccccgtccgcgtccgcggtcacttccgcgctccctggggcgcttacaagcgggggcggacctctgctcctgccgccgtgcgcaccaccgtcgacgacgtcatcgactcggtggtcgccgatgcgcgcaactacacccccgccccctcgaccgtggacgcggtcatcgacagcgtggtggcagacgcgcgtgactatgccagacgcaagagccggcggcgacggatcgccaggcgccaccggagcacgcccgccatgcgcgccgcccgagctctgctgcgccgcgccagacgcacgggccgccgggccatgatgcgagccgcgcgccgcgctgccactgcacccacccccgcaggcaggactcgcagacgagcggccgctgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaaacccgtgaccctgcagcaggtgctgccccaggcggtgctgctgccgagccgcggggttaagcgcgagggcgagagcatgtacccgaccatgcagatcatggtgcccaagcgccggcgcgtggaggacgtgctggacaccgtgaaaatggatgtggagcccgaggttaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccaccgctaccgtctccacttctaccgccgccacggctaccgagcctcccaggaggcgaagatggggccctgccaaccggctgatgcccaactacgtgttgcatccttccatcatcccgacgccgggctaccgcggcacccggtactacgccagccgcaggcgcccagccagtaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcactgggcagttgttaagggaaaagctcaaagaccagaacttccagcaaaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaagggcgagaagcgaccgcggcccgacgcggaggagacaatcctgcaagtggacgagccgccctcgtacgaggaggccgtcaaggccggcatgcccaccacgcgcatcatcgcgccgctggccacgggtgtaatgaaacccgctacccttgacctgcctccaccacccacgcccgctccaccaaaagcagctccggttgtgcagccccctccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccaacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgttctggaccgcggccccagcttcaaaccctactcgggcacggcttacaacagcctggcccccaagggcgcccccaattccagtcagtgggatgctcaagaaaaaaatggacaaggaggaaatgacatggttaccaaaactcacacatttggcgtggctgctatgggaggaacaaatattacaaaccagggtttgttaattggaactgaagaaacagccgataatcctccaaaggaaatctttgcagacaaattattccagccagaacctcaagtaggagaggaaaactggcaagacagcaatgcattctatggaggcagggctcttaagaaggaaactaaaatgaaaccatgctatggatcttatgctagaccaacaaacacaagtggcggacaggctaagcttaaaactggtgacaatatcgatcctaccaaggatttcgacatagatcttgctttcttcgatactcctggcggaaatcctccagcaggtggtattggaacggaagaatacaaagcagatattgttatgtacactgaaaatgtcaaccttgaaacacctgacactcatgtggtgtacaaaccagccaaagaggatgaaagttctcaggccaacttggttcagcagtccatgcccaacagacccaactacattggcttcagagacaattttgtggggctcatgtattacaacagcactggcaacatgggagtgctggctggtcaggcctctcagttgaatgctgtggtggacttgcaagacagaaacacagagctgtcttaccagctcttgctagattctctgggtgacagaaccagatactttagcatgtggaactctgcggtggacagctatgatccagatgtcagaatcattgaaaatcacggtgtggaagatgagcttccaaactattgctttccattggatggctctggtaccaatgctgcctaccaaggtgtaaaggttcaagatggtgaagacggggataaagaaactgaatgggaaaaagataccaaagtcgcagatcgtaaccaactgtgcaagggtaacatcttcgccatggagatcaacctccaggccaacctgtggaagagttttctgtactcgaacgtggccctgtacctgcccgactcctacaagtacacgccggccaacatcacgctgcccgccaacaccaacacctacgagtacatgaacggccgcgtggtagccccctcgctggtggacgcatacgtcaacatcggtgcgcgctggtcgctggaccccatggacaacgtcaaccccttcaaccaccaccgcaacgcgggcctgcgctaccgctccatgcttctcggcaacggccgctacgtgcccttccacatccaagtgccccaaaagttctttgccattaagaacctgctcctgctccccggctcctacacctacgagtggaacttccgcaaggatgtcaacatgatcctgcagagttccctcggaaacgacctgcgcgtcgacggcgcctccgtgcgcttcgacagcgtcaacctctacgctaccttcttccccatggcgcacaacaccgcctccaccctggaagccatgctgcgcaacgacaccaacgaccagtcctttaacgactacctctcggccgccaacatgctctaccccatcccggccaaggccaccaacgtgcccatttccatcccctcgcgcaactgggccgccttccgcggctggagtttcacccggctcaagaccaaggaaactccctcccttggctcgggttttgacccctactttgtctactcgggctccatcccctacctcgacgggaccttctacctcaaccacaccttcaagaaggtttccatcatgttcgactcctcggtcagctggcccggcaacgaccggctgcttacgccgaacgagttcgagatcaagcgcagcgtcgacggggagggctacaacgtggcccaatgcaacatgaccaaggactggttcctcgtccagatgctctcccactacaacatcggctaccagggcttccatgtgcccgagggctacaaggaccgcatgtactccttcttccgcaacttccagcccatgagcaggcaggtggtcgatgagatcaactacaaggactacaaggcagtcaccctgcccttccagcacaacaactctggcttcaccggctacctggcacccaccatgcgtcaggggcagccctaccccgccaacttcccctacccgctcatcggctccaccgcagtgccatccgtcacccagaaaaagttcctctgcgacagggtcatgtggcgcatccccttctccagcaacttcatgtccatgggcgccctcaccgatctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggtcgcgagaccgggggcgtgcactggctcgcctttggctggaacccgcgctcgcgcacctgctacatgttcgaccccttcgggttctcggaccgccggctcaagcagatttacagcttcgagtacgaggccatgctgcgccgaagcgccctggcctcctcgcccgatcgctgtcttagcctcgaacagtccacccagaccgtgcaggggcccgactccgccgcctgcggactcttctgttgcatgttcttgcatgccttcgtgcactggcccgaccgacccatggacgggaaccccaccatgaacttgctgacgggggtgcccaacggcatgctacaatcgccacaggtgctgcccaccctcaggcgcaaccaggaggagctctaccgcttcctcgcgcgccactccccctactttcgctcccaccgcgccgccatcgaacacgccaccgcttttgataaaatgaaacaactgcgtgtatgactcaaataaacagcacttttattttacacatgcgctggagtatatgcaagttatttaaaagtcgaaggggttctcgcgctcgtcgttgtgcgccgcgctggggagggccacgttgcggtactggaacttgggctgccacttgaactcggggatcaccagtttgggcactggagtctcggggaaggtctcgctccacatgcgccggctcatttgcagggcgcccagcatgtcagggccggagatcttgaaatcgcagttgggaccggtgctctgcgcgcgcgagttgcggtacacggggttgcagcactggaacaccatcagactggggtacttcacactggcaagcacgctcttgtcgctaatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctaaaaaacaggccgcagctcttcccgctgaactggttattcccgcacccggcatcatgcacgcagcagcgcgcgtcatggctggtcagttgcaccacgctccgtccccagcggttctgggtcaccttagccttgctgggctgctccttcagcgcgcgctgtccgttctcgctggtcacatccatctccaccacgtggtccttgtgaatcatcaccgttccatgcagacacttgagctgaccttccacctcggtgcagccgtgatcccacaggacgcagccggtgcactcccaattcttgtgcgcgatcccgctgtggctgaaaatgtaaccttgcaacaggcgacccataatggtgctaaatgctttctgggtggtgaatgtcagttgcatcccgcgggcctcctcgttcatccaggtctggcacatcttctggaagatctcggtctgctccggcatgagcttgtaagcatcgcgcaagccgctgtcgacgcggtagcgttccatcagcacgttcatggtatccatgcccttctcccatgacgagaccagaggcagactcagggggttgcgcacgttcaggacaccaggggtcgcgggctcgacgatgcgttttccgtccttgccttccttcaacagaaccggaggctggctgaatcccactcccacgatcacggcgtcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctaaaacccccacaggatgaacaggagcacgagcaagacgcaggccaggaggagaccgacgctgggctcgagcatggctacctgggaggagaggaggatgtgctgctaaaacacctgcagcgccagtccctcatcctccgggacgccctggccgaccgaagcgaaacccccctcagcgtcaaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccatctcctgtcgcgccaatcgcactcgcgccgacgcgctcctcgctctggggcccggcgcgcgcatacctgatatcgcttccctggaagaggtgcccaagatcttcgaagggctcggtcgggacgagacgcgcgcggcaaacgctctgaaagaaacagcagaggaagagggttacactagcgccctggtagagttggaaggcgacaacgccaggctggccgtgcttaagcgcagcgtcgagctcacccatttcgcctaccccgccgtcaacctcccgcccaaggtcatgcgtcgcatcatggatcagctcatcatgccccacatcgaggcccttgatgaaagtcaggaacagcgccccgagaacgcccagcccgtggtcagcgacgagatgctcgcgcgctggctcgggacccgcgacccccaggccctggagcagcggcgcaagctcatgctggccgtggtcctggtcacccttgagctcgaatgcatgcgccgcttttttaccgaccccgagaccctgcgcaaggtcgaggagaccctgcactacactttcagacacggtttcgtcaggcaggcctgcaagatctccaacgtggagctgaccaacctggtctcctgcctggggatcctacacgagaaccgcttgggacagaccgtgctccactctaccctgaagggcgaggcgcggcgggactacatccgcgactgcgtctttctctttctctgccacacatggcaagcggccatgggcgtgtggcagcagtgtctcgaggacgagaacctgaaggagctggacaagcttcttgctagaaaccttaaaaagctgtggacgggctttgacgagcgcaccgtcgcctcggacctggccgagatcgtcttccccgagcgcctgaggcagacgctgaaaggagggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacattgcccaccactcggatgtgatcgaggacgtgagcggcgaggggctgctcgagtgccactgtcgctgcaacctatgctccccgcaccgctccctggtctgcaacccccagctactgagcgagacccaggtcatcggtacctttgagctgcaaggtccgcaggagtccaccgctccgctgaaactcacgccggggttgtggacttccgcgtacctgcgcaaatttgtacccgaggactactacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagacttggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcgacagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctaaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgggaattacctcatcgccaccatgagcaaggagattcccaccccttacatgtggagctatcagccccagatgggcctggccgcaggcgcctcccaggactactccacccgcatgaactggctcagtgccggcccctcgatgatctcacaggtcaatggggtccgtaaccatcgaaaccagatattgttggagcaggcggcggtcacctccacgcccagggcaaagctcaacccgcgtaattggccctccaccctggtgtatcaggaaatccccgggccaactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcctccttcactccccaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgatgcagtgagagaagcggtggacggctacgactgaatgtcccatggtgactcggctgagcttgctcggttgaggcatctggaccactgccgccgcctgcgctgcttcgcccgggagagctgcggactcatctactttgagtttcccaaggagcaccccaacggcccggcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgttgtactctgtgtgctgagtttaataaaagctaaactcctacaatactctggaatcccgtgtcgtcgcactcgcaacgagatcttcaacctcaccaaccagactgaggtaaaacttaactgcagaccggggggcaaatacatcctctggctctttgaaaacacttccttcgcagtctccaacgcctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccgacagcagcacagccgctccagaaacatctaacctttttgatactaacactcctaaaaccggaggtgagctctgggttccctctttaacagaggggggtaaacatattgaagcggttgggtatttgattttaggggtggtcctgggtgggtgcatagcggtgctgtattaccttccttgctggaacgaaatcaaaatctttatctgctgggtcatacattgttgggaggaaccatgaaggggctcttgctgattatccttttcctggttgggggtgtactgtcatgccacgaacagccacgatgtaacatcaccacaggcaatgagaggagtgtgatatgcacagtagtcatcaaatgcgagcatacatgtcctctcaacatcacattcaagaataagaccatgagaaattcatgggtgggcgattgggaaccaggagatgagcagaactacacggtcactgtccatggtagcgatgggaatcacactttcggtttcaaattcatttttgaagtcatgtgtgatatcacactgcatgtggctagacttcatggcttgtggccccctaccaaggagaacatagttgggttttctttggcttttgtgatcatggcctgctttatgtcaggtctgctggtaggggctttagtatggttcctgaagcgcaagcctaggtatggaaatgaggagaaggaaaaattgctataaatctttttctcttcgcagaaccatgaatactttgaccggtgtcgtgctgctctctcttcttgtagcttttagtcaggcaggatttcatactatcaatgctacatggtgggctaatataactttagtgggaccctcagatacgccagtcacatggtatgataaacagggaatgcagttctgtgatggaaatacagttaagaatcctcaaataagacatgagtgtaatgagcaaaaccttacactaattcatgtgaacaaaacccatgaaaggacatacatgggttataatacacagagtactcataaggaagactataaagtcatagttataccgcctcctcctgctactgtaaagccacagtcaggtccagagtatgtatatgttaatatgggagagaacaaaaccttagttggacctccaggaataccagttacttggtatgacggagaaggaaataaattctgcgatggagaaaaagttgaacatgcagaatttaatcatacatgtgacgagcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaaatgagcataaacagggtgggcagaaacaggaggggcaaaaagagacaagtcaaaagaaagctaatgacaaacagaaggcgacacacaggaggccatcaaaactaaagccgcacacacctgaagcaaaactgattacagtttctagtgggtctaacttaacattacttgggccagatggaaaggtcacttggtatgatgatgatttaaaaagaccatgcgagcctgggtataagttagggtgtaagtgtgacaatcaaaacctaacgctaatcaatgtaactaaactttatgagggagtttactatggtactaatgacagaggcaacagcaaaagatatagagtaaaagtaaacactactaattctcaaagtgtgaaaattcagccatacaacaggtctactactcctaatcagaaacacagatttgaattgcaaattgattctaatcaagacaatgacaaaattccatcaaccactgtggcaatcgtggtgggagtgattgcgggcttcataactataatcattgtcattctgtgctacatctgctgccgcaagcgtcccagggcatacaatcatatggtagacccactacttagcttctcttactgagactcagtcactttcatttcagaaccatgaaggctttcacagcttgcgttctgattagcatagtcacattagtatcagctgattacaaacaagttcaagttagcagaggaggaaacattacattagatggaccattcgataatactacatggacaagatatcataatgatggacataaaaatggttggatgaaaatttgcacatggactggagcaacatataaatgtcacaataatggaagcattactatttttgctttcaacattacatccggagtttacaaagcagaagggtataaaaaagaggttagaacattttcatctagaaatcaaaaacatacaattgaagattctggagattatgaacaacaaaaaatatatctatataatctaacaataattgaaccgccaactactaaagcacccaccatagttagaacaactactagggaaacaacacatccaaccaccacaactcacactacacatctagacactacagtgcagaatactactttattgattgggtttttaataagaggaaatgaaagtactactgatcagacagaggctacctcaagtgccttcagcagcactgcaaatttaacttcgcttgcttcggtaaatgaaacgatcgtgccaatgatgtatggccaaccttactcaggtttggatattcaaattacttttctggttgtctgtgggatctttattcttgtggttcttctgtactttgtctgctgcaaagccagagaaaaatctaggaggcccatctacaggccagtaattggggatcctcagcctctccaagtggaagggggtctaaggaatcttctcttctctttttcagtatggtgattcagccatgattcctaggttcttcctatttaacatcctcttctgtctattcaacgtgtgcgctgccttcgcggccgtctcgcacgcctcgcccgactgtcttgggcccttccccacctaccttctttttgccctgctcacctgcacctgcgtctgcagcattgtctgcctggtcgttaccttcctgcagctcatcgactggtgctgcgcgcgctacaattatctccaccacagtcccgaatacagggacgagaacgtagccagaatcttaaggctcatttgaccatgcatactctgctcatactgctatccctcctctcccctgccctcgctgatgatgattactctaagtgcaaatttgtggagctatggaatttcttagactgctatgatgttaaaatggatatgccatcctattacttggtgattgtggggatagtcatggtctgctcctgcactttctttgccatcatgatctacccctgttttaatctcggctggaactctgttgaggcattcacatacacactagaaagcagttcactagcttccacgccgccacccacaccgcctccccgcagaaatcagtttcccatgattcagtacttagaagagccccctccccggcccccttccactgttagctactttcacataaccagcggcgatgactgacaaccacctggacctcgagatggacggccaggactccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctgccccagcagaagcagaagttcacctgcatggtgggcgtcaaccccatagtcatcacccagcagtcgggcgagaccagcggctgcatccactgctcctgcgaaagccccgagtgcatctactccctccttaaaaccctttgcggactccgcaaccttcttcccacaaactaactgatttaagcccaaaaaccaatcaaacccccttttcccatctacccaaataaacatttattggaaataattattcaataaagatcacttacttaaaatctgaaagtatgtctttggtgtagttgtttagcagcacctcagtcccctcctcccagctctggtactccagtccccggcgggcggcaaactttctccacaccttgaaagggatgtcaaattcctggtccacaattttcattgtcttccctcttagatgacaaagagactccgggtggaagatgacttcaaccccgtctacccctatggctacgcgcggaatcaaaatattcccttcctcactcccccctttgtctcctccaatggatttcaaaacttcccccctggggtcctgtcacttaaactggctgacccaatcaccattaacaatcaaaatgtatcactcaaggttggaggggggctaactttgcaagaagaaactggaaaattaacagttaatactgaaccacctttgcatcttacaaataacaaattagggatagctttagacgctccatttgatgttatagacaataagcttacactattagcaggccatggcttgtctattataacaaaagaaacatcaacactgcctggcttggttaatactcttgtagtattaactggaaagggtattggaacagatttatcaaataatggtggaaatatatgtgttagagttggagaaggcggcggcttatcatttaatgacaatggagacttggtagcatttaataaaaaagaagacaaacgcaccctatggacaactccagacacatctccaaattgcagaattgatcaggataaggactctaagctaactttggtccttacaaagtgtggaagtcaaatattagccaatgtgtcattaattgttgtagctggaaggtacaaaattatcaataacaatactaatccagctcttaaaggatttaccattaaattgttgtttgataaaaatggagtccttatggaatcttcaaatcttggtaaatcatattggaactttcgaaatcaaaattcaattatgtcaacagcttatgaaaaagctattggttttatgcctaatttggtagcctatccaaaacctaccactggctctaaaaaatatgcaagagatatagtttatggaaacatctaccttggcggaaagccacatcaaccagtaaccattaaaactacctttaaccaggaaactggatgtgaatactctattacatttgattttagttgggccaaaacttatgtaaatgttgaatttgaaactacctcttttaccttttcctatattgcccaagaataaaggataaataaacgtgtttttcatttaaaaatttcatgtatctttattgatttttacaccagcgcgggtacacattctcccaccaccagcccattttacagtgtaaacaattctctcagcacgggtggccttaaataggggaaagttctcattagtgcgggaactggacttggggtttataatccacacagtttcctggcgagccaaacgggggtcggtgattgagatgaagccgtcctttgaaaaatcatccaagtgggcctcgcagtccaaggtcacagtctggtggaatgagaagaacgcacagactcatactcggaaaacaaaatgggtctgtgcctctccatcagcgcccttaacagtctctgccgccggggctcggtgcggctgctacagatgggatcgggatcgcaagtctctttcactataatccccacagcctttagcattagtcttctggtgcgtcgggcacagcaccgcatcctaatctcgctcatgttttcacagtaagtgcagcacataatgaccatgttattcagcagcccataatttagggtgctccagccaaagcttatgttggaaatgatggaacccacgtgaccatcgtaccaaatgcggcagtatatcaggtgcctgccccttataaacacactgcccatatacataatctctttggacatg

SEQ ID NO: 1421 - DNA, 32767 bp, Human mastadenovirus D
catcatcaataatataccccacaaagtaaacaaaagttaatatgcaaatgagcttttgaatttggggcgtggccgccgctgattggctgttgcaagaaccgttagtgacgtcacgacgcacggcgtcaacggtcggcgcggaggcgtggcctaggccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccacagggtatttaaaccagtcgagcccgtcaagaggccactcttgagtgccagcgagtagagatttctctgagctccgctcccagagtgtgagaaaaatgagacacctgcgtctcctgcctggaactgtgcccttggacatggccgcattattgctggatgactttgtgagtacagtattggaggatgaactgcaaccaactccgtttgagctggggcccacacttcaggacctctatgatctggaggtagatgcccaggaggacgacccgaacgaagaggctgtgaatttaatatttccagaatctctgattcttcaggctgacatagccagcgaagctgtacctacaccacttcatacaccgactctgtcacccatacctgaattggaagaggaggacgaactagacctccggtgttatgaggaaggttttcctcccagcgattcagaggacgaacggggtgagcagagtatggctataatctcagactatgcttgtgtggttgtggaagagcattttgtgttggacaatcctgaggtgcctgggcaaggctgtagatcctgccaatatcaccgggatcagaccggagaccaaaatgcttcctgtgctctgtgttacatgaaaatgagcttcagctttatttacagtaagtggagtgaatgtgagagaggctgagtgcttaacacatcactgtgtgatgcttgaacagctgtgctaagtgtggtttattttgttactaggtccggtgtcagaggatgagtcatcaccctcagaagaagaccacccgtctccccctgatctcacagatgacacgcccctgcaagtgatcagacccaccccagtcagactcagtggggagaggcgaatggctgttgacaaaatcgaggacttgttgcaggacatgggtggggatgaacctttggacctgagcttgaaacgccccaggaactaggcgcagctgtgctgagtcatgtgtaaataaagttgtacaataaaagtgtatgtgacgcatgcaaggtgtggtttatgactcatgggcggggcttagacctatataagtggtaacacctgggcactcaggcacagaccttcagggagttcctgatggatgtgtggactatccttggggactttagcaagacacgccggcttgtagaggatagttcagacgggtgctccgggttctggagacactggtttggaactcctctatctcgcctggtgtacacagttaagaaggattatagcgaggaatttgaaaatcttttttccgactgctctggcctgctagattctctgaatcttggccaccagtcccttttccaggaaagggtactccacagccttgatttttcatctcccgggcgcactacagccggggttgcttttgtggtttttctggttgacaaatggagccaggacacccaactgagcaggggatacatcctggacttcgcagccatgcatctgtggagggcctggatcaggcagcggggacagagaatcttgaactactggcttctacagccagcagctccgggtcttcttcgtctacacagacaaacatccatgttggaggaagaaatgagggaggccatggacgagaacccgaggagcggcctggaccctccgtcggaagaggagctggattgaatcaggtatccagcctgtacccagagcttagcaaggtgctgacatccatggccaggggagtgaagagggagaggagcgatgggggcaataccgggatgatgaccgagctgacggccagcctgatgaatcgcaagcgcccagagcgcattacctggcacgagctacagattgagtgcagggatgaggtgggcctgatgcaggataaatacggcctggagcagataaaaacccactggttgaatccagatgaggattgggaggaggccattaagaaatatgccaagatagccctgcgcccagattgcaagtacagggtgaccaagacggtgaatatcagacatgcctgctacatctcagggaacggggcagaggtggtcatcgacaccctggacaaggccgccttcaggtgttgcatgatgggaatgagagccggagtgatgaatatgaattccatgatcttcatgaacataaagttcaatggagagaagtttaatggggtgctgttcatggccaacagccacatgaccctgcacggctgcaatttcttcgggttcaacaatatgtgtgcagaggtctggggcgcctccaagatcaggggatgtaagttttatggctgctggatgggcgtggtcggaagacccaagagcgagatgtctgtgaagcagtgtgtgtttgagaaatgctacctgggggtgtctacagagggcaatgctcgagtgagacactgctcttccctggagacgggctgcttctgcctggtgaagggcacagcctcgatcaagcataatgtggtgaagggctgcacggatgagcgcatgtacaacatgctgacctgcgactcgggggtctgccatatcctgaagaacatccatgtgacctcccaccccagaaagaagtggccattgtttgagaataacctgctgatcaagtgtcacatgcacctgggcgccagaaggggcaccttccagccgtaccagtgcaactttagccagaccaagctgctgttggagaacgatgccttctccagggtgaacctgaacggcatctttgacatggatgtttcggtctacaagatcctgagatacgatgagaccaagtccagggtgcgcgcttgcgagtgcgggggcaggcacaccaggatgcagccagtggccctggatgtgaccgaggagctgagaccagaccacctggtgatggcctgtaccgggaccgagttcagctccagtggggaggacacagattagaggtaggttttgagtagtgggcgtggctaatgtgagtataaaggcggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagccgccatgacagcgacgagactggcctcgagctacatgcccagcagcggcagcagcccctctgtgcccagttccatcattgccgaggagaaactgctggccctgctggccgagctggaagccctgagccgccagctggccgccctgacccagcaggtgtccgatctccgcgagcagcagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccaccggaagccccttggtgtaggtgttggcaaagcggttgagctgggagggatgcatgcggggggagatgatgtgcagtttggcctggatcttgaggttggcgatgttgccacccagatcccgcctggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccctggggcgaagttcccctcacagatctgcatctcccaggctttcatctcggagggggggatcatgtccacctgcggggcgatgaaaaaaacggtttccggggcgggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttaagcatgtccctgacttggaggttttcccggacgagctcgccgaggaggcggtccccgcccagcgagagcagctcttgcagggaagcaaagtttttcaggggcttgagcccgtcggccatgggcatcttggcgagggtctgcgagaggagctccaggcggtcccagagctctgtgacgtgctctacggcatctcgatccagcagacttcctcgtttcgggggttgggacgactgcgactgtagggtacgagacgatgggcgtccagcgctgccagcgtcatgtccttccagggtctcagggtccgcgtgagtgtggtctccgtcacggtgaaggggtgggccccgggctgggcgcttgcgagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgcccttggaagagcgcccgcaggcgggacagaggagggattgcagggcgtagagcttgggcgcgagaaagaccgactcgggggcgaaggcgtccgctccgcagtgggcgcagacggtctcgcactcaacgagccaggtgagctcgggctgctcggggtcaaaaaccagttttcccccgttctttttgatgcgcttcttacctcgcgtctccatgagtctgtgtccgcgttcggtgacaaacaagctgtcagtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcaagcacatgtccccctcctccgcatccaagaaggtgattggcttgtaggtgtaggccacgtgaccgggggtcaccgacgggggggtataaaagggggcgggtctgtgctcgtcctcactctcttccgcgtcgctgtccacgagcgccagctgttggggtaagtattccctctcgagagcgggcatgacctcggcactcaggttgtcagtttctagaaacgaggaggatttgatgttagcctgccctgccgcgatgcttttgaggagactttcatccatctggtcagaaaagactatttttttattgtcaagcttggtggcaaaggagccatagagggcgttggagaggagcttagcgatggatctcatggtctgatttttgtcacgatcggcgcgctccttggccgcgatgttgagctggacatactcgcgcgcgacgcacttccattcggggaagacggtggtgcgctcgtcgggcacgatcctgacgcgccagccgcggttatgcagggtgaccaggtccacgctggtggccacctctccgcgcaggggctcgttagtccagcagaggcgcccgcccttgcgcgagcagaacgggggcaacacatccagcaggtgctcgtcaggggggtctgcatcgatggtaaagatgcccggacagagttccttgtcaaaataatcgatttttgaggatgcatcatccaaggccatctgccattcgcgggcggccagcgctcgctcgtaggggttgaggggcggaccccatggcatgggatgcgtgagcgcggaggcgtacatgccgcagatgtcatagacatagatgggctccgagaggatgccgatgtaggtgggataacagcgccccccgcggatgctggcgcgcacgtattcatacaactcgtgcgagggggccaagaaagcggggccgagattggtgcgctggggctgctcggcgcggaagacgatctggcgaaagatggcatgcgagttggaggagatggtgggccgttggaagatgttaaagtgggcgtgcggcagtcggaccgagtcgcggatgaagtgcgcgtaggagtcttgcagcttggcgacgagctcggcggtgacgaggacgtccatggcgcagtagtcgagggtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaattggttcacggccttgtagggacagcagcccttctccacggggagggcgtaagcttgagcggccttgcggagcgaggtgtgcgtcagggcgaaggtgtccctgaccatgactttcaagaactggtacttgaagtccgagtcgtcgcagccgccgtgttcccagagctcgaaatcggtgcgcttcttcgagagggggttaggcagagcgaaagtgacgtcattgaagagaatcttgcctgcccgcggcatgaaattgcgggtgatgcggaaagggcccgggacggaggctcggttgttgatgacctgggcggcgaggacgatctcgtcgaagccgttgatgttgtgcccgacgatgtagagttccatgaatcgcgggcggcctttgacgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtcccctgagaatttcatgaccagcatgaatgggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccatggggctcctcgaggacggagaggctgacgagcccgcgcgggagccaggtccagatctcggcgcggcgggggcgcagagcgaagacgagggcgcgcagttgggagctgtccatggtgtcgcggagatccaggtccgggggcagggttctgaggttgacatcgtagaggcgggtgagggcgtgcttgagatgcagatggtacttgatctccacgggtgagttggtggccgtgtccacgcattgcatgagcccgtagctgcgcggggccacgaccgtgccgcgctttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgccgcctctgagtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatctccgcggcccgcgcgctcgacggtggcggcgaggtcatttgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcagtggcatctcgctgatgtcgccgatggcttccaacctttccatggcctcgtagaagtccacggcgaagttgaaaaactgggcgttgcgggccgagaccgtgagctcgtcttccaggagcctgatgagctcggcgatggtggcgcgcacctcgcgctcgaaatccccgggggcctcctcctcttcctcttcttccatgacgacctcttcttctatttcctctaccactgggggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgactatgcatcttatcaattgcggtgtaggggacgtgagcgcgtcgagatcgaccggatcggagaatctttcgaggaaagcgtctagccaatcgcagtcgcaaggtaagctcagacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactgacggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtagcccacgaggaagtgcggcggcggctggcggtagaggggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgcgtgtaccccggttcgagtcccctcgaatcaggctggagccgcgactaacgtggtattggcactcccgtctcgacccgagcccgatagccgccaggatacggcggagagccctttttgcaggccgcgcggggtcgctaaacttgaaagcggccgaaaaccccgccgggtagtggctcgcgcccgtagtctggagaagcatcgccagggttgagtcgcggcagaacccggttcgcggacggccgcggcgagcgggacttggtcaccccgcctattaaagacccacagccagccgacttctccagttacgggagcgagccccttttttctttttgccagatgcatcccgtcctgcgccaaatgcgtcccacccctccggcgaccaccgcaaccgcggccgtagcaggcgccggcgctagccagccacagacagagatggacttggaagagggcgaagggctggcgagactgggggcgccgtccccggagcgacacccccgcgtgcagctgcagaaggacgtgcgcccggcgtacgtgcccgcgcagaacctgttcagggaccgcagcggggaggagcccgaggagatgcgcgactgccggtttcgggcgggcagggagctccgcgagggtctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggcactgggcctgatgcacctgtgggacctggcggaggccatcgtgcagaacccggacagcaagcctctgacggcgcagctgttcctggtggtgcagcacagcagggacaatgaggcgttcagggaggcgctgctgaacatcgccgagcccgagggtcgctggctgctggagctgattaacatcttgcagagcatcgtagtgcaggagcgcagcctgagcctggccgagaaggtggcagctatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcgctggtagggggcgctacaggcgaggagtcctacttcgacatgggggcggacctgcattggcagccgagccgacgcgccttggaggccgcctacggtccagaggacttggatgaggatgaggaagaggaggaggatgcacccgttgcggggtactgacgcctccgtgatgtgtttttagatgtcccagcaagccccggaccccgccataagggcggcgctgcaaagccagccgtccggtctagcatcggacgactgggaggccgcgatgcaacgcatcatggccctgacgacccgcaaccccgagtcctttagacaacaaccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcttgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaactttttgctgaccaatagacagcagaagatcccggcgcagtacgcgctatcggccgaggaggaaaggatcctgagatatgtgcagcagagcgtagggctgttcctaatgcaggagggcgccacccccagcgccgcgctggacatgaccgcgcgcaacatggaacctagcatgtacgccgccaaccggccgttcatcaataagctgatggactacctgcaccgcgcggcggccatgaacacggactactttaccaacgccatcctgaacccgcactggctcccgccgccggggttctacactggcgagtacgacatgcccgaccccaacgacgggttcctgtgggacgacgtggacagcgcggtgttctccccgaccttgcaaaagcgccaggaggcggtgcgcacgcccgccagcgagggcgcggtgggtcgcagcccctttcctagcttagggagtttgcatagcttgccgggctcggtgaacagcggcagggtgagccggccgcgcttgctgggcgaggacgagtacctgaacgactcgctgctgcagccgccacgggtcaagaacgccatggccaataacgggatagagagtctggtggacaaactgaaccgctggaagacctacgctcaggaccatagggacgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggcggcggatgttttgaaatgcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcccggtggggcggtgatctgaagaccattctgcacaccaacatgcccaatgtgaacgagtacatgttcaccagcaagtttaaggcgcgggtgatggtggctaggaagcacccacagggggtagaagcaacagatttaagtcaggataagcttgagtatgattggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcagactgggctgggacccggagaccaagctggtgatgccaggtgtctacacctacgaggccttccacccggacgtggtgctgctgccgggctgcggggtggacttcaccgagagccgcctgagcaacctcctgggcattcgcaagaagcaacctttccaagagggcttcaggatcatgtatgaggatctagaagggggcaacatccccgcactccttgatgtggccaagtacttggaaagcaagaaggaacttgaggatgctgccaaggaagctgcaaagcaacagggagatggcgctgtcactagaggcgatacccacctcactgtagctcaagaaaaagcagctggaaaggagctagtgattgttcccattgagaaagatgaaagcaacagaagctacaacctgatcaaggatacccatgacaccctgtaccgaagttggtacctgtcctatacctacggggaccccgagaagggggtgcagtcgtggacgctgctcaccaccccggacgtcacctgcggcgcggagcaagtctactggtcgctgccggacctcatgcaagacccggtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctatccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacacccccgccccctcgaccgtggacgcggtcatcgacagcgtggtggccgacgcgcgcgactatgccagacgcaagagccggcggcgacggattgccaggcgccaccggagcacgcccgccatgcgcgccgcccgggctctgctgcgccgcgccagacgcacgggccgccgggccatgatgcgagccgcgcgccgcgccgccgccgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggcggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggatgaaacgtagctatgacgaggtgtacggcgacgacgacatcctggaccaggcggcggagcgggcgggcgagttcgcctacgggaagcggtctcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcttctaccgccaccgcctctacatctacggttgccacggctaccgagcctcccaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccaccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcgggttcctgcccgcgctcatccccataatcgccgcggccatcggcacgatcccgggcatagcttccgtggcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgttaagggaaaagctcaaagaccagaacttccagcagaaggtggtggacggcctggcctcgggcattaacggggtggtggacatcgcgaaccaggccgtgcagcgcgagataaacagtcgcctggacccgcgcccgcccgccgccacggtggtggagatggaagatgcaagtgcgcatcctccgcccaggggcgagaagcggccgcgacccgacgcggaggagacgaccctgcaggtggacgagcctccctcgtacgaggaggccgtcaaggccggcatgcccaccacgcgcatcatcgcgccgctggccacgggagtgatgaaacccgccaccctagacttgcctccaccacccgcgcccgctccaccaaaggcagctcccgcggtcgtgcagccccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagcctggcccccaagagcgctcccaatcccagccagtgggttgccaaagaaaatggtcagggaactgataagacacatacttatggctcagctgccatgggaggaagcaacatcaccattaaaggtttagtaattggaactgatgaaaaagctgaggatggccaaaaagatatttttgcaaataaactttatcagccagaaccccaggtaggagaagaaaactggcaagagtctgaagccttctatggaggcagagctcttaagaaagacacaaaaatgaagccctgctatggctcatttgcaagacctaccaatgaaaaaggcggacaagctaaatttaagccagtggaagaggggcaacaacctaaagattatgacatagatttggctttctttgacacacctggaggcaccatcacaggaggcacaggcgaagaatataaagcagacattgtgttgtacactgaaaatgtcaaccttgaaaccccagacacccacgtggtatacaagccaggaaaagaggatgacagttcagaagtaaatttgacacagcagtccatgcccaacaggcctaactacattggcttcagagacaactttgtggggctcatgtattacaacagtactggtaacatgggtgtgctggctggtcaggcctctcagttgaatgctgtggtcgacttgcaagacagaaacaccgagctgtcttaccagctcttgctagattctctgggtgacagaaccagatactttagcatgtggaactctgcggtggatagctatgatcccgatgtcaggatcattgaaaatcatggtgtggaagatgagcttcccaactactgcttcccgttgaatggcactggcaccaattccacttatcaaggcgtaaaggtgaaaccagatcaagatggtgatgttgagagcgagtgggataaagatgataccattgcaaggcagaatcaaatcgccaagggcaacgtctttgccatggagatcaacctccaggccaacctgtggaagagttttctgtactcgaacgtggccctgtacctgcccgactcctacaagtacacgcctgccaacgtcacgctgcccaccaacaccaacacctatgagtacatgaacggccgcgtggtggccccctcgctggtggacgcctacatcaacatcggcgcccgctggtcgctggatcccatggacaatgtcaaccccttcaaccaccaccgcaatgcgggcctgcgctatcgctccatgctgctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctgggcaacgacctgcgcgtcgacggcgcctccgttcgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacgcggctcaagaccaaggaaactccctccctcggctcgggtttcgacccatactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctacccgctcatcggccagaccgccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctcaagcagatttacagcttcgagtacgaggccatgctgcgccgaagcgccctggcctcctcgcccgaccgctgtctcagcctcgagcagtccacccagacagtgcaggggcccgactccgccgcctgcggacttttctgttgcatgttcttgcatgccttcgtgcactggcccgaccgacccatggactggaaccccaccatgaacttgctgacgggggtgcccaacggcatgctacaatcgccacaggtgctgcccaccctccggcgcaaccaggaggagctctaccgcttcctcgcgcgccactccccctactttcgctcccaccgcgccgccatcgaacacgccaccgcttttgataaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaactcggggatcaccagtttgggaaccggaatctcggggaaggtctcgctccacatgcgccggctcatctgcaggacgcccagcatgtcgggcgcggagatcttgaaatcgcagttggggccggtgctctgcgcgcgcgagttgcggtacacggggttgcagcactggaacaccatcagactggggtacttgacgctggccagcacgctcttgtcgctgatctgatccttgtccaggtcctcggcgttgctcaggccgaacggggtcatcttgcacaactggcggcccaggaagggcacgctgtggggcttgtggttacactcgcagtgtacgggcatcagcatcatccccgcgccgcgctgcatattcgggtagagggccttgacgaaggccatgatctgcttgaaagcttgctgggccttggccccctcgctgaagaacaggccgcagctcttcccgctgaactggttattcccgcacccggcatcctgcacgcagcagcgcgcgtcgtggctggtcagttgcaccacgcttctcccccatcggttctgggtcaccttggccttgctgggctgctccttcaacgcgcgctgcccgttctcgctggtcacatccatctccaccacgtggtccttgtggatcatcaccgtcccgtgcagacacttgagctgaccttcgacctcggtgcatccgtggtcccacaggacgcagccggtgcactcccagttcttgtgcgcgatcccgctgtggctgaaaatgtaaccttgcaacaggcggcccatcacggtgctaaaggttttctgggtggtgaaggtcaattgcagcccgcgggcctcctcgttcatccaggtctggcacatcttttggaagatctcggtctgctcgggcatgagcttgaaagcatcgcgcaggccgctgtcgacgcggtagcgttccatcagcacgttcatggcatccatgcccttctcccaggacgagaccagaggcagactcagggggttgcgcacgttcagaataccgggggtcgcgggttcgacgatgcgttttccgtccttgccttccttcaacagaaccggcggctggctgaatcccactcccacgatcacggcatcttcttcctggggcatctcttcgtcggggtctaccttggtcacatgcttggtctttctggcttgcttcttttttggagggctgtccatgggaaccacgtcctcctcggaagacccggagcccacccgctgatactttcggcgcttggtgggcagaggaggtggtggcggcgaggggctcctctcctgctccggcggatagcgcgccgacccgtgaccccggggcggagtggcctctcggtccatgaaccggcgcacgtcctgactgccgccggccattatttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagcgtcgaggagctgtgtcgggcctacgagctcaacctcttctcaccgcgcgtaccccccaaacgccagcccaacggcacatgcgagcccaacccgcgtctcaacttctatcccgtctttgcggtccccgaggccctcgccacctatcacatctttttcaagaaccaaaagatccccgtctcctgccgcgccaaccgcacccgcgccgacgcgctccttgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcatcatgccccacatcgaggccctcgatgagacccaagagcagcgccccgaggacgcccaaccagtggtcagcgacgagatgctcgcgcgctggctcgggacccgcgacccccaggccctggagcagcggcgcaagctcatgctggccgtggtgttggtcaccctagagctggaatgcatgcgccgcttcttcagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctggggcagaccgtgctccactccaccctgaagggcgaggcgcggcgggactacgtccgcgactgcgtctttctctttctctgtcacacctggcaagcggccatgggcgtgtggcagcagtgtctcgaagacgagaacctgaaggagctggacaagcttcttgctagaaacctcaaaaagctgtggacgggcttcgacgagcggaccaccgccgccgacctggccgagatcgttttccccgagcgcctgaggcagacgctgaaaggcggactgcccgacttcatgagccagagcatgatacaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacatcgcctaccactcggacgtgatcgaggacgtgagcggcgagggcctgctcgagtgccactgccgctgcaacctgtgctccccgcaccgctccctggtctgcaacccccagctcctgagcgaaacccaggtcatcggtaccttcgagctgcaaggtccgcaggagtccaccgctccgctgaaactcacgccggggttgtggacttccgcgtacctgcgcaaatttgtacccgaggactaccacgcccacgagataaagttcttcgaggaccaatcgcgcccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagccgctagtggaggaggagatggaagaagaatgggacagccaggcagaggaggacgactgggaggaggaggagagtacagaggaggaagaattggaagaggtggaagaggagcaggcaacagagcagcccgtcgccgcaccatccgcgccggcagccccgccggtcacggatacaacctccgcagcacctccggccaagcctcctcgtagatgggatcgagtgaagggtgacggtaagcacgagcggcagggctaccgatcatggagggcccacaaagccgcgatcatcgcctgcttgcaagactgcggggggaacatcgctttcgcccgccgctacctgctcttccatcgcggggtgaacatcccccgcaacgtgttgcattactaccgtcaccttcacagctaagaaaaaatcagaagtaagaggagtcgccggaggaggaggcctgaggatcgcggcgaacgagccctcgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccaccatgagcaaagagattcccacaccttacatgtggagctatcagccccagatgggcctggccgcgggcgcctcccaggactactccacccgcatgaactggctcagtgccgggccctcgatgatctcacgggtcaacggggtccgtaaccatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctcgggaggcatcggaaccctccagttcgtggaggagtttgtgccctcggtctacttcaaccccttctcgggctcgccaggcctctacccggacgagttcataccgaacttcgacgcagtgagagaagcggtggacggctacgactgaatgtcctatggtgactcggctgagctcgctcggttgaggcatctggaccactgccgccgcctgcgctgcttcgcccgggagagctgcggactcatctactttgagtttcccgaggagcaccccaacggccctgcacacggagtgcggatcaccgtagagggcaccaccgagtctcacctggtcaggttcttcacccagcagcccttcctggtcgagcgggaccggggcgccaccacctacaccgtctactgcatctgtcctaccccgaagttgcatgagaatttttgctgtactctttgtgctgagtttaataaaagctgaaataagaatcttctctggaccttgtcatcgacctcggaatcgcaccgtcttactcaccaaccagaccaaggttcgactgaactgtacaaccaacaggaagtaccttctttggtccttccaaaacacctcactcgctgttgtcaacgcccgtgacgacgacggtgttttaatcccaaacaacctcaccagtggacttactttctctaccaacaaaacaaagctcatccttcaccacccttttgtagagggaacctaccagtgccgacacggaccttgtgttcacaacttccatttggtgaaccttaccagcagcagtacagttgctcctgaaacaactaacctttcttctgatactaacaaacctcgtgtcggaggtgagctttgggttccctctctaacagagggtgggagtcatattgaagtggtcgggtatttgattttaggggtggtcctgggtgggtgcatagcggtgctatatcaccttccttgctgggtcgaaatcagagtctttatctgctgggtcagacactgtggggaggaaccatgaaggggctcttgctgattatcctttccctggtggggggtttactggcctgccacgaacagccacgatgtaacattaccacagggaatgagaggaacgactgctctgtagtgatcaaatgcgagcaccagtgtcctttcaacattacattcaagaataagaccatgggaaatgtatgggtgggattctggcaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggagaacatggttgggttttctttggcttttgtgatcatggcctgcttgatgtcaggtctgctggtaggggctctagtgtggttcctgaagcgcaagcccaggtacggaaatgaggagaaggaaaaattgctataaattctttttctcttcgcagaaccatgaatactttgaccagtgtcgtgctgctctctcttcttgtagcttttagtcagggacaagctgtgcatgagaatcttgaaatttcttatggttgtaatggtacactaatagggccacctaaaaccccagttgagtggtatgatggcagaggacacaaactttgtgcaggaactgatacttttcgcaaggaactaaatcacacatgtaatttacaaaatatgacacttacctttgttaacttaactcataagggtacttactatggttttggcagtgataacaaaaactctaaagtgtaccaggttactattaagccacctgttctgacaacacgcaggcctttattaaaacctgaagatgttgtaattactaagggaagcaacaaaactcttgtgggtcctccagatacaccagttgattggtatgatggttcaggacataaattgtgtaaaggaaaagaagtacactaccctgaactcaatcacacctgtgatgagcagaaccttacactcatatttgtcaatgccacttttaagggaacctattatggatttagaaaagatggtacagacaaaaaggagtatagagtcacaattgatgatttatatgcaaaacaactaaaacaggaaaaagatgaaaagccaaggtctggtcatgacaggcagaaagcaaaaacagatgaaaggcaaaatataaaaacagaagaaaaacagaaaccaaaaacagaggaaaggcatagacaaagagatgttgttaaagaagttagttttaaaactggaactaatcaaactctagtgggtcctcctgggtctaaagttgattggcttaaagtgtcaaatggtgggacatttagtgaactttgtaaaggagatgataaacactattcttgcaattctcaaaacttaacaataatcaacattaccagatctgatgaaggaagctattatggatctaatgatggttcagctcattacagagtttcagtgtatgacccagtacagaaaaaaaaggttatgaaaatacagccacataccacaaaaagaactacaactaaagggactacaaaaagcagcactaatgaatcagatgaaaactttgctttgcaacagggtaatggggaaaatcaatctgacgaatctaatgttccatcagctactgtggcaattgtggtgggagtgattgcgggattcataactctgatcattgtcattctgtgctacatctgctgccgcaagcgtcccagggcttacaatcatatggtagacccactactcagcttctcttactgagactcagtcactctcatttcagaaccatgaaggctttcacagcttgcgttctgattagcatagtcacactcattgcagctgcaggatatactcaaattagcatacctagaggtggtagcattacattaaatggtacttttaaaaataccacatggacaagatatcacacaaatggttggaaaaaaatttgtgaatggaatgttacagcttataaatgtcacaataatgggagcattactattactgccacaaatattacttccggcagatacaaagctgacagttacaaaaaagaaattagaacttcattttttagaaataataagactacattcgaagattctggaaattatgaacaacagaaattgactttatttaatctaacaataattgagccaccaactactaaggcgcccactaccactaaacccaccacagttaggacaactagggaaacaaccacacagcctactactgtacccactacacatccaaccaccacagccagtacaactaccgagaccactactcatactacacagttagacactacagtgcagaatagtactgtgctggttaggtatttgttgagggaggaaagtactactgaacagacagaggctacctcaagtgccttcagcagcactgcaaatttaacttcgcttgcttcggttaatgaaaccgtcatcgcattgaaactggatcaagatcgaggtttggatatgcaaattacttttctaattgtctgtgggatctttattcttgcggttcttctctactatgtcttttgcaaggccagatcaaagtctcatagaacaatctacaggccagtaatcggggatcctcagccactccaagtggaaggaggtctaaggaatcttcttttctctttttcagtatggtgatcagccatgattcctaggttcttcctatttaacatcctcttctgtctcttcaacgtgtgcgctgccttcgcggccgtctcgcacgcctcgcccgactgtctcgggcccttccccacctacctcctctttgccctgctaacctgcacctgcgtctgcagcattgtctgcctggtcatcaccttcctgcagctcatcgactggtgctgcgcgcgctacaattacctacaccgcagtcccgaatacagggacgagaacgtggccagaatcttaaggctcatctgaccatgcagactctgctcatactgctattcctcctatcccctgccctcgctgatgattactctaagtgcaaattcgcggacatatggaatttcttagactgctatcaggagaaaattgatatgccctcctattacttggtgattgttggggtagtcatggtctgctcatgcactttctttgccattatgatctacccctgttttaatcttggctggaactctgttgaggcattcacatacacactagaaagcagttcactagcctccacgccaccacccacaccgcctccccgcagaaatcagttccccatgattcagtacttagaagagccccctccccggcccccttccactgttagctactttcacataaccggcggcgatgactgacaaccacctggacctcgagatggacggccaggcctccgagcagcgcatcctgcaactgcgcgtccgtcagcagcaggagcgggccgccaaggagctcctcgatgccatcaacatccaccagtgcaagaaaggcatcttctgcttggtcaaacaggcaaagataacctacgagctcgtgtccggcggcaagcagcatcgcctcgcctatgagctgccccagcagaagcagaagttcacctgcatggtgggcgtcaaccccatagtcatcacccagcagtcaggcgagaccagcggctgcatccactgctcctgcgaaagccccgagtgcatctactccctcctcaagaccctttgcggactccgcgacctcctcccaatgaactgatgttgattaaaagcccaaaaaccaatcagccccttcccccatttccccatccccaattactcataagaataaatcattggaactaatcattcaataaagatcacttacttgaaatctgaaagtatgtctctggtgtagttgttcagcagcacctcggtaccatcctcccagctttggtactccagtccccggcgggcggcaaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcttccgatggattccaaaacttcccccctggggtcctgtcgctcaaactggctgacccaatcgccatcgccaatgggaatgtttcactcaaggtgggagggggactcactgtggaacaagaaagtggaaatctaaaggtgaaccctaaggctcccttgcaagttgcaacagatggaactttagagctaaattatgatgatccatttaaagtggaaaacaacaagcttagcattaaagctggtcatggtttagcagttgtaaccaaagaaaatacaagcttgcctagcttagttggctcacttgttgttttaactggaaagggcattggaaccggatcaagtgcacatggaggaacaattgatgttagaattggagatggaggaggactatcttttgatgaaaagggagatttagtggcatgggataaaaaaaatgaccagcgcaccctttggacaactccagacccatcaccaaattgcaaagtggaaactgaaaaggactcaaagcttactttaattttaacgaaatgcggaagtcaaattttggcaaatgtgtccttgcttgttgtaaagggaaaatatgaaaatataagtgattcagttaatccaaaaacatttccaataaaattactttttaatgataaaggtattcttttaaaagaatcaaaccttgatggaacatattggaactttagaagtggcagcaataatgttccaaagccatatgaaaatgctgttggttttatgccaagcacaacagcttatccaaagtatgattctagcgctccaactaatccagaagataaaaaaagtagtggaaaaaataaaattgtgagtaatatttattttggaggagaaatttatcaacctggcctaatagttattaagtttaatcaggaaaataactgtgcttattctatcacatttgaattcggatggggaaaaacctatacggcagccataccctttgatacttcttctttcaccttttcatacattgcccaagaatgaaaacgagaacgaataaagtatttttcaactaatcaagtctttattgaatttttacaccagcacgggtagtcagtctcccaccaccagcccatttcacagtataaacaattctctcagcacgggtggccttaaataggggaatgttctgattagtgcgggaactgatcttggggtctataatccacacagtttcctggcgagccaaacgggggtcggtgattgagatgaagccgtcctctgaaaagtcatccaagcgggcctcacagtccaaggtcacagtctggtggaatgagaagaacgcacagattcatactcggaaaacaggatgggtctgtgcctctccatcagcgccctcaacagtctctgccgccggggctcggtgcggctgctgcagatgggatcgggatcgcaagtctctctgactatgatccccacagccttcagcatcagtctcctggtgcgtcgggcacagcaccgcatcctgatctcgctcatgttctcacagtaagtgcagcacattatcaccatgttattcagcagcccataattcagggtgctccagccaaagctcatgttgggg

SEQ ID NO: 1422 - DNA, 32767 bp, Human mastadenovirus D
catcatcaataatataccccacaaagtaaacaaaagttaatatgcaaatgagcttttgaatttagggcgtggccgacgctgattggctgttgcaagaaccgttagtgacgtcatgacgcacgacgtcaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagtctgagaaaaatgagacacctgcgcctcctgcctggaactgtgcctatggacatggccgcattattgctgcaggactttgtggatacagtattggaggacgaactgcaaccaactccgttcgagctgggacccacacttcaggacctatatgatctggaggtagatgcccaggatgacgacccgaacgaagaggctgtgaatttaatatttccagaatctctgattcttcaggctgacatagccagcgaagctgtacctacaccacttcatacaccgactctgtcgcccatacctgaattggaagaggaggacgaactagacctccggtgttatgaggaaggttttcctcccagcgattcagaggacgaacggggtgagcagagtatggctataatctcagactatgcttgtgtggttgtggaagagcattttgtgttggacaatcctgaggtgccagggcaaggatgtagatcctgccaatatcaccgggatcagaccggagactcaaatgcttcctgcgctctgtgttacatgaaaatgagcttcagctttatttacagtaagtggagtgaatgtgagagaggctgagtgcttaacacatcactgtgtatcgcttgaacagctgtgctaagtgtggtttatttttgttactaggtccggtgtcagaggatgagtcatcaccctcagaagaagaccacccgtctccccctgatctcacagatgacacgcccctgcaagtgttcagacccaccccagtcagacccagtggcgagaggcgagcggctgttgacaaaattgaggacttgttgcaggacatgggtggggatgaacctttggacctgagcttgaaacgccccaggaactaggcgcagctgcgcttagtcatgtgtaaataaagttgtacaataaaagtatatgtgacgcatgcaaggtgtggtttatgactcatgggcggggcttagtcctatataagtggcaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataacgaggaatttgaaaatctttttgctgactgctctggcctgctagattctctgaatcttggccaccagtcccttttccaggaaagggtactccacagtcttgatttttccagcccagggcgcactacagccggggttgcttttgtggtttttctggttgacaaatggagccagaacacccaactgagcaggggctacatcctggacttcgcggccatgcacctgtggaggtcctgggtcaggcagcggggacagagaatcttgaactactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagtcaagagggagaggagcgatgggggcaataccggaatgatgaccgagctgacggccagcctgatgaatcgcaagcgcccagaacgcattacctggcacgagctacagatggagtgcagggatgaggtgggcctgatgcaggataaatatggcctggagcagataaaaacccactggttgaacccagatgaggattgggaggaagccattaagaaatatgccaagatagccttgcgcccagattgcaagtacagggtgaccaagaccgtgaatatcagacatgcctgctacatctcggggaacggggcagaggtggtcatcgataccctggacaaggccgcctttaggtgttgcatgatgggaatgagagccggagtgatgaatatgaattccatgatcttcatgaacatgaagttcaatggagagaagtttaatggggtgatgttcatggccaacagccacatgaccctgcatggctgcagtttctttggcttcaacaatatgtgtgcagaggtctggggcgctgctaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacattgctcttccctggagacgggctgcttctgcctggtgaagggcacagcctcgatcaagcataatgtggtgaagggctgcacggatgagcgcatgtacaacatgctgacctgcgactcgggggtctgccatatcctgaagaacatccatgtgacctcccaccccagaaagaagtggccagtgtttgagaataacctgctgatcaagtgccatatgcacctgggtgccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcttgtaccgggaccgagttcagctccagtggggaggacacagattagaggtaggttttgagtagtgggcgtggctaaggtgagtataaaggcggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcgctcgacagcaccgccgcagccgcggcagccgcagccgccatgacagcgacgagactggcctcgagctacatgcccagcagcggtagcagcccctctgcgcccagttccatcatcgccgaggagaaactgctggccctgctggccgagctggaagccctgagccgccagctggccgccctgacccagcaggtgtccgatctccgcgagcagcagcagcaaaataaatgattcaataaacacagattctgattcaaacagtaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcaaagcggttgagctgggagggatgcatgcggggggagatgatgtgcagtttggcctggatcttgaggttggcgatgttgccgcccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcgatgggaccgtgggctgcggctttggcaaagacgtttctggggtcagagacatcataattatgctcctgggtgagatcatcataagacattttaatgaatttggggcggagggtgccagattgggggactatggttccctcgggtcccggggcaaagttcccctcacagatctgcatctcccaggctttcatctcggagggggggatcatgtccacctgcggtgcgatgaaaaaaacggtttccggggcgggagtgatgagctgcgaggagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccggacgagctcgccgaggaggcggtccccgcccagcgagagcagctcttgcagggaagcaaagtttttcaggggcttgagcccgtcggccatgggcatcttcgcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgcgtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagctcgtagttgagggcctcggcggcgtggcccttggcgcggagcttgccattggaagagcgcccgcaggcgggacagaggagggattgcagggcgtagagcttgggcgcgagaaagacggactcgggggcgaaggcgtccgccccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcattgtcaaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctaaaaacgaggaggatttgatgttggcttgccctgccgcgatgctttttaggagactttcatccatctggtcagaaaagactatttttttattgtcaagcttggtggcgaaggagccatagagggcgttggagagaagcttggcgatggatctcatggtctgatttttgtcacggtcggcgcgctccttggccgcgatgtttagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcagggggatccgcatcgatggtgaagatgcccggacagagttccttgtcaaaataatcgatttttgaggatgcatcatccaaggccatctgccactcgcgggcggccagcgctcgctcgtaggggttaaggggcggaccccagggcatgggatgcgtgagggcggaggcgtacatgccgcagatgtcatacacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcatgcgagttggatgagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcatactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccggcacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctcgagcgcccactcctggagatgtgggttggcttgcatgaaggaagcccagagctcgcgggccatgagggtctggagctcgtcgcgaaagaggcggaactgctggcccacggccatcttttcgggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtaacaaagagccgctccgtgcgaggatgagagccgattgggaagaactggatttcctgccaccagttggacgagtggctgttgatgtgatgaaagtagaaatcccgccggcgaaccgagcactcatgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcgctttagaagcggtgtcgcgggcgcgctcccggcggcagcggcggttccggccccgcgggcaggggcggcagaggcacgtctgcgtggcgctcgggcaggtcccggtgctgcgccctgagagcgctggcgtgcgcgacgacgcggcggttgacatcctggatctgccgcctctgtgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatctcctcctcctggagatcgccgcggcccgcgcgctccacggtggcggcgaggtcattcgagatgcgacccatgagctgcgagaaggcgcccaggccgctctcgttccagacgcggctgtagaccacgtccccgtcggcgtcgcgcgcgcgcatgaccacctgcgcgaggttgagctccacgtgccgcgtgaagacggcgtagttgcgcaggcgctgggagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcgttgcgggccgagaccgtgagctcgtcttccaggagcctgatgagctcggcgatggtggcgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgactatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacgaagcggtggtaggccccggtgttgatggtgtaggtgcagttggccatgatcgaccagttgacggtctgcaggccgggctgcacgacctcggagtacctgagccgcgagaaggcgcgcgagtcgaagacgtagtcgttgcaggtgcgcaccaggtactggtagccgactaggaagtgcggcggcggctggcgatagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgcggggggtcgctagacttgaaagcggccgaaaaccccgccgggtagtggctcgcgcccgtagtctggagaagcatcgccagggttgagtcgcggcagaacccggttcgaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcgagactgggggcgccgtccccggagcgacacccccgcgtgcagctgcagaaggacgtgcgcccggcgtacgtgcctgcgcagaatctgttcagggaccgcagcggggaggagcccgaggagatgcgcgactgccggtttcgggcgggcagggagctgcgcgagggcctggaccgccagcgagtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccttgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctgagcgaccgcgagctgatgctgagcctgcgccgggcgctggtagggggcgccgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggatcggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggtgccccagagcgaggtgtaccagtcgggcccggactactttttccagacgagccggcagggcctgcagacggtgaacctgagccaggctttcaagaatctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagccgcgcgctggggcagaacgacaccgacagtctgagggccaccctgaactttttgctgaccaatagacagcagaagattccggcgcagtacgcactgtcggccgaggaggaaaggatcctgagatatgtgcagcagagcgtagggctgttcctgatgcaggagggcgccacccccagcgccgcgctggacatgaccgcgcgcaacatggaacctagcatgtacgccgccaaccggccgttcatcaataagctgatggactacctgcaccgcgcggcggccatgaacacggactactttaccaacgccatattgaacccgcactggctcccgccgccggggttctacacgggcgagtacgacatgcccgaccccaacgacgggttcctgtgggacgacgtggacagcgcggtgttctccccgaccttgcaaaagcgccaggaggcgccgccgagcgagggcgcggtgggtcggagtccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggccaacccgttcgcgcatctgcagcccaaactggggcggcggatgttttgaaaagcaaaataaaactcaccaaggccatagcgtgcgttctcttccttgttagagatgaggcgcgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcaccccagccgaggccagcacgcagacgataaattttgacgagcggtcccggtggggcggtgatctgaagaccattctgcacaccaacatgcccaatgtgaacgagtacatgttcaccagcaagtttaaggcgcgggtgatggtggctaggaagcatcccaaagaggttacagatgagaatgatagaagcaaggatatcttagagtatgagtggtttgagtttaccctgcccgagggcaacttttccgagaccatgaccatagacctgatgaacaacgccatcttggaaaactacttgcaagtggggcggcaaaatggcgtgctggagagcgatatcggagtcaagtttgacagcaggaatttcaagctgggctgggacccggtgaccaagctggtgatgccaggggtctacacctacgaggccttccacccggacgtggtgctgctgccgggctgcggggtggacttcaccgaaagccgcctgagcaacctcctgggcattcgcaagaagcaacctttccaagagggcttcagaatcatgtatgaggatctagaagggggcaacatccctgccctgctggatgtggatgcatacctcaaaagcaagaatgatctggaagaggctaccaagaaagcgaacacagctgctgccaatggaggtggtgaaactaggggagatacttttctcaccaccgaacagctaagagccgctggcaaggagctggttattaagcccatcaaggaagatgctagcaagaggagctataatgtcataggggatacccatgacaccctgtaccgaagctggtacctgtcctatacctacggggaccccgagaagggggtgcagtcgtggacgctgctcaccaccccggacgtcacctgcggcgcggagcaagtctactggtcgctgccggacctcatgcaagaccccatcaccttccgctccgcccagcaagtcagcaactaccccgtggtcggcgccgagctcatgcccttccgcgccaagagcttttacaacgacctcgccgtctactcccagctcatccgcagctacacttccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctctccagtcgcaccttctaaaaaatgtctattctcatctcgcccagcaataacaccggctggggtcttactaggcccagcaccatgtacggaggagccaagaagcgctcccagcagcaccccgtccgcgtccgcggccacttccgcgctccctggggcgcttacaagcgcgggcggacttccaccgctgccgccgtgcgcaccaccgtcgacgacgtcatcgactcggtggtcgccgacgcgcgcaactacacccccgccccctcgaccgtggacgcggtcatcgacagcgtggtggccgacgcgcgcgactatgccagacgcaagagccggcggcgacggatcgccaggcgccaccggagcacgccagccatgcgcgccgcccgggctctgctgcgccgcgccagacgcacgggccgccgggccatgatgcgagccgcgcgccgcgccgccgccgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggatgaaacgtagctatgacgaggtgtacggcgacgacgacatcctggaccaggcggcggagcgggcgggcgagttcgcctacgggaagcggtcgcgcgaagaggagctgatctcgctgccgctggacgagagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctctaccgccaccgcctctacatctacggttgccacggctaccgagcctccaaggaggcgaagatggggcgccgccagccggctgatgcccaactacgtgttgcatccttccatcatcccgacgccgggctaccgcggcacccggtactacgccagccgcaggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaatccgtgtgctgtgatactgttgcagagagatggctctcacttgccgcctgcgcatccccgtcccgaattaccgaggaagatcccgccgcaggagaggcatggcaggcagtggcctgaaccgccgccggcggcgggccatgcgcaggcgcctgagtggcggctttctgcccgcgctcatccccataatcgccgcggccatcggcacgatccctggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggaactatgggaacaaggcctggaatagtagcacggggcagttgttaagggaaaagctcaaagaccagaacttccagcagaaggtggtggacggtctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggttgacgagccgccatcgtacgaggaggccgtcaaggccggcatgcccaccacgcgcatcatcgcgccgctggccacgggtgtaatgaaacccgccacccttgacctgcctccaccacccacgcccgctccaccgaaggcagctccggtcgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggctcccacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggatcgcggtcccagcttcaaaccctactcgggaacggcttacaacagtctggcccccaagggcgcccccaactccagtcagtgggttgcgaaagacaccaatgctaccgatcaagcattaaaaacccacacacatggcgtagctgctatggggggaacagatatcacagcaaagggtttgcaaattggtgttgacacaactgaaaacaagaatgagcctatttatgcaaatgaaatctatcagccagagcctcaaataggagaagaaaacttgcaagatgttgaaaacttttatggcggcagaactcttaaaaaggaaacaaaaatgaaaccctgctatggctcatttgccagacccacaaatgaaaaaggcggtcaagccaaatttttaactgacggcgatggtcagctaactaaaaatcatgatatcacaatgaatttctttgacactcctggaggaacagttggtcaggatactgaacttgaagcagacattgttatgtatgctgagaatgtgcatctggaaactccagacacgcatgtggtgtacaaaccaggaacttctgatgagagttctgaaattaatttaactcagcagtccatgccaaacaggcccaactacattggcttcagggacaactttgtgggtctcatgtattacaacagtactggcaacatgggtgtgctggccggtcaggcctctcagttgaatgctgtggtcgacttgcaagacagaaacaccgagctgtcttaccagctcttgctagattctctgggtgatagaaccagatactttagcatgtggaactctgcggtggacagctatgatcccgatgtcaggatcattgagaatcacggcgtggaagatgaacttccaaactattgcttcccattggatggagctggcactaatgctacataccaaggtgtaaaagttaaaaatggcgaagatggagatgtaaacgcagattgggaaaaagatccaaaccttgcttctcgaaaccaaatatgcaagggaaacatcttcgccatggagatcaacctccatgccaacctgtggaagagttttctgtactcgaacgtggccctgtacctgcccgactcctacaagtacacgccggccaacgtcacgctgcccgccaacaccaacacctacgagtacatgaacggccgcgtggtagccccctcgctggtggacgcctacatcaacatcggcgcccgctggtcgttggaccccatggacaacgtcaaccccttcaaccaccaccgcaatgcgggcctgcgctaccgctccatgcttctgggcaacggccgctacgtgcccttccacattcaagtgccccaaaagttctttgccatcaagaacctgctcctgctcccgggctcctacacctacgagtggaacttccgcaaggacgtcaacatgatcctgcagagttccctcggaaacgatctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggatggagtttcacccggctcaagaccaaggaaactccctccctcggctcgggtttcgacccctactttgtctactcgggctccatcccctatctcgacgggaccttctacctcaaccacaccttcaagaaggtctccatcatgttcgactcctcggtcagctggcccggcaacgaccggctgctcacgccgaacgagttcgaaatcaagcgcagcgtcgacggggagggctacaacgtggcccaatgcaacatgaccaaggactggttcctcgtccagatgctctcccactacaacatcggctaccagggcttccatgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcacccaccatgcgccaggggcagccctaccccgccaacttcccctacccgctcatcggctccaccgcagtgccctccgtcacccagaaaaagttcctctgcgacagggtcatgtggcgcatccccttctccagcaacttcatgtccatgggcgcccttaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggaaacgccaccacctaagcatgagcggctccagcgaaagagagctcacggccatcgtgcgcgacctgggctgcgggccctactttttgggcacccacgacaagcgcttcccgggtttcctcgccggcgacaagctggcctgcgccatcgtcaacacggccggccgcgagaccggaggcgtgcactggctagccttcggctggaacccgcgctcgcgcacctgctacatgttcgacccctttgggttctcggaccgccggctcaagcagatttacagcttcgagtacgaggccatgctgcgtcgcagcgccctggcctcctcgcccgaccgctgtctcagcctcgagcagtccacccagaccgtgcaggggcccgactccgccgcctgcggacttttctgttgcatgttcttgcatgccttcgtgcactggcccgaccgacccatggacggaaaccccaccatgaacttgctgacgggggtgcccaacggcatgctacaatcgccacaggtgctgcccaccctcaggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggaacttgggctgccacttgaactcggggatcaccagtttgggaaccggaatctcggggaaggtctcgctccacatgcgccggctcatctgcagggcgcccaatatgtcaggcgcggatatcttgaaatcgcagttgggaccggtactctgcgcgcgcgagttgcggtacacggggttgcagcactggaacaccatcagactggggtgcttcacactggccagcacgctcttgtcgctaatctgatccttgtccaggtcctcggcgttgctcaggccgaacggagtcatcttgcacagctggcggcccaggaagggcacgctgtgaggcttgtggttacactcgcagtgaacgggcatcagcatcatccccgcgccgcgctgcatattcgggtagagggccttgacaaaggctgagatctgcttgaaagcttgctgggccttggccccctcgctgaagaacagcccgcagctcttcccgctgaactggttattcccgcacccggcatcatgcacgcagcagcgcgcgtcatggctggtcagttgcaccacgctccgtccccagcggttctgggtcaccttggccttgctaggctgctccttcaacgcgcgctggccgttctcgctggtcacatccatctccaccacgtggtccttgtggatcatcaccgtcccgtgcagacacttgagctggccttccacctcggtgcagccgtgatcccacagggcgcagccggtgcactcccagttcttgtgcgcaatcccgctgtggctgaagatgtaaccttgcaacatgcggcccatgacggtgctaaatgatttactggtgctgaaggtcagttgcaggccgcgggcctcctcgttcagccaggtctggcacatcttctggaagatctcggtctgctcgggcatcagcttgtaggcatcgcgcaggccgctgtcgacgcggtagcgttccatcagcacgttcatggtatccatgcccttctcccaggacgagaccagaggcagactcagggggttgcgcacgttcaggacaccgggggtcgcgggctcgacgatgcgttttccgtccttgccttccttcaacagaaccggaggctggctgaatcccactcccacgatcacggcatcttcctggggcatctcttcgtctgggtctaccttggtcacatgcttggtcttcctggcttgcttcttttttggagggctgtccacggggaccacgtcctcctcggaagacccggagcccacccgctgatactttcggcgcttggtgggcagaggaggtggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctggccgaccggagcgaaacccccctcagtgtcgaggagctgtgtcgggcctacgagctcaacctcttctcgccgcgcgtgccccccaaacgccagcccaacggcacatgcgagcccaacccgcgtctcaacttttaccccgtctttgcggtccccgaggcccttgccacctatcacatctttttcaagaaccaaaagatccccgtctcctgccgcgccaaccgcacccgcgccgacgcgctccttgctctgggacccggcgcgcgcatacctgatatcgcttccctggaagaggtgcccaagatcttcgaagggctcggtcgggacgagacgcgcgcggcgaacgctctgaaagaaacagcagaggaagagggtcatactagcgccctggtagagttggaaggcgacaacgccaggctggccgtgcttaagcgcagcgtcgagctcacccacttcgcctaccccgccgtcaacctcccgcccaaggtcatgcgtcgcatcatggatcagctcatcatgccccacatcgaggccctcgatgagacccaagagcagcgcccagaggacacccgtcccgtggtcagcgacgagcagctcgcgcgctggctcgggacccgcgacccccagaccctggagcagcggcgcaaactcatgctggccgtggtcctggtcaccctcgagctcgaatgcatgcgccgcttcttcagcgaccccgagaccctgcgcaaggtcgaggagaccctgcactacactttcaggcacggtttcgtcaggcaggcaagcaagatttccaacgtggagctgaccaacctggtctcctgcctggggatcctgcacgagaaccgcctggggcagaccgtgctccactcgaccctgaagggcgaggcgcggcgagactatgtccgcgactgcgtctttctctttctatgccacacatggcaagcagccatgggcgtgtggcagcagtgtctcgaggacgagaacctgaaggagctggacaagcttcttgctagaaatcttaaaaagctgtggacgggcttcgacgagcgtaccgtcgcctcggacctggccgagatcgtcttccccgagcgcctgaggcagacgctgaaaggcgggctgcccgacttcatgagccagagcatgttgcaaaactaccgcactttcattctcgagcgatctgggatgctgcccgccacctgcaacgccttcccctccgactttgtcccgctgagctaccgcgagtgtcccccgcctctgtggagccactgctacctcttgcagctggccaactacatcgcctaccactcggacgtgatcgaggacgtgagcggcgaggggcttctcgagtgccactgccgctgcaacctgtgctccccgcaccgctccctggtctgcaacccccagctcctcagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcatgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcggcagggctatcgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaaatcagaagtaagaggagtcgccggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccaaatgggcctggccgcgggcgcctcccaggactactccacccgcatgaactggctcagtgccggcccctcgatgatctcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggctcgccaggcctctacccggacgagttcataccgaacttcgacgcagtgagagaagcggtggacggctacgactgaatgtcccatggtgactcggctgagctcgctcggttgaggcatctggaccattgccgccgcctgcgctgctttgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgtgaccggggcgccaccacctacaccgtctactgcatctgtcctaccccgaagttgcatgagaatttttgctgtactctgtgtgctgagtttaataaaagctaaactcctacaatactctgggatcccgtgtcgtcgcactcgcaacgagaccttcaaccttaccaaccagactgaggtaaaactcaactgcagaccaggggacaaatacatcctctggctctttgagaacacttccttcgcggtctccaacacctgcgccaacgacggtattgaaatacccaacaaccttaccagtggactaacttacaccaccagaaagactaagctagtactctacaatccttttgtagagggaacctaccactgccagagcggaccttgcttccacactttcactttggtgaacgttaccggcagcagcacagccgctccagaaacatctaaccttctttctgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatttgctgggtcatacattgttgggaggaaccatgaagaggctcttgctgattatcctttccctggttgggggtgtactgtcatgccacgaacagccacgatgtaacatcaccacaggcaatgagaggagtgtgatatgcacagtagtcatcaaatgcgagcatacatgtcctctcaacatcacattcaagaataagaccatgggaaatgcatgggtgggcgattgggaaccaggagatgagcagaactacacggtcactgtccatggtagcaatggaaatcacactttcggtttcaaattcatttttgaagtcatgtgtgatatcacactgcatgtggctagacttcatggcttgtggccccctaccaaggagaacatggttgggttttctttggcttttgtgatcatggcctgtgcaatgtcaggtctgctggtaggggctataatatggttcctgaggctcaagcccaggtatggaaatctggaaaaggaaaaattgctataaatgtttttctttccacagcatcatgaatacagtgatccgtatcgtgctgctctctcttcttgtagcttttagtcaggcaggatttcatactatcaatgctacatggtgggctaatataactttagtgggaccctcagatacgccagtcacctggtatgataaacagggaatgcagttctgtgatggaaatacagttaagaatcctcaaataagacatgagtgtaatgagcaaaaccttacactaattcatgtgaacaaaacccatgaaagtacatacatgggttataatagacagagtactcataaggaagactataaagtcatagttataccgcctcctcctgctactgtaaagccacagtcaggtccagagtatgtatatgttaatatgggagagaataaaacattagttggacctccgggaataccagttacttggtatgacggagaaggaaataaattctgcgatggagaaaaagttgaacatgcagaatttaatcatacatgtgacgtgcaaaatcttacactgttgtttataaatcttacacatgatggggcttatcttggctataatcaccagggaactaaaagaacttggtatgaggttgtagtgacagatggttttccaaaatcaggggagatgaaaatcgaagatcagagtagacaaacagaacaaaaacaaactgggcaaaaacaaaatgagcataaacagggtgggcagaaacaggaggggcaaaaagagacaagtcaaaagaaagctaatgacaaacagaaggctacacacaggaggccatcaaaactaaagccgcacacacctgaagcaaaactgattacagtttctagtgggtctaacttaacattacttgggccagatggaaaggtcacttggtatgatgatgatttaaaaagaccatgtgaacctggatataagttaaactgtaagtgtgacaatcaaaacctaaccctaatcaatgtaactaaactttatgagggagtttactatggtactaatgacggaggcaacggcaaaagatacagagtaaaagtaaacactacgaattctcaaaatgtgaaaattcagccgtacaccaggcctactactcctgatcagaaacacagatttgaattgcaaattgattataatcaagacaatgacaaaattccatcaactactgtggcaatcgtggtgggtgtgattgcgggcttcataactctgatcattgtcattctgtgctacatctgctgccgcaagcgtccaagggcatacaatcatatggtagacccactactcagcttctcttactgagactcagtcactttcatttcagaacaatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttacagcctataaatgcttcagtaatggaagcattacaattactgccactgctaatattacttctggcacaatcaaggcagaaagctataaaaatgaaatgaaaaaaatggtatataaaaataacaagacaacatttgaagattctggaaattatgagtatcagaaattatctttttataatctgacaattattgagctgccaactactaaggctcccacagttaggacaacgcagcctaccactgtacccactacacatccaaccaccacagccagtacaactactgagaccacaactcacactacacagttagacactacagtgcagaatagtactgtattggttaggtatttgttaagagaggaaagtactactgaacagacagaggctacctcaagtgccttcagcagcactgcaaatttaacttcgcttgcttggactaatgaaaccggagtatcattgatgcatggccagccttactcaggtttgaatattcaaattacttttctggttgtttgtgggatctttattcttgtggttcttctgtactttgtctgctgcaaagccagagaaaaatctaggaggcccatctacaggccagtaatcggggatcctcagcctctccaagtggaagggggtctaaggaatcttctcttctctttttcagtatggtgattcagccatgattcctaggttcttcctatttaacatccttttctgtctattcaacgtgtgcgctgccttcgcggccgtctcgcacgcctcgcccgactgtctcgggcccttccccacctacctcctctttgccctgctcacctgcacctgcgtctgcagcattgtctgcctggtcgtcaccttcctgcagctcatcgactggtgctgcgcgcgctacaattatctccaccacagtcccgaatatagggacgagaacgtagccagaatcttaaggctcatttgaccatgcagactctgctcatactgctatccctcctctcccctgccctcgctgatgatgattactctaagtgcaaatttgtggagctatggaatttcttagactgctatgatgctaaaatggatatgccatcctattacttggtgattgtggggatagtcatggtctgctcctgcactttctttgccatcatgatctacccctgttttgatctcggctggaactctgttgaggcattcacatacacactagaaagcagttcactagcctccacgccaccacccacacctcctccccgcagaaatcagtttcccctgattcagtacttagaagagccccctccccgacccccttccactgttagctactttcacataaccggcggcgatgactgaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccaacggcaaacagcatcgcctcacctatgagatgccccagcagaagcagaagttcacctgcatggtgggcgtcaaccccatagtcatcacccagcagtcgggcgagaccaacggctgcatccactgctcctgcgaaagccccgagtgcatctactccctcctcaagaccctttgcggactccgcgacctcctccccatgaactgatgttgattaaaagcccagaaaccaatcagccccttccctatttccccagccccttgcccaattattcataagaataaatcattggaattaatcattcaataaagatcgcttacttgaaatctgaaagtatgtctttggtgtagttgtttagcagcacctcggtaccctcctcccagctctggtactccagtccccggcgggcggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcctccgatggattcaaaaacttcccccctggggtcctgtcactcaaactggctgacccaatcaccatcaccaatggggatgtttcgctcaaggtgggagggggtcttactttgcaagatggaactggaaaactaacagtcaatactgaaccacctttgcaacttacaaataacaaattaggtattgctttagacgctccatttgatgttataggcgataagctcacactgttagcaggccatggcttgtctatcataacaaaagaaacatcaacactgcctggcttaattaatactcttgtagtattaactggaaagggtattggaacagaatcaacagataatggtgggagcatatgcgttagagttgcagaaggcggaggcttatcatttaatgatgatggagacttggtagcatttaataaaaaagaagataagcgcaccctatggacaactccagatccatctccaaattgcaaaatacttgaggataaagactcaaaactaacgttagttcttacaaagtgtggtagtcaaattctaggaaatgtgtctttgttggtagttaagggaaagtttagtaatatcaataataccacaaacccaaatgacaccgataaacaaataacaattaagttgttgtttgatgcaaacggagttcttaaacagggctctactatggattcttcatattggaattatagaagtgataattccaatttatcccaaccatacaaacaagcagttggattcatgcctagtaagactgcttatcctaagcaaaccaaacccgccaacaaagaaataagtcaggcaaaaaataaaattataagcaatgtttaccttggaggtaaaattgatcaaccgtgtgttattataattacttttaatgaagaagctgacagcgagtattctattgtgttttactttaaatggtacaaaacttatgaaaatgttcagttcgactcttcatcctttaccttctcctacatcgcccaagaatgaaagaccaataaacgtgtttttcatttaaaatttcatgtatctttattgatttttacaccagcacgggtagtcagtctcccaccaccagcccatttcacagtgtacacggttctttcagcacgggtggccttaaataggggaatgttctgattagtgcgggaactggacttggggtctataagccacacagtttcctggcgagccaaacgggggtcggtgattgagatgaagccgtcctctgaaaagtcttccaagcgggcctcacagtccaaggtcacagtctggtggaatgagaagaacgcacagattcatactcggaaaacaggatgggtctgtgcctctccatcagtgccctcaacagtctctgccgccggggctcggtgcggctgctgcagatgggatcgggatcgcaagtctctctgactatgatccccacagccttcagcatcagtctcctggtgcgacgggcacagcaccgcatcctgatctcggccaggttctcacagtaagtgcaacatagaatcaccatgttattcagcagcccataattcagggcgctccagccaaagctcatgttggggatgatggaacccacgtgaccatcgtaccagatgcggcagtatatcaggtgc

SEQ ID NO: 1423 - DNA, 32767 bp, Human mastadenovirus D
catcatcaataatataccccacaaagtaaacaaaagttaatatgcaaatgagcttttgaattttaacggttttggggcggagccaacgctgattggacgagaagcggtgatgcaaataacgtcacgacgcacggctaacggccggcgcggaggcgtggcctaggccggaagcaagtcgcggggctaatgacgtataaaaaagcggactttagacccggaaacggccgattttcccgcggccacgcccggatatgaggtaattctgggcggatgcaagtgaaattaggtcattttggcgccaaaactgaatgaggaagtgaaaagtgaaaaatacctgtcccgcccagggcggaatatttaccgagggccgagagactttgaccgattacgtggggtttcgattgcggtgtttttttcgcgaatttccgcgtccgtgtgaaagtccggtgtttatgtcacagatcagctgatccacagggtatttaaaccagttgagcccgtcaagaggccactcttgagtgccagcgagtagagatttctctgagctccgctcccaaagtgtgagaaaaatgagacacctgcgcctcctgtcttcaactgtgcctattaacatggccgcattattgctggaggactatgtgagtacagtattggaggacgaactacatccatctccatttgagctgggacctacacttcaggacctttatgatttggaggtagatgcccatgatgacgacccaaacgaagaggctgtgaatttaatatttccagaatctctgattcttcaggctgacatagccagcgaagctgtacctacaccacttcatacaccgactttgtcacccatacctgaattggaagaggaggacgagttagacctccgatgttatgaggaaggttttcctcccagcgattcagaggacgaacagggtgagcagagcatggctctaatctcagaatatgcttgtgtggttgtggaagagcattttgtgttggacaatcctgaggtgcccgggcaaggctgtagatcctgccagtaccaccgggataagaccggagacacaaacgcctcctgcgctctgtgttacatgaaaaagaacttcagctttatttacagtaagtggagtgaatgtgagagaggctgagtgcttaacacataactgggtgatgcttaaacagctgtgctaagtgtggtttatttttgtttctaggtccggtgtcagaggatgagtcatcaccctcagaagaaaaccacccgtgtccccctgagctgtcaggcgaaacgcccctgcaagtgcacaaacccaccccagtcagacccagtggcgagaggcgagcagctgttgaaaaaattgaggacttgttacatgacatgggtggggatgaacctttggacctgagcttgaaacgccccaggaactaggcgcagctgtgcttagtcatgtgtaaataaagttgtacaataaaagtatatgtgacgcatgcaaggtgtggtttatgactcatgggcggggcttagtcctatataagtggcaacacctgggcactgggcacagaccttcagggagttcctgatggatgtgtggactatccttgcagactttagcaagacacgccggcttgtagaggatagttcagacgggtgctccgggttctggagacactggtttggaactcctctatctcgactggtgtacacagttaagaaggattataacgaggaatttgaaaatctttttgctgattgctctggcctgctagattctctgaatctcggccaccagtcccttttccaggaaagggtactccacagccttgatttttccagcccagggcgcactacagccggggttgcttttgtggtttttctggttgacaaatggagccagaacacccaactgagcaggggctacattctggacttcgcagccatgcacctgtggagggcatgggtgaggcagcggggacagagaatcttgaactactggcttatacagccagcagctccgggtcttcttcgtctacacagacaaacatccatgttggaggaagaaatgaggcaggccatggacgagaacccgaggagcggcctggaccctccgtcggaagaggagctgaattgaatcaggtatccagcttgtacccagagcttagcaaggtgctgacatccatggctaggggagtgaagagggagaggagcgatgggggcaataccgggatgatgaccgagctgacggccagcctgatgaatcgcaagcgcccagagcgcattacctggcacgagctacagatggagtgcagggatgagttgggcctgatgcaggataaatatggcctggagcagataaaaacacattggttgaacccagatgaggattgggaggaggccattaagaaatatgccaagatagccctgcgcccagattgcaagtacatagtgaccaagaccgtgaatattagacatgcctgctacatttcagggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttctttggcttcaacaatatgtgcgccgaggtctggggcgcttccaagatcaggggatgtaagttttatggctgctggatgggcgtggtcggaagacctaagagcgagatgtctgtgaagcagtgtgtgtttgagaaatgctacctgggagtctctaccgagggcaatgctagagtgagacactgctcttccctggatacgggctgcttctgcctggtgaagggtacggcctctctgaagcataatatggtgaagggctgcacagatgagcgcatgtacaacatgctaacatgcgactcgggggtctgtcatatcctgaagaacatccatgtgacctcccaccccagaaagaagtggccagtgtttgagaataacctgatgatcaagtgccatatgcacctgggtgccagaaggggcaccttccagccgtaccagtgcaactttagccagaccaagctgctgttggaaaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtttgagtagtgggcgtggctaatgtgagtataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatctacggtggatgggcgtccagtgcttccagcaaattcctcgaccatgacctacgcgaccgtggggagctcgtcgcttgacagcaccgccgcagccgcggcagccgcagccgccatgacagcgacgagactggcctcgagctatatgcccagcagcggtagcagcccctctgtgcccagttccatcatcgccgaggagaaactgctggccctgctggccgagctggaagccctgagccgccagctggccgccctgacccagcaggtgtccgatctccgcgagcaacagcagcagcaaaataaatgattcaaacagcaaagcatctttattatttattttttcgcgcgcggtaggccctggtccacctctcccgatcattgagagtgcggtggattttttccaggacccggtaaaggtgggattggatgttgaggtacatgggcatgagcccgtcccgggggtggaggtagcaccactgcatggcctcgtgctctggggtcgtgttgtagataatccagtcatagcaggggcgctgggcgtggtgctggatgatgtccttgaggaggagactgatggccacggggagccccttggtgtaggtgttggcaaagcggttaagctgggagggatgcatgcggggggagatgatgtgcagtttggcctggatcttgaggttggcgatgttgccacccagatcccgccgggggttcatattgtgcaggaccaccagaacggtgtagcccgtgcacttggggaacttatcatgcaacttggaagggaatgcgtggaagaatttggagacgcccttgtgcccgcccaggttttccatgcactcatccatgatgatggcaatgggcccgtgggctgcggctttggcaaaaacgtttctggggtcagagacatcataattatgctcctgggtgagatcatcataagacattttaatgaatttggggcgaagggtgccagattgggggacgatcgttccctcgggccccggggcgaagttcccctcgcagatctgcatctcccaggctttcatctcggagggggggatcatgtccacctgcggggcgatgaaaaaaacggtttccggggcgggggtgatgagctgcgaggagagcaggtttcttaacagctgggacttgccgcacccggtcgggccgtagatgaccccgatgacgggttgcaggtggtagttcaaggagatgcagctgccgtcgtcccggaggaggggggccacctcgttgagcatgtctctcacttggaggttttcccggacgagctcgccgaggaggcggtccccgcccagcgagagcagctcttgcagggaagcaaagtttttcaggggcttgagcccgtcggccatgggcatcttggcaagggtctgcgagaggagctccaggcggtcccatagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggccccgggctgggcgcttgcaagggtgcgcttgagactcatcctgctggtgctgaaacgggcacggtcttcgccctgcgcgtcggcgagatagcagttgaccatgagcttgtagttaagggcctcggcggcgtggcccttggcacggagcttgcctttggaagagcgcccgcaggcgggacagaggagggattgcagggcgtagagcttgggtgcgagaaagacggactcgggagcgaaggcgtccgctccgcagtgggcgcagacggtctcgcactcgacgagccaggtgagctcgggctgctcggggtcaaaaaccagttttcccccgttctttttgatgcgcttcttacctcgcgtctccatgagtctgtgtccgcgttcggtgacaaacaggctgtctgtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccaccagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcaatgctttttaggagactttcatccatctggtcagaaaagactatttttttattgtcaagcttggtggcaaaggagccatagagggcgttggagagaagcttggcgatggatctcatggtctgatttttgtcacggtcggcgcgttccttggccgcgatgttgagctggacatactcgcgcgcgacacacttccattctgggaagacggtggtgcgctcgtcgggcacgatcctgacgcgccagccgcgattatgcagggtgaccaggtccacgctggtggccacctcgccgcgcaggggctcgttggtccagcagaggcgtccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgcgtgagggcggaggcgtacatgccgcagatgtcgtagacatagatgggctccgagaggatgccgatgtaggtgggataacagcgccccccgcggatgctggcgcgcacatagtcatacaactcgtgcgagggggccaagaaagcggggccgagattggtgcgctggggctgctcggcgcggaagacgatctggcgaaagatggcatgcgagttggaggagatggtgggccgttggaagatgttaaagtgggcgtggggcaagcggaccgagtcgcggatgaagtgcgcgtaggagtcttgcagcttggcaacgagctcggcggtgacaaggacgtccatggcgcagtagtccagcgtttcacggatgatgtcataacccgcctcttctttcttctcccacagcgcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtatccctaaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccggaacggaggctcggttgttgatgacctgggcggcgaggacgatctcgtcgaagccgttgatgttgtgcccgacgatgtagagttccatgaatcgcgggcggcctttgatgtgcggcagctttttgagttcctcgtaggtgaggtcctcggggcattgcaggccgtgctgctcgagcgcccactcctggagatgtgggttggcttgcatgaatgaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcggggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggtcgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaaaacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggcggtcgtgtccacgcattgcatgagcccgtagctgcgcggggccacgaccgtgccgcggtgcgcttttagaagcggtgtcgcggacgcgctcccggcggcagcggcggttccggccccgcgggcagtggcggtagaggcacgtcggcgtggcgctcgggcaggtcccggtgctgcgccctgagagcgctggcgtgcgcgacgacgcggcggttgacatcctggatctgccgcctttgcgtgaagaccacgggccccgtgactttgaacctgaaagacagttcaacagaatcaatctcggcgtcattgacggcggcctgacgcaggatctcttgcacgtcgcccgagttgtcctggtaggcgatctcggacatgaactgctcgatttcctcctcctggagatcgccgcggcccgcgcgctctacggtggcggcaaggtcattcgagatgcgacccatgagctgcgagaaggcgcccaggccgctctcgttccagacgcggctgtaaaccacgtccccgtcggcgtcgcgcgcgcgcatgaccacctgcgcgaggttgagctccacgtgccgcgtaaagacggcgtagttgcgcaggcgctggaagaggtagttgagggtggtggcgatgtgctcggtgacgaagaagtacataatccagcggcgcaggggcatttcgctgatgtcgccaatggcctccagcctttccatggcctcgtagaaatccacggcgaagttgaaaaactgggcgttgcgggccgagaccgtgagctcgtcttccaggagcctgatgagttcggcgatggtggcgcgcacctcgcgctcgaaatccccgggggcctcctcctcttcctcttcttccatgacgacctcttcttctatttcttcctctgggggcggtggtggcggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggtgggtccccgttgggcagcgatagggcgctgacaatgcatcttatcaattgcggtgtagggcacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgaacggctgcacgagcgccaggtcggcgacgacgcgctcggcgaggatggcctgttgcacgcgggtgagggtgtcctggaagtcgtccatgtcgacgaagcggtggtaggcccctgtgttgatggtgtaagtgcagttggccataagcgaccagttgacggtctgcaggccgggttgcacgacctcggagtacctgagccgcgagaaggcgcgcgagtcgaagacatagtcgttgcaggtgcgcacgaggtactggtatccgactagaaagtgcggcggcggctggcggtagagcggccagcgctgggtggccggcgcgcccggggccaggtcctcaagcatgagtcggtggtagccgtagaggtagcgggacatccaggtgatgccggcggcggtggtggaggcgcgcgggaactcgcggacgcggttccagatgttgcgcaggggcaggaaatagtccatggtcggcacggtctggccggtgagacgcgcgcagtcattgatgctctagaggcaaaaacgaaagcggttgagcgggctcttcctccgtagcctggcggaacgcaaacgggttaggccgcgtgtgtaccccggttcgagtcccctcgattcaggctggagccgcgactaacgtggtattggcactcccgtctcgacccaagcccgatagccgccaggatacggcggagagccctttttgtcggccgaggggagtcgctagacttgaaagcggccgaaaaccctgccgggtagtggctcgcgcccgtagtctggagaagcatcgccagggttgagtcgcggcagaacccggttcaaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcacagctgttcctggtggtgcagcacagcagggacaacgaggcgttcagggaggcactgctgaacatcgccgagcccgagggtcgctggctgctggagctgattaacatcttgcagagcatcgtagtgcaggagcgcagcctgagcctggccgagaaggtggcggcgatcaactactcggtgctgagcctgggcaagttttacgcgcgcaagatttacaagacgccgtatgtgcccatagacaaggaggtgaagatagacagcttttacatgcgcatggcgctcaaggtgctgacgctgagcgacgacctgggcgtgtaccgcaacgaccgcatccacaaggccgtgagcacaagccggcggcgcgagctgagcgaccgcgagctgatgctgagtctgcgccgggcgctggtaggaggcgccaccggcggtgaggagtcctacttcgacatgggggcggacctgcattggcagccgagccgacgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtatagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggatgattataccaactttataagcgcgctgcggctgatggtgaccgaggttccccagagcgaggtgtaccagtctggcccggactactttttccagacgagcagacagggcctgcagacggtgaacctgagtcaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagtggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcgtccatgaactcggactactttaccaatgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccacgggccaagaacgccatggccaataacggtatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggatttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgttacctgcggcgcggagcaagtctactggtcactgccggacctcatgcaagaccccgtcaccttccgctccacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactacactcccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgctgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcacgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcaaaccgtggacattcagatccccaccgacatggatgtcgacaaaaaaccctcgaccagcatcgaggtgcaaaccgacccctggctcccagcctccacagctaccgtctccacttctaccgccgccacggctaccgagcctcccaggaggcgaagatggggcgccgccagccggctgatgcccaactacgtgttgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcaactccggttgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagcctggcccccaagggcgcccccaactccagtcagtgggaacagaaaaaggccaatgctggagaacaaaaggaaacacatacttatggtgtagctcctatgggtggagaaaacattacaattagcggtttgcaaattggaacagatactacaaatggcaaacaagacccgatatatgctaataagctgtatcaaccagagcctcaagtaggagaagaaaactggcaggaaacagaagccttctatggaggaagggctcttaaaaaggaaaccaagatgaaaccatgctatggctcatttgccagacccacaaatgaaaaaggaggacaggcaaaactaagagaccctgaaaaaagtcaagaagattttgacatagacctagcattctttgatactccgggaggaactttaacaggtggtggaacggaatacaaagcagacattgttatgtgcactgaaaatgttaatcttgaaaccccggacacccacgtggtgtataaaccaggcaaagatgatgacagttcagaaatcaacttggttcagcagtccatgcccaacagacctaactacatcggcttcagggacaactttgtgggtctcatgtactacaacagcactggcaacatgggtgtgctggccggtcaggcttctcagttgaatgctgtggtcgacttgcaagacagaaacacagagctgtcttaccagctcttgctagattctctgggcgacagaaccaggtactttagcatgtggaactctgcggtggacagctatgatcccgatgtcaggatcattgagaatcacggtgtggaagatgaacttcccaactattgcttcccattggatgggtctggcaccaatgctgcttatgaaggtgtaaaagttaaaaatggacaagatggggatcaagagagcgaatgggaaaaagacaccaatgtggcagatcgaaaccaaatatgcaagggcaacatctacgccatggagatcaacctccaggccaacctgtggaagagttttctgtactcgaacgtggcgctgtacctgcccgactcctacaagtacacgccggccaacgtcacgctgcccaccaacaccaacacctacgagtacatgaatggccgcgtggtagccccctcgctggtggacgcctacattaacatcggcgcccgctggtcgctggaccccatggacaacgtcaacccctttaaccaccaccgcaacgcgggcctgcgctaccgctccatgcttctgggcaacggccgctacgtgcccttccacatccaagtgccccaaaagttctttgccatcaagaacctgctcctgcttcccggctcctacacctacgagtggaacttccgcaaggatgtcaacatgatcctgcaaagttccctcggcaacgacctgcgcgtcgacggcgcctccgtccgcttcgacagcgtcaacctctacgccaccttcttccccatggcgcacaacaccgcctccaccctggaagccatgctgcgcaacgacaccaacgaccagtccttcaacgactacctctcggccgccaacatgctctaccccatcccggccaaggccaccaacgtgcccatttccatcccctcgcgcaactgggccgccttccgcggctggagtttcacccggctcaagaccaaggaaactccctcccttggctcgggttttgacccctactttgtctactcgggttccatcccctacctcgacgggaccttctacctcaaccacaccttcaagaaggtctccatcatgttcgactcctcggtcagctggcccggcaacgaccggctgctcacgccgaacgagttcgagattaagcgcagcgtcgacggggagggctacaatgtggcccaatgcaacatgaccaaggactggttcctcgtccagatgctctcccactacaacatcggctaccagggcttccacgtgcccgagggctacaaggaccgcatgtactcctttttccgcaacttccagcccatgagcaggcaggtggtcgatgagatcaactacaaggactacaaggccgtcaccctgccattccagcacaacaactcgggcttcaccggctacctcgcacccaccatgcgtcaggggcagccctaccccgccaacttcccctacccgctcatcggctccaccgcagtgccatccgtcacccagaaaaagttcctctgcgacagggtcatgtggcgcatccccttctccagcaacttcatgtccatgggtgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggttccagcgaacgagaactcgcggccatcgtgcgcgacctgggctgcgggccctactttttgggtacccacgacaagcgctttccgggtttcctcgccggcgacaagctggcctgcgccatcgtcaacacggccggccgcgagaccgggggcgtgcactggctcgccttcggctggaacccgcgctcgcgcacctgctacatgttcgacccctttgggttctcggaccgccggctcaagcagatttacagcttcgagtacgaggccatgctgcgccgcagcgccctggcctcctcgcccgatcgctgtctcagcctcgaacagtccacccagaccgtgcaggggcccgactccgccgcctgcggactcttctgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatgactcaaataaacagcacttttattttacacatgcactggagtatatgcaagttatttaaaagtcgaaggggttctcgcgctcgtcgttgtgcgccgcgctggggagggccacgttgcggtactggaacttgggctgccacttgaactcggggatcaccagtttgggcactggggtctcggggaaggtctcgctccacatgcgccggctcatctgcagggcgcccagcatgtcagggccggagatcttgaaatcgcagttggggccggtgctctgcgcgcgcgagttgcggtacacggggttgcagcactggaacaccatcagactggggtacttcacactggccaacacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacgaaggccgcgatctgcttgaaagcttgctgggccttggccccctcgctgaaaaacaggccgcagctcttcccgctgaactggttattcccgcacccggcatcatgcacgcagcagcgcgcgtcatggctggtcagttgcaccacgctccgtccccagcggttctgggtcaccttagccttgctgggctgctccttcagcgcgcgctgtccgttctcgctggtcacatccatctccaccacgtggtccttgtgaatcatcaccgttccatgcagacacttgagctgaccttccacctcggtgcagccgtgatcccacaggacgcagccggtgcactcccaattcttgtgcgcgatcccgctgtggctgaaaatgtaaccttgcaacaggcgacccataatggtgctaaatgctttctgggtggtgaatgtcagttgcatcccgcgggcctcctcgttcatccaggtctggcacatcttctggaagatctcggtctgctccggcatgagcttgtaagcatcgcgcaagccgctgtcgacgcggtagcgttccatcagcacgttcatggtatccatgcccttctcccatgacgagaccagaggcagactcagggggttgcgcacgttcaggacaccaggggtcgcgggctcgacgatgcgttttccgtccttgccttccttcaacagaaccggaggctggctgaatcccactcccacgatcacggcgtcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctaaaacccccacaggatgaacaggagcacgagcaagacgcaggccaggaggagaccgacgctgggctcgagcatggctacctggaaggagaggaggatgtgctgctaaaacacctgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgtctttgcggtccccgaggcccttgccacctatcacatctttttcaagaaccaaaagatccccatctcctgtcgcgccaatcgcactcgcgccgacgcgctcctcgctttggggcccggcgcgcgcatacctgatatcgcttccctggaagaggtgcccaagatcttcgaagggctcggtcgggacgagacgcgcgcggcaaacgctctgaaagaaacagcagaggaagagggttacactagcgccctggtagagttggaaggcgacaacgccaggctggccgtgcttaagcgcagcgtcgagctcacccatttcgcctaccccgccgtcaacctcccgcccaaggtcatgcgtcgcatcatggatcagctcatcatgccccacatcgaggcccttgatgaaagtcaggaacagcgccccgagaacgcccagcccgtggtcagcgacgagatgctcgcgcgctggctcgggacccgcgacccccaggccctggagcagcggcgcaagctcatgctggccgtggtcctggtcacccttgagctcgaatgcatgcgccgcttttttaccgaccccgagaccctgcgcaaggtcgaggagaccctgcactacactttcagacacggtttcgtcaggcaggcctgcaagatctccaacgtggagctgaccaacctggtctcctgcctggggatcctacacgagaaccgcttgggacagaccgtgctccactctaccctgaagggcgaggcgcggcgggactacatccgcgactgcgtctttctctttctctgccacacatggcaagcggccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggagggctgcccgacttcatgagccagagcatgttgcaaaactaccgcactttcattctcgagcgatctgggatgctgcccgccacctgcaacgccttcccctccgactttgtcccgctgagctaccgcgagtgtcccccgccgctgtggagccactgctacctcttgcagctggccaactacattgcccaccactcggatgtgatcgaggacgtgagcggcgaggggctgctcgagtgccactgtcgctgcaacctatgctccccgcaccgctccctggtctgcaacccccagctactgagcgagacccaggtcatcggtacctttgagctgcaaggtccgcaggagtccaccgctccgctgaaactcacgccggggttgtggacttccgcgtacctgcgcaaatttgtacccgaggactactacgcccatgagataaagttcttcgaggaccaatcgcgtccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacccgggtctcccccagcatgccgaggaagaagcaggagccgctagtggaggagatggaagaagaatgggacagccaggcagaggaggacgaatgggaggaggagacagaggaggaagacttggaagaggtggaagaggagcaggcaacagagcagcccgtcgccgcaccatccgcgccggcagcccctccggtcacggatacaacctccgcagctccggccaagcctcctcgtagatgggatcgagtgaagggtgacggtaagcacgagcgacagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtcaaaggagtcgccggaggaggaggcctgaggatcgcggcgaacgagcccttgaccaccagggagctgaggaaccggatcttccccactctttatgccatttttcagcaaagtcgaggtcagcagcaagagctcaaagtaaaaaaccggtctctgcgctcgctcacccgcagttgcttgtaccacaaaaacgaagatcagctgcagcgcactcttgaagacgccgaggctctgttccacaagtactgcgcgctgactcttaaagactaaggcgcgcccacccggaaaaaaggcgggaattacctcatcgccaccatgagcaaggagattcccaccccttacatgtggagctatcagccccagatgggcctggccgcgggcgcctcccaggactactccacccgcatgaactggcttagtgccggcccctcgatgatctcacgggtcaacggggtccgtaaccatcgaaaccagatattgttgcagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcaatcggtctgcgaccggacggagtgttccaactagccggagccgggagatcgtccttcactcccaaccaggcctacctgaccttgcagagcagctcttcgcagcctcgctcgggaggcatcggaaccctccagttcgtggaggagtttgtgccctcggtctacttcaaccccttctcgggctcgccaggcctctacccggacgagtttataccgaacttcgacgcagtgagagaagcggtggacggctacgactgaatgtcctatggtgactcggctgagctcgctcggttgaggcatctggaccactgccgccgcctgcgctgctttgcccgggagagctacggcctcatctactttgagctgcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatttgtcctaccccgaagttgcatgagaatttttgttgtactctttgtggtgagtttaataaaagctaaactcttgcaatactctggaccttgtcgtcatcaactcaacgagaccgtctacctcaccaaccagactgaggtaaaacttacctgcagaccacacaagacctatatcatctggttcttcgagaacacctcatttgcagtctccaacactcactgcaacgacggtgttgaacttcccaacaacctttccagtggactgagttacaatacacgtagagctaagctcatcctctacaatccttttgtagagggaacctaccagtgccagagcggaccttgcttccacagttttactttggtgaacgttaccggcagcagcacagccgctccagaaactaaccttccttctgatactatcaaaccttgtttcggaggtgagctaaggcttcccccttctcaggagggggttagcccatacgaagtggtcgggtatttgattttaggggtggtcctgggtgggtgcatagcggtgctagctcagctgccttgctgggtggaaatcaaaatctttatatgctgggtaagacattgtggggaggaactatgaaggggctcttgctgattatcctttccctggtggggggtgtgctgtcatgccacgaacagccacgatgtaacatcaccacaggcaatgagaggaacgactgctctgtagttatcaaatgcgagcaccattgtcctctcaacattacattcaaaaataagaccatgggaaatgtatgggtgggattctggcaaccaggagatgagcagaactacacggtcactgtccatggtagcaatggcaatcacactttcggtttcaaattcatttttgaagtcatgtgtgatatcacactacatgtggctagacttcatggcttgtggccccctaccaaggataacatggtgggtttttctttggcttttgtgatcatggcctgcttgatgtcaggtctgctggtaggggctctagtgtggtttctgaaacgcaagcccaggtatggaaatgaagagaaggaaaaattgctataaattctttttctttttcgcagaaccatgaatacagtgatccgtatcgtgctgctctctcttcttgtagcttttagtcaggcaggatttcatactatcaatgctacatggtgggctaatataactttagtgggacccccagacacaccagtcacttggtatgatactcaaggattgtggttttgcaatggcagtagagttaagaatcctcaaatcagacatacatgtaatgatcaaaaccttactttgatccatgtgaacaaaacttatgaaagaacatacatgggttataatagacaagggactaaaaaagaagactacaaagttgtagttataccacctcctcctgctactgtaaaaccacagccagagccagagtatgtgtttgtttatatgggagagaacaaaactctagaaggtcctccgggaactccagtcacatggtttaatcaggatggaaagaaattttgtgaaggagaaaaagttcttcatccagaatttaaccacacctgtgacaaacaaaaccttatactactgtttgtgaattttacacatgatggagcttaccttgggtacaatcatcaaggaacccagagaacacactatgaagttacagtattagatctttttccagattctggccaaatgaaaattgaacatcataactggcagaaacagggtgggcaaaaacagggtgggcaaaaaacaaatcaaacaaaagttaatgacaggagaaaaacagcgcaaaaaagaccatcaaagctaaagccggcaactattgaggcaatgctggttacagtgactgccgggtctaacttaactttggttggacctaaagcagaaggaaaagttacttggtttgatggagatttaaaaagaccatgtgagcctaattacagactaagacacgaatgtaataatcaaaacttaactctgattaatgtaactaaagattatgagggaacttactatggtacaaatgacaaagatgagggcaaaaggtacagagtgaaagtaaatactacaaattctcaatctgtgaaaattcagccatataccagacaaactactcctgatcaagagcacaaatttgaattacagttcgaaactaatggaaattatgattcaaaaattccctcaaccactgtggcaatcgtggtgggtgtgattgcgggcttcataactctgatcattgtcttcatatgctacatctgctgccgcaagcgtcccagggcatacaatcatatggtagacccactactcagcttctcttactaagactcagtcactttcatttcagaaccatgaaggttttcacagcttgcgttctgattagcctagtcacacttagtgtagctattaaaaatcaatatcatgttcataatgttaccagagatggatatatcacattaaatgtaacaattgataatactacctggacaagatatcatttaaataagtggcatcaaatttgtacgtggtcagacccatcatacaaatgtcacagcaatggcagcattaccattcatgctttcaatattacttctggccagtacaaagctgaaagttttactaactggtttagatattacggtaatcataaacatgaaattcatatttttaacataactgtaattgagcatcctacaacaaaagcacccaccactgctaatacagctacatcaattaaatcaacaaccacacagcctactactagggagacaactactgagaccactactcaaactacacagctagacacaacagtgcagaatagcactgtgttggttaggtatctgttgagggaggaaagtactactgaacagacagaggctacctcaagtgcctttagcagcactgcaaatttaacttcgcttgcttggactaatgaaaccggagtatcattgatgaatcatcagcctttctcaggtttggatattcaaattacttttctggttgtttgtgggatctttattcttgtggttcttctgtactttgtctgctgcaaagccagagagaaatctaggaggcccatctacaggccagtaatcggggaacctcagccactccaagtggaagggggtctaaggaatcttcttttctctttttcagtatggtgatcagccatgattcctaggttcttcctatttaacatcctcttctgtctcttcaacatctgcgctgcctttgcagccgtctcgcacgcctcgcccgactgtctcgggcccttcccaacctacctcctctttgccctgctcacctgcacctgcgtctgcagcattgtctgcctggtcatcaccttcctgcagcttatcgactggtgctgtgcgcgctacaattatctccatcacagtcccgaatacagggacaagaacgtagccagaatcttaaggctcatctgaccatgcagactctgctcatgctgctatccctcctatcccctgccctagccacttatgctgattactctaaatgcaaattcgcagacatatggaatttcttagattgctatcaggaaaaaattgatatgccctcctattacttggtgattgtgggaatagtcatggtctgctcctgcactttctttgccatcatgatttacccctgttttgatctcggctggaactctgttgaagcattcacatacacactagaaagcagttcactagcctccacgccaccacccacaccgcctcctcgcagaaatcagttccccctgatacagtacttagaagagccccctccccgacccccttccactgttagctactttcacataaccggcggcgatgactgaccaccacctggacctcgagatggacggccaggcctccgagcagcgcatcctgcaactgcgcgtccgtcagcagcaggagcgggccgccaaggagctccttgatgccatcaacatccaccagtgcaagaagggcatcttctgcctggtcaaacaggcaaagatcacctacgagctcgtgtccaacggcaaacagcatcgccttacctatgagatgccccagcagaagcagaagttcacctgcatggtgggcgtcaaccccatagtcatcacccagcagtcgggcgagaccaacggctgcatccactgctcctgcgaaagccccgagtgcatctactcccttctcaagaccctttgcggactccgcgacctcctccccatgaactgatgttgattaaaagcccagaaaccaatcagacccttcctcatttccccatcccaatactcataagaataaatcattggaattaatcattcaataaagatcacttacttgaaatctgaaagtatgtctctggtgtagttgctcagcaacacctcggtaccctcctcccagctctggtactccagtccccggcgggcggcgaactttctccacaccttgaaagggatgtcaaattcctggtccacaattttcattgtcttccctcttagatgtcaaagaggctccgggtggaagatgacttcaaccccgtctacccctatggctacgcgcggaatcagaatatccccttcctcactcccccctttgtctcctccgatggattcaaaaacttcccccctggggtactgtcactcaaactggctgatccaatcaccattaccaatggggatgtatccctcaaggtgggaggtggtctcactttgcaagatggaagcctaactgtaaaccctaaggctccactgcaagttaatactgataaaaaacttgagcttgcatatgataatccatttcaaagtagtgctaataaacttagtttaaaagtaggacatggattaaaagtattagatgaaaaaagtgctgcggggttaaaagatttaattggcaaacttgtggttttaacaggaaaaggaataggcactgaaaatttagaaaatacagatggtagcagcagaggaattggtataaatgtaagagcaagagaagggttgacatttgacaatgatggatacttggtagcatggaacccaaagtatgacacgcgcacactttggacaacaccagacacatctccaaactgcacaattgctcaagataaggactctaaactcactttggtacttacaaagtgtggaagtcaaatattagctaatgtgtctttgattgtggtcgcaggaaagtaccacatcataaataataagacaaatccaaaaataaaaagttttactattaaactgctatttaataagaacggagtgcttttagacaactcaaatcttggaaaagcttattggaactttagaagtggaaattccaatgtttcgacagcttatgaaaaagcaattggttttatgcctaatttggtagcgtatccaaaacccagtaattctaaaaaatatgcaagagacatagtttatggaactatatatcttggtggaaaacctgatcagccagcagtcattaaaactacctttaaccaagaaactggatgtgaatactctatcacatttaactttagttggtccaaaacctatgaaaatgttgaatttgaaaccacctcttttaccttctcctatattgcccaagaatgaaagaccaataaacgtgtttttcatttgaaattttcatgtatctttattgatttttacaccagcacgagtagacagtctcccaccaccagcccattttacagtgtacacggttctctcagcacgggtagccttaaatagggaaatattctcattagtgcgggaattggacttggggtctataatccacacagtttcctggcgagccaaacgggggtcggtgattgaaataaagccgtcctctgaaaagtcatccaagcgggcctcacagtccaaggtcacagtctggtggaacaagaagaacgcacagattcatactcggaaaacaggatgggtctgtgcctctccatcagcgccctcagcagtctctgccgccggggctcggtgcggctgctgcaaatgggatcgggatcacaagtctctctgactatgatcccaacagccttcagcatcagtctcctggtgcgacgggcacagcaccgcatcctgatctctgccatgttctcacagtaagtgcagcacataatcaccatgttattcagcagcccataattcagggcgctccagccaaagctcatgttgggaatgatggaacccacgtgaccatcgtaccagatgcgacagtatatcaggtgcctgcccctcatgaacacactgcccatgtacatgatctctttgggcatgtttctgtttacaatctggcggtaccaggggaagcgctggttga

SEQ ID NO: 1424 - DNA, 32767 bp, Human adenovirus 81
catcatcaataatataccccacaaagtaaacaaaagttaatatgcaaatgagcttttgaatttagggcgtggccaacgctgattggccgttgcaacgaccgttagtgacgtcacgacgcacggcgtcaacggtcggcgcggaggcgtggcctaggccggaagcaagtcgcgggtctgatgacgtctaaaaaagcggactttagacccggaaatggccgattttcccgcggccacgcccggatatgaggtaattctgggcggatgcaagtgaaattaggtcattttggcgcgaaaactgaatgaggaagtgaaaagcgaaaaataccggtcccgcccagggcggaatatttaccgagggccgagagactttgaccgattacgtgggggtttcgattgcggtgtttttttcgcgaatttccgcgtccgtgtcaaagtccggtgtttatgtcacctggtcagctgatccacagggtatttaaaccagtcgagaccgtcaagaggccactcttgagtgccagcgagtagagatttctctgagctccgctcccagagtctgagaaaaatgagacacctgcgcctcctgccagcaactgtgcctatggacatggctgtgcttctgctggacgactttgtgaatacagtattggaggacgaactgcatccaagtccgttcgagctgggacccacacttcaggacctctatgatctggaggtagatgcccatgaggacgacccgaacgaagaggctgtgaatttaatatttccagaatctatgattcttcaggctgacatagccaacgaatctattcctactccacttcatactccaactctgtcacccatacctgaattggaagaggaggacgagttagacctccggtgctacgaggaaggttttcctcccagcgattcagaggacgaacagggtgagcagagcatggctctaatctcagactatgcttgtgtggttgtggaagagcattttgtgttggacaatcctgaggtgcccggggaaggctgtagatcctgccaatatcaccgggatcagaccggagaccctaatgcctcctgcgctctgtgttacatgaaaaccactttcagctttatttacagtaagtggagtgaatgtgagagaggctgagtgcttaacacatctctgtgtgatgcttgaacagctgtgctaagtgtggtttatttttgttactaggtccggtgtcagaggatgagtcatcaccctcagaagaagaccacccgtcaccccctgatctcacagatgacacgcccctgcaagtgtacagacccaccccagtcagacccagtggcgagaggcgagcagctgttgacaaaattgaggacttgttgcaggacatgggtggggatgaacctttggacctgagcttgaaacgccccaggaactaggcgcagctgcgctgagtcatgtgtaaataaagctgtataataaaagtatatgtgacgcatgcaaggtgtggtttatgactcatgggcggggcttagacctatataagtggcaacacctggacactcagacacagaccttcagggagctcctgatggaggtgtggactatccttggggactttaacaagacacgccggcttgtggaggatagttcagacgggtgctccggtttctggagacactggtttggaactcctctatctcgcctggtgtacacagttaagaaggattatagcgaggaatttgaaaatcttttttccgactgctctggcctgcttgattcactgaattttggccaccagtcccttttccaggaaagggtcctccacagccttgatttttccagcccagggcgcactacagccggggttgcttttgtggtttttctggttgacaaatggagccagaacacccaactgagcaggggctacatcctggacttcgcggccatgcacctgtggagggcctggatcaggcagcggggacagagaatcttgaactactggcttctacagccagcagctccgggtcttcttcatctacacagacaaacatccatgttggaggaagagatgagggaggccatggacgacaacccgaggagcggcctggaccctccgtcggaagaggagctggattgaatcaggtatccagcctgtacccagagcttagcagggtgctgacatccatggccaggggagtgaagcgggagaggagcgatgggggcaataccgggatgatgaccgagctgacggccagcctgatgaatcgcaagcgcccagagcgcattacctggcatgagctacagctggagtgcagggatgaggtcggcctgatgcaggataaatatggcctggagcagataaaaacccactggttgaacccagatgaggattgggaggaggccattaagaagtatgccaagattgccctgcgcccagattgcaagtacagggtgaccaagacggtgaatatcagacatgcctgctacatctcagggaacggggcagaggtggtcatcgataccctggacaaggccgccttcaggtgttgcatgatgggaatgagagccggagtgatgaatatgaattccatgatcttcatgaacatgaagttcgatggagagaagtttaatggggtgctgttcatggccaacagccacatgaccctgcatggctgtgatttcttcggcttcaacaatatgtgtgcagaggtctggggcgccgctaagatcaggggatgtaagttttatggctgttggatgggcgtggtcggaagacccaagagcgagatgtctgtgaagcagtgtgtgtttgagaaatgctacctgggagtctctaccgagggcaatgctcgagtgagacactgctcttccatggagacgggctgcttctgcctggtgaagggcacagcctcgatcaagcataatatggtgaagggctgcacggatgagcgcatgtacaacatgctgacctgcgactcgggggtctgccatatcctgaagaacatccatgtgacctcccaccccaggaagaagtggccagtgtttgagaataacctgctgatcaagtgccatatgcacctgggtgtcagaaggggtaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcaaccggtggccctggatgtgaccgaggatctgcgacccgaccacctggtgatggcctgtaccgggaccgagttcagctccagtggggaggacacagattagaggtaggtttgagtagtgggcgtggctaaggcgactataaaggtgggtgtcttacgagggtctttttgcttttctgcagacatcatgaacgggaccggcgggcacttcgaaggggggctttttagcccttatttgacaacccgcctgccgggatgggccggagttcgtcagaatgtgatgggatcgacggtggacgggcgcccagtgcttccagcaaattcctcgaccatgacctacgcgaccgtggggacgagctcgtcgctcgacagcaccgccgcagccgcggcagccgcagccgccatgacagcgacgagactggcctcgagctacatgccaagcagcaacagcagcccctccgtccccagttccatcatcgccgatgagaaactgctggccctgctggcagagctggaagccctgagccgccagttggccgccctgacccagcaggtgtccgatctccgcgagcaacagcagcagcaaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtccttgaggaggagactgatggccacggggagccccttggtgtaggtgttggcgaagcggttgagctgggagggatgcatgcggggggagatgatgtggagtttggcctggatcttgaggttggcgatgttgccgcccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcactcatccatgatgatggcaatgggcccgtgggctgcggctttggcaaagacgtttctggggtcagagacatcgtaattatgctcctgggtgagatcatcataagacattttaatgaatttggggcggagggtgccagattgggggacgatggttccctcgggacccggggcgaagttcccctcgcagatctgcatctcccaggctttcatctcggagggggggatcatgtccacctgcggggcgatgaaaaaaacggtttccggggcgggggtgatgagctgcgaggatagcaggtttctcaacagctgggacttgccgcacccggtcgggccgtagatgaccccgatgacgggttgcaggtggtagttcaaggagatgcagctgccgtcgtcccggaggaggggggccacctcgttgagcatgtccctgacttggaggttttcccggacgagctcgccaaggaggcggtccccgcccagcgagagcagctcttgcagggaagcaaagtttttcaggggcttgagcccgtcggccatgggcatcttggcgagggtctgcgagaggagctcgaggcggtcccagagctcggtgacgtgctctacggcatctcgatccagcagacttcctcgtttcgggggttgggacgactgcgactgtagggcacgagacgatgggcgtccagcgctgccagcgtcatgtccttccagggtctcagggtccgcgtgagcgtggtctccgtcacggtgaatgggtgggccccgggctgggcgcttgcaagggtgcgcttgagactcatcctgctggtgctgaaacgggcacggtcttcgccctgcgcgtcggcgagatagcagttgaccatgagctcgtagttgagtgcctcggcggcgtggcccttggcgcggagcttgcccttggaagagcgcccgcaggcgggacagaggagggattgcagggcgtagagcttgggtgcaagaaagacggactcgggggcaaaggcgtccgctccgcagtgggcgcagacggtctcgcactccacgagccaggtgagctcgggccgctcggggtcaaaaaccagttttcccccgttctttttgatgcgcttcttacctcgcgtctccatgagtctgtgtccgcgttcggtgacaaacaagctgtctgtgtccccgtagacggacttgatgggcctgtcctgcaagggcgtcccgcggtcctcctcgtagagaaactcggaccactctgagacaaaggcgcgcgtccacgccaagacaaaggaggccacgtgcgaggggtagcggtcgttgtccaccagggggtccaccttttccacggtatgcagacacatgtccccctcctccgcatccaggaaggtgattggcttgtaggtgtaggccacgtgacccggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcctgccctgccgcgatgcttttgagtagactttcatccatctggtcagaaaagactatttttttattgtcaagcttggtggcgaaggagccatagagggcgtttgagagaagcttggcgatggatctcatggtctgatttttgtcacggtcggcgcgctccttggccgcgatgttgagctggacatactcgcgcgcgacacacttccattcggggaagacggtggtgcgctcgtcgggcacgatcctgacgcgccagccgcggttatgcagggtgaccaggtccacactggtggccacctcgccgcgcaggggctcgttggtccagcagagtcgcccgcccttgcgcgaacagaacgggggcagcacatcaagcaggtgctcgtcaggggggtccgcatcgatggtgaagatgcccggacagagttccttgtcaaaatagtctatttttgaggatgcatcatccaaggccatctgccactcgcgggcggccagcgctcgctcgtaggggttgaggggcggaccccatggcatgggatgcgtgagcgcggaggcgtacatgccgcagatgtcgtagacatagatgggctccgcgaggatgccgatgtaggtgggataacagcgccccccgcggatgctggcgcgcacgtagtcatacaactcgtgtgagggggccaagaaggcggggccgagattggtgcgctggggctgctcggcgcggaagacgatctggcgaaagatggcatgcgagtttgaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgtctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgtgcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgcccgcggcatgaaattgcgggtgatgcggaaagggcccggcacggaggctcggttgttgatgacctgggcggcgaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggctagatcgcgagcgagggcgaccagctctgggtccccggagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatccctccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggttttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggccgtgtccacgcattgcatgagcccgtagctgcgcggggccacgaccgtgccgcggtgcgcttttagaagcggtgtcgcggacgcgctcccggcggcagcggcggttccggccccgcgggcaggggcggcagaggcacgtcggcgtggcgctcgggcaggtcccggtgctgcgccctgagagcgctggcgtgcgcgacgacgcggcggttgacatcctggatctgtcgcctctgcgtgaagaccacgggccccgtgactttgaacctgaaagacagttcaacagaatcaatctcggcgtcattgacggcggcttgacgcaggatctcttgcacgtcgcccgagttgtcctggtaggcgatctcggacatgaactgctcgatctcctcctcctggagatcgccgcggcccgcgcgctcgacggtggcggcgaggtcattcgagatgcgacccatgagctgcgagaaggcgcccaggccgctctcgttccagacgcggctgtagaccacgtccccgtcgacgtcgcgcgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcgacgcaggggcatctcgctgatgtcgccgatggcctccagcctttccatggcctcgtagaagtccacggcgaagttgaaaaactgggcgttgcgggccgagatcgtgagctcgtcttccaggagcctgatgagttcggcgatggtggcgcgcacctcgcgctcgaaatccccgggggcctcctcctcttcctcttcttccatgacgacctcttcttctatttcctcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgagagggcgctgacgatgcatcttatcaattgcggtgtaggggacgtgagcgcgtcgagatcgacaggatcggagaatctttcgaggaaagcgtctagccaatcgcagtcgcaaggtaagctcaaacacgtagcagccctgtggacgctgttagaattgcggttgctgatgatgtaattgaagtaggcgtttttaaggcggcggatggtggcgaggaggaccaggtccttgggtcccgcttgctggatgcggagccgctcggccatgccccaggcctggccctgacaccggctcaggttcttgtagtaatcatgcatgagcctttcaatgtcatcactggcggaggcggagtcttccatgcgggtgaccccgacgcccctgagcggttgcacgagcgccaggtcggcgacgacgcgctcggcgaggatggcctgttgcacgcgggtgagggtgtcctgaaagtcgtccatgtcgacgaagcggtggtaggccccggtgttgatggtgtaggtgcagttggccatgagcgaccagttgacggtctgcaggccgggctgcacgacctcggagtacctgagccgcgagaaggcgcgcgagtcgaagacgtagtcgttgcaggtgcgcacgaggtactggtagccgactaggaagtgcggcggcggctggcggtagagcggccagcgctgggtggccggcgcgcccggggccaggtcctcgagcatgaggcggtggtagccgtagaggtagcgggacatccaggtgattccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtcccctcgaatcaggctggagccgcgactaacgtggtattggcactcccgtctcgacccgagcccgatagccgccaggatacggcggagagccctttttgccggccgaggggggtcgctagacttgaaagcggccgaaaaccctgccgggtagtggctcgcgcccgtagtctggagaagcatcgccagggttgagtcgcggcagaacccggttcgaggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagacagagatggacttggaagagggcgaagggctggcgagactgggggcgccgtccccggagcgacatccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgcgcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcgctgctaaacatcgccgagcccgagggccgctggctgctggagctgatcaacatcttgcaaagcatcgtagtgcaggagcgcagcctgagcttggccgagaaggtggcggcgatcaattactcggtgctaagcctgggcaagttttacgcgcgcaagatttacaagacgccgtacgtgcccatagacaaggaggtgaaaatagacagcttttacatgcgcatggcgctcaaggtgctgacgctgagcgacgacctgggcgtgtaccgcaacgaccgcatccacaaggccgtaagcacgagccggcggcgcgagctgagcgaccgcgagctgatgctaagcctgcgccgggcgctggtagggggcgccgccggcggcgaggagtcctacttcgacatgggggcggacctgcattggcagccgagccggcgcgccttggaggccgcctacggtccagaggacttggatgaggatgaggaagaggaggaggatgcacccgttgcggggtactgacgcctccgtgatgtgtttttagatgcagcaaaccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgatacaacagcacgaacgtgcagtccaacctggaccggctggtgacggacgtgcgcgaggccgtggcgcagcgcgagcggttcaagaacgagggcttgggctcgctggtggcgctgaatgccttcctggcgacgcagccggcgaacgtgccgcgcgggcaggacgattacaccaactttatcagcgcgctgcggctgatggtgaccgaggtgccccagagcgaggtgtaccagtctggcccggactactttttccagacgagccggcagggcttgcagacggtgaacctgagccaggctttcaagaacctgcgcgggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccacctgctgacgctgtaccgcgaggccataggccaggcgcaggtggacgagcagaccttccaggagatcacgagcgtgagtcgcgcgctgggtcagaacgacaccgacagtctgagggccaccctgaacttcttgctgaccaatagacagcagaagatcccggcgcagtacgcgctgtcggccgaggaggaaaggatcctgagatatgtgcagcagagcgtagggctgttcctgatgcaggagggcgccacccccagcgccgcgctggacatgaccgcgcgcaacatggaacctagcatgtacgccgccaaccggccgttcatcaataagctgatggactacctgcaccgcgcggcgtccatgaacacggactactttactaatgctatactaaacccgcactggctcccgccgccggggttctacacgggcgagtacgacatgcctgaccccaacgacgggtttttgtgggacgacgtggacagcgcggtgttctcaccgaccttgcaaaagcgccaggaggcggtgcgcacgcccgcaagcgagggcgcggtgggtcggagcccctttcctagcttagggagtttgcatagcttgccgggctcggtgaacagcggcagggtgagccggccgcgcttgctgggcgaggacgagtacctgaacgactcgctgctgcagccgccgcgggtcaagaacgccatggccaataacgggatagagagtctggtggacaaactgaaccgctggaagacctacgctcaggaccatagggagcctgcgcccgcgccgcggcgacagcgccacgaccggcagcggggcctggtgtgggacgacgaggattcggccgacgatagcagcgtgttggacttgggcgggagcggtggggtcaacccgttcgcgcatctgcagcccaaactggggcgacggatgttttgaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcagagctggctccgctgtacgacaccactcgcgtgtacttggtggacaacaagtcggcggacatcgcttccctgaactaccaaaacgaccacagcaacttcctgaccacggtggtgcagaacaacgatttcacccccgccgaggctagcacgcagacgataaattttgacgagcggtcgcggtggggcggtgatctgaagaccattctgcacaccaacatgcccaatgtgaacgagtacatgtttaccagcaagtttaaggcgcgggtgatggtgtctaggaagcggccagagggggcgacagatgcaagtcaggatatcttaaagtatgagtggtttgagtttacccttcccgagggcaacttttccgagaccatgaccatagacctgatgaacaacgccatcttggaaaactacttgcaagtggggcggcagaatggcgtgctggagagcgatatcggagtcaagtttgacagcaggaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaagggggcaacatccccgctctgcttgatgtggaagcatacctcaacagcaagaatgataaggaggaggctaccaagaatgcaaacagagctgctgacaatggaggtggtgaaactaggggagatacttttctcaccaccgaacagctaagagctgctggcaaggagctggttattaagcccatcaaggaagatgctagcaagaggagctataatgtcatagatggcacccatgacaccctgtaccgaagctggtacctgtcctatacctacggggaccccgagaagggggtgcagtcgtggacgctgctcaccaccccggacgtcacctgcggcgcggagcaagtctactggtcgctgccggacctcatgcaagaccccgtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgttagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaatgtctattctcatctcgcccagcaataacaccggctggggtattactaggcccagcaccatgtacggaggagccaagaagcgctcccagcagcaccccgtccgcgtccgcggccacttccgcgctccctggggcgcttacaagcgcgggcggacttccaccgccgtgcgcaccaccgttgacgacgtcatcgactcggtggtcgccgacgcgcgcaactacacccccgccccctccaccgtggacgcggtcatcgacagcgtggtggccgacgcgcgcgactatgccagacgcaagagccggcggcgacggattgccaggcgccaccggagcacgcccgccatgcgcgccgctcgggctctgctgcgccgcgccagacgcacgggccgccgggccatgatgcgagccgcgcgccgcgctgccgctgcacccacccccgcaggcaggactcgcagacgagcggccgccgccgccgccgcggccatttctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcggtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgatccctggctcccagcctccaccgctaccgtctccacttctaccgccgccacggctaccgagcctcccaggaggcgaagatggggcgccgccagccggctgatgcccaactacgtgttgcatccttccatcatcccgacgcctggctaccgcggcacccggtattacgccagccgcaggcgcccagccagcaaacgccgccgccgcaccgccacccgccgccgtctggcccccgcccgcgtgcgccgcgtaaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatacccataatcgccgcggccatcggcacgatcccgggcatagcttccgttgcgctgcaggcgtcgcagcgccgttgatgtgcgaataaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcctccgccgcccaagggcgagaagcggccgcggcccgacgcggaggagacgatcctgcaggtggacgagccgccctcgtacgaggaggccgtgaaggccggcatgcccaccacgcgcatcatcgcgccgctggccacgggtgtaatgaaacccgccacccttgacctgcctccaccacccacgcccgctccaccgaaggcagctccggttgtgcaggcccccccggtggcgaccgccgtgcgccgcgtccccgcccgccgccaggcccagaactggcagagcacgctgcacagtatcgtgggcctgggagtgaaaagtctgaagcgccgccgatgctattgagagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacggcttacaacagtctggcccccaagggcgcccccaatcccagtcagtgggaagagaaaaagaatggaggaggaagcgatgctaatcaaatgcaaactcacacgtttggagttgctgccatgggtggcattgaaattacagctaagggtcttcaaattggcattgatgcaaccaaagaggaagataatggaaaggaaatatatgccgacaaaacattccagccagagcctcaaataggagaagaaaactggcaggatagtgataattactatggaggcagagccatcaagaaagaaaccaagatgaagccatgctatggctcatttgccagacctaccaatgaaaaaggcggccaggctaaattcaaaacacctgaaaaagaaggtgaagaacccaaagaacttgacatagatttgaatttctttgatattcccagtactggcacaggtggtaatggaacaaatgttaatttcaaaccagacatgataatgtatgcagaaaatgtgaacttggaaaccccagacactcatattgtatacaagccaggcaaggaagatgcaagttctgaatctaacctcacacaacagtccatgcccaacagacccaactacattggatttagggacaactttgtagggctcatgtactacaacagcactggcaacatgggtgtgctggctggtcaggcatctcagttgaatgctgtggtcgacttgcaagacagaaacaccgagctgtcttaccagctattgctagattctctgggtgacagaaccagatactttagtatgtggaactctgcggtggacagttacgatcccgatgtcaggatcattgagaatcacggtgtggaagatgaacttcccaactattgcttccccttggatggcgctggaactaacgcagtgtaccaaggtgtaaaagttaaaactactaacaatacagaatgggaaaaagacactgcagtatctgaacacaatcagatatgcaaaggcaacgtgtatgccatggagatcaacctccaggccaacctgtggaagagttttctgtactcgaacgtggccctgtacctgcccgactcctacaagtacacgccggccaacgtcacgctgcccaccaacaccaacacctacgagtacatgaacggccgcgtggtagccccctcgctggtggacgcttacatcaacattggcgcccgctggtcgctggaccccatggacaacgtcaacccattcaaccaccaccgcaacgcgggcctgcgctaccgttccatgcttctgggcaacggccgctacgtgcccttccacatccaagtgccccaaaagttctttgccatcaagaacctgctcctgctcccgggctcctacacctacgagtggaacttccgcaaggacgtcaacatgatcctgcagagttccctcggaaacgacctgcgcgtcgacggcgcctccgtccgcttcgacagcgtcaacctctacgccaccttcttccccatggcgcacaacaccgcctccaccctggaagccatgctgcgcaacgacaccaacgaccagtctttcaacgactacctctcggccgccaacatgctctaccccatcccggccaaggccaccaacgtgcccatttccatcccctcgcgcaactgggccgccttccgcggctggagtttcactcgtctgaaaaccaaggaaactccctccctcggctcgggtttcgacccctactttgtctactcgggctccatcccctacctcgacgggaccttctacctcaaccacaccttcaagaaggtctccatcatgttcgactcctcggtcagctggcccggcaacgaccggctgctcacgccgaacgagttcgagatcaagcgcagcgtcgacggggagggctacaacgtggcccaatgcaacatgaccaaggactggttcctcgtccagatgctctctcattacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctacctcgcacccaccatgcgccaggggcagccctaccccgccaacttcccctacccgctcatcggccagacagccgtgccctccgtcacccagaaaaagttcctctgcgacagggtcatgtggcgcatccccttctccagcaacttcatgtccatgggcgccctcaccgacctgggtcagaacatgctctacgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccatcgtcaacacggccggccgcgagaccggaggcgtgcactggctcgcctttggctggaacccgcgctcgcgcacctgctacatgttcgacccctttgggttctcggaccgccggctgaagcagatttacagcttcgagtacgaggccatgctgcgccgcagcgccctggcctcctcgcccgaccgctgtctcagcctcgagcagtccacccagaccgtgcaggggcctgactctgccgcctgcggacttttttgttgcatgttcttgcatgccttcgtgcactggcccgaccgacccatggacggaaaccccaccatgaacttgctgacgggggtacccaacggcatgctacaatcgccacaggtgctacccaccctccggcgcaaccaggaggagctctaccgcttcctcgcgcgccactccccttactttcgatcccaccgcgccgccatcgaacacgccaccgcttttgataaaatgaaacaactgcgtgtatctcaataaacagcacttttattttacatgcactggagtatatgcaagttatttaaaagtcgaaggggttctcgcgctcgtcgttgtgcgccgcgctggggagggccacgttgcggtactggtacttgggctgccacttgaattcggggatcaccagtttgggcactggaatctcggggaaggtctcgctccacatgcgccggctcatctgcagggcgcccagcatgtcgggcgcggagatcttgaaatcgcagttgggaccggtgctctgcgcgcgcgagttgcggtacacggggttgcagcactggaacaccatcagactggggtgcttcacactggccagcacgctcttgtcgctgatctgatccttgtccaggtcctcggcgttgctcaggccgaacggggtcatcttgcacagctggcggcccaggaagggcacgctctgaggcttgtgattacactcgcagtgcacgggcatcagcatcatccccgcgccgcgctgcatattcgggtagagggccttgacgaaggccgagatctgcttgaaagcttgctgggccttggccccctcgctgaaaaacagcccgcagctcttcccgctgaactggttattcccgcaaccggcatcttggacgcagcagcgcgcgtcatggctggtcagttgcaccacgctccgtccccagcggttctgggttaccttggccttgctgggttgctccttcaacgcgcgctgcccgttctcgctggtcacatccatctccaccacgtggtccttgtggatcatcaccgttccatgcagacacttgagctggccttccacctcggtacagccgtgatcccacagggcactgccggtgcactcccagttcttgtgcgcgatcccgctgtggctgaagatgtaaccttgcaacaggcggcccatgatggtgctaaagctcttctgggtggtgaaggtcagttgcagaccgcgggcctcctcgttcatccaggtctggcacatcttctggaagatctcggtctgctcgggcatgagcttgtaagcatcgcgcaggccgctgtcgacgcggtagcgttccatcagcacgttcatggtatccatgcccttctcccaggacgagaccagaggcagactcagggggttgcgcacgttcaggacaccgggggtcgcgggctcgacgatgcgttttccgtccttgccttccttcaacagaaccggcggctggctgaatcccactcccacgatcacggcttcttcctggggcatctcttcgtcggggtctaccttggtcacatgcttggtctttctggcttgcttcttttttaaagggctgtccacggggaccacgtcctcctcggaagacccggagcccacccgctgatactttcggcgcttggtgggcagaggaggtggcggcggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacctgcagcgccagtccctcatcctccgggacgccctagccgaccggagcgaaacccccctcagcgtcgaggagctgtgtcgggcctacgagctcaacctcttctcgccgcgcgtgccccccaaacgccagcccaacggcacatgcgagcccaacccgcgtctcaacttctatcccgtctttgcggtccccgaggccctggccacctatcacatctttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccacttcgcctaccccgccgtcaacctcccgcccaaggtcatgcgtcgcatcatggatcagctcattatgccccacatcgaggccctcgatgaaagtcaggagcagcggcccgaggacgcccggcccgtggtcagcgacgagatgctcgcgcgctggctcgggacccgcgacccccaggctttggaacagcggcgcaagctgatgctggccgtggtcctggtcaccctcgagctcgaatgcatgcgccgcttcttcagcgaccccgagaccctgcgcaaggtcgaggagaccctgcactacactttcagacacggtttcgtcaggcaggcctgcaagatctccaacgtggagctgaccaacctggtctcctgcctggggatcctgcacgagaaccgcctggggcagaccgtgctccactccaccctgaagggcgaggcgcgtcgggactatgtccgcgactgcgtctttctctttctctgccacacctggcagtcggccatgggcgtgtggcagcagtgtctcgaggacgagaacctgaaggagctggacaagcttcttgctagaaaccttaaaaagctgtggacgggcttcgacgagcgcaccgtcgcctcggacctggccgagatcgtcttccccgagcgcctgaggcagacgctgaaaggcgggctgcccgacttcatgagccagagcatgttgcaaaattaccgcactttcattctcgagcgatctgggatgctgcccgccacctgcaacgcctttccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgatgcaacctgtgctccccgcaccgctccctggtctgtaacccccagctcctgagcgaaacccaggtcatcggtaccttcgagctgcaaggtccgcaggagtccaccgctccgctgaaactcacgccggggttgtggacttctgcgtacctgcgcaaatttgtacccgaggactaccacgcccacgagataaagttcttcgaggaccaatcgcgcccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaatccgggtctcccccagcatgccgaggaagaagccgatagtggaggaggagatggaagaagaatgggacagccaggcagaggaggaggacgaatgggaggaggagacagaggaggaagaattggaagaggtggaagaggagcaggcaacagagcagcccgtcgccgcaccatccgcgccggcagccccggcggtcacggatacaacctccgcagcacctccggccaagcctcctcgtagatgggatcgagtgaagggtgacggtaagcacgagcggcagggctaccggtcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagccagtaagaggagtcgccggaggaggaggcctgaggatcgcggcgaacgagccctcgaccaccagggagctgaggaaccggatcttccccactctttatgccatttttcagcagagtcgaggtcagcagcaagagctcaaagtaaaaaatcggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatcatgagcaaggagattcccaccccttacatgtggagctatcagccccagatgggcctggccgcgggcgcctcccaggactactccacccgcatgaactggctaagtgccggcccctcgatgatctcacgggtcaacggggtccgtaaccatcgaaaccagatattgttggagcaggcggcggtcacatccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcctccttcactcccaaccaggcctacctgaccttgcagagcagctcttcggagcctcgctccggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactcggctgagctcgctcggttgaggcatctggaccactgccgccgcctgcgctgctttgcccgggagagctgcggactcatctactttgagtttcccgaggagcaccccaacggccctgcacacggagtgcggatcaccgtagagggcaccaccgagtctcacctggtcaggttcttcacccagcaacccttcctggtcgagcgggaccggggcgccaccacctacaccgtctactgcatctgtcctaccccgaagttgcatgagaatttttgctgtactctgtgtgctgagtttaataaaagctaaactcctacaatactctgggatcccgtgtcgtcgcactcgcaacgagaccttcaaccttaccaaccagactgaggtaaaactcaactgcagaccaggggacaaatacatcctctggctatttgaaaacacttcattcgcagtctccaacacctgcgccaacgacggtattgaaatacccaacaaccttaccagtggactaacttacactaccagaaagactaagctagtactctacaatccttttgtagagggaacctaccactgccagagcggaccttgcttccacactttcactttggtgaacgttaccggcagcagcacagccgctccagaaacatctaaccttctttctgatactaacactcctaaaaccggaggtgagctctgggttccctctctaacagaggggggtaaacatattgaagcggttgggtatttgattttaggggtggtcctgggtgggtgcatagcggtgctgtattaccttccttgctggatcgaaatcaaaatctttatttgctgggtcatacattgttgggaggaaccatgaaggggctcttgctgattatcctttccctggttgggggtgtactgtcatgccacgaacagccacgatgtaacatcaccacaggcaatgagaggagtgtgatatgcacagtagtcatcaaatgcgagcatacatgccctctcaacatcacattcaagaataagaccatgggaaatgcatgggtgggcgattgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggagaacatggttgggttttctttggcttttgtgatcatggcctgctttatgtcaggtctgctggtaggggctttagtgtggttcctgaagcgcaagcctaggtatggaaatgaggagaaggaaaaattgctataaatctttttctcttcgcagaaccatgaatactttgaccagtgtcgtgctgctctctcttcttgtagctcttagtcaggcaggatttcatactatcaatgctacatggtgggctaatataactttagtgggaccctcagatattccagtcacatggtatgatagcactggattacaattttgcgatggaagtacagttaagaatcatcagatcagacatagctgtaatgatcaaaacttaactctgattcatgtgaacaaaacccatgaaagaacatacatgggttataatagacagagtactcataaggaagactataaagtcatagttataccgcctcgtcctgttactgtaaagccacagtcaggcccagagtatgtcaatgttaatatgggagagaacaaaaccttagttggacctccaggaattccagttagttggtttaatcaggatggattacaattctgcattggggataaagttcttcatccagaatttaatcacacctgtgacatgcaaaatcttacactgttgtttataaatcttacacatgatggagcttatcttggttataatcgccagggaactgaaagaacttggtatgaggttgtagtgtcagatggttttccaaaatcagaagagatgaaggtagaagagcatagtaaagaaacagaacaaaaacaaactggacaaaaacagagtggccaaaaagaaacaagtcaaaagaaaactaatgacacacaaaagccatcgcgcaggaggccatctaaactaaagccaaacacacctgacacaaaactaattacagccactagtgggtcaaacgtaactttagttggtccagctggaaaggtcacttggtacgatgatgatttaaaaagaccatgtgagactgggtataagttagactgtaagtgtgacaaacaaaacctaactctgattaatgtaactaaactgtacgaaggagtttactatggcactaatgacaaaagcgatagcaaaagatacagaataaaagtaaacactactaattctcaaagtgtgaaaattcagccgtataccatacctactactcctgaaaataatcacaaatttgaattgcaaattgattctaatcaagacaatgacaaaattccatcaaccactgtggcaatcgtggtgggagtgattgcgggctttgttactctgatcattgtcattctgtgctacatctgctgccgcaagcgtcccaggtcatacaatcacatggtagacccactgctcagcttctcttactaaaactcagtcactctcatttcagaaccatgaaggctttcacagcttgcgttctgattagcctagtcacacttagtgcagctattaaaaatcaatatcatgttcataatgttaccagagatggatatatcacattaaatgtaacaattgataatactacctggacaagatatcatttaaataagtggcaccaaatttgtacgtggtcagacccatcatacaaatgccacagtaatggcagcattactattcatgcttttaatattacttctggccaatacaaagctgaaagttttactaactggtttagatattatggtaatcataaacatgaaattcatatttttaacataactgtaattgagcatcctacaacaaaatcgcccaccactgctaatacagctacatcaattaaatcaacaaccacacagcctacaactgtgcccactacacatccaatcaccacagtcagtacaaccactgagacaactacccacactacacagctagacacatcagtgcagagtagtactgtgttgattaggtttttgttgagggaggaaagtaccactgaacagacagaggctacctcaagtgccttcaacagcactgcaaatttaacttcgcttgcttcaataaatgagaccctcgtgccgttgatgctggaacaagatctaagaggtttggatatgcaaattacttttctggttgtctgtgggatctttattcttgcggttcttctgtactttgtctgctgcaaagccagagagaaatctaggaggcccatctacagaccagtaatcggggagcctcagcccctccaagtggatggaggcttaagaaatcttctcttctcttttacagtatggtgatcagccatgattcctaggttcttcctatttaacatactcttctgtctattcaacatctgcgctgccttcgcggccgtctcgcacgcctcgcccgactgtctagggcctttccccacctacctcctatttgccctgctcacctgcacctgcgtctgcagcattgtctgcgtggtcatcaccttcctgcagctcatcgactggtgctgcgcgcgctacaattacctacaccacagtcccgaatacagggacgagaacgtggccagaatcttaaggctcatctgaccatgcagactctgctcatactgctatccctcctataccctgcccttgctgatgattactctaagtgcaaattcgcggacatatggaatttcttagactgctatcaggagaaaatggatatgccttcctattacttggtgattgttggggtagtcatggtctgctcctgcactttctttgccatcatgatctacccctgttttgatcttggctggaactctgttgaggcattcacatacacactagaaagcagttcactagcctccacgccaccacccacaccgcctccccgcagaaatcagtttcccatgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgcctggtcaaacaggcaaagatcacctacgagctcgtgtccggcggcaagcagcatcgcctcgcctatgagctaccccagcagaagcagaagttcacctgcatggtgggcgtcaatcccatagtcatcacccagcagtcgggcgagaccagcggctgcatccactgctcctgcgaaagccccgagtgcatctactccctgctcaagaccctttgcggactccgcgacctcctccccatgaactgatgttgattaaaagcccaaaaaccaatcagtcccttccccatttccccatacccaattaaaatcattggaattaatcattcaataaagatcacttacttgaaatctgaaagtatgtctctggtgtagttgttcagcagcacctcggtaccctcctcccagctctggtactccagtccccggcgggtggcgaacttcctccacaccttgaaagggatgtcaaattcctggtccacaattttcattgtcttccctctcagatggcaaagaggctccgggtggaagatgacttcaaccccgtctacccctatggctacgcgcggaatcagaatatccccttcctcactcccccctttgtctcatccgatggattccaaaacttccccccgggtgtcatgtcactcaaactggctgacccaatcaccatcgtcaatggggatgtctcccttaaggttggagggggacttgccttgcaagaaggaagtggaaagctgacagtcaatactaaggctccattgcaagttgcaaatgataaattagaattagcatttgatgcgccatttcaagaaaaaaatggaaaactggtattgaaaacaggacatggtttagctcttttaactgaagataacacccacataccagacttaattggaacccttgtagtacgaactggaaatggaattggtacaggtagtgtagctggcggaggaaccatagatgtaagacttggaaacgatggtggactctcatttgataaaaagggtgacttagtagcctggaataaaaaagatgacaggcgcactctatggacaacgccagatccatcgccaaattgtagaattgaaaccgcaaaggatgcaaaacttactcttgtcttaacaaagtgcggaagtcagattttagcctctgtttcaattattgtgctaaaaggaacatatgaatatgcaaaaaaggacacaactgttaaagagttcagtattaagttactgtttgataaaaatggagtacttttacctgaatctaatttggacaaagattattggaactacagaagcgatgatttaactatagccaagccatatgaaaatgcagtgcctttcatgccaaatttaaaggcatacccaagacctgatacaactactcaaacaactccaggagataaaaaaagtagtggtaaaaataaaattgttagtaatgtgtattttggaggcgaggtttatcagccaggagttatagttatttattttaatcaagaaaaagacgctaactgtgcttactccataactttgaaatttggatggggaaagacatatgaaacacccgtaccatttgatacctcttctttcaccttctcatacattgcccaagaaaatgaagacaaaaacgaataaagtgttttaaactgaatttatgtatctttattgatttttacaccagcacgggtagtcagtctcccaccaccagcccatttcacagtgtacacggttctttcagcacgggtggccttaaatagggaaatgttctgattagtgcgggaactggacttggggtctataatccacacagtttcctggcgagccaaacgggggtcggtgattgagatgaagccgtcctctggaaagtcatccaagcgggcctcacagtccaaggttacagtctggtggaatgagaagaacgcacagattcatactcggaaaacaggatgggtctgtgcctctccatcagcgccctcaacagtctctgccgccggggctcggtgcgactgctgcagatgggatcgggatcgcaagtctctttgactatgatccccacagccttcagcaacagtctcctggtgcgacgggcacagcaccgcatcctgatctcactcaagttctcacagtaagtgcagcacataatcaccatgttattcagcagcccataattcagggcgctccagccaaagctcatgttggggataatggaacccacgtgaccatcgtaccagatgcggcagtatatcaggtgcctgcccctcat

SEQ ID NO: 1425 - DNA, 32767 bp, Human mastadenovirus B
catcatcaataatataccttatagatggaatggtgccaatatgtaaatgaggcgattttaaaaagtgtgggctgtgtggtgattggctgtggggttaacggctaaaaggggcggcgcgaccgtgggaaaatgacgttctttgggggtggagttttcttgcaagttgtcgcggtaaatgtgacgcatacaaaggttttttttctcacggaactacttagttttcccacggtatttaacaggaaatgaggtagttttggccggatgcaagtgaaaattgttcattttcgcgcgaaaactgaatgaggaagtgtttttctgaataatgcggtctttatggcagggtggagtatttgttcagggccaggtagactttgacctattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaagagttttctcctctgcgccggcagtttaatattaaaaaaatgagaaacttgcgatttctgcctcaggaaataatttctgctgagactggaaacgaaatactggagcttgtggtgcacgccttaatgggagacgatccggagccgcctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctccgagtgatgaggaggaccatgaaacggagcagtctatgcacactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgggggatttgtgcttcttattataggtcctgtgtctgatgctgatgagtcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgagagtgcaatgtaataaaaatatgttaactgttcactggtttttattgctttttgggcggggactcaggtatataagtagaagcagacctgtgtggttagctcataggagctggctttcatccatggaggtttgggccattttggaagaccttagaaagactaggcaactgttagaggacgcttcggacggagtctccggtttttggagattctggttcgctagtgaattagctagggtagtttttaggataaaacaggactataaagaagaatttgaaaagttgttgctagattgcccaggactttttgaagctcttaatttgggtcatcaagttcactttaaagaaaaagttttatcagttttagacttttcaaccccaggtagaactgccgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatgtagtggtactgatgctagatctgagttggctttaagtttaatgagtcgcagacgtcctgaaaccatttggtggcatgaggtccagaaagagggaagggatgaagtttctgtattgcaggaaaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactccagacaagacagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctgtgcgtgttggattgccacagctggcagaaccaagagtcaattgtctctgaagaaatgcatattccaaagatgtaacctgggcattctgaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggtgggcattgtaatatgctggctactgtgcatattgtttcccatcaacgcaaaaaatggcctgtttttgatcacaatgtgttgacgaagtgtaccatgcatgcaggtgggcgtagaggaatgtttatgccttaccagtgtaacatgaatcatgtgaaagtgttgttggaaccagatgccttttccagaatgagcctaacaggaatctttgacatgaacatgcaaatctggaagatcctgaggtatgatgatacgagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaaggtgagtattgggaaaactttggggtggggttttcagatggacagattgagtaaaaatttgttttttctgtctttcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgccgccgcctctgttgccgctaacactgtgcttggaatgggttactatggaagcatcctggctaattccacttcctctaataacccttctaccctgactcaggacaagttacttgtccttttggcccagctggaggctttgacccaacgtctgggtgaactttctcagcaggtggccgagttgcgagtacaaactgagtctgctgtcggcacggcaaagtctaaataaaaaaattccagaatcaatgaataaataaacgagcttgttgttgatttaaaatcaagtgtttttatttcatttttcgtgcacggtatgccctagaccaccgatctcgatcattgagaactcggtggattttttccagaatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcatgcggggtgaaattatgtgcatttttgattggatttttaagttggcaatattgccgccaagatctcgtcttgggttcatgttatgaaggaccaccaagacggtgtatccggtacatttaggaaatttatcgtgcagcttggatggaaaagcgtggaaaaatttggagacacccttgtgtcctccgagattttccatgcactcatccatgataatagcaatggggccgtgggcagcggcgcgggcaaacacgttccgtgggtctgacacatcatagttatgttcctgagttaaatcatcataagccattttaatgaatttggggcggagagtacccgattggggtatgaatgttccttcgggccccggagcatagttcccctcacagatttgcatttcccaagctttcagttccgagggtggaatcatgtccacctggggggctataaagaacaccgtttctggggcgggggtgattagttgggatgatagcaagtttctgagcaattgagatttgccacatccggtggggccataaatgattccgattacaggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtctgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagagttcgagtcagggttgtttccgtcacagtgaaggggtgtgcgcctgcttgggcgcttgccagggtgcgcttcagactcatcctgctggtcgaaaacttctgccgcttggcgccctgtatgtcggccaagtagcagtttaccatgagttcgtagttgagcgcctcggctgcgtgacccttggcgcggagcttacctttggaagttttcttgcataccgggcagtataggcatttcagcgcatacagcttgggcgcaaggaaaatggattctggggagtatgcatccgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtcccagttgggggggtataaaagggggcggttctctgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccgcttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgccaggcacttccattcggggaagatagttgtcaattcatctggcacgattctcacttgccaccctcggttatgcaaggtaattaaatccacactggtggccacctcgcctcgaaggggttcgttggtccagcagagcctacctcctttcctagaacagaaaggtggaagtgggtctagcataagttcatcgggagggtctgcatccatggtaaagattccaggaagtaaatccttatcaaaatagctgatgggagtggggtcatctaaggccatttgccattctcgagctgccagtgcgcgctcgtatgggttaaggggactgccccagggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgacggcgctagcagccccggacccaagttggtgcgattgggtttttctgttctgtagacaatctggcgaaagatggcgtgagaattggaagagatggtgggtctttgaaaaatgttgaagtgggcatgaggtagacctacagagtctctgataaagtgggcataagattcttgaagcttggttaccagttcggcggtgacaagtacgtccagggcgcagtagtcaagtgtttcttgaatgatgtcataacatggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcgaaggtgtctctgaccatgactttgagaaattggtatttgaagtctatgtcgtcacaggctccctgttcccagagttggaagtctacccgtttcttgtaggcggggttgggcaaagcgaaagtaacatcgttgaagagaatcttaccggctctgggcataaaattgcgagtgatgcggaaaggctgtggtacttccgctcgattgttgatcacctgggcagctaggacgatctcgtcgaaaccgttgatgttgtgtcctacaatgtataattctatgaaacgcggcgtgcctctgacgtgaggtagcttattgagctcatcaaaggttaggtctgtagggtcagataaggcgtagtgttcgagggcccattcgtgcagatgaggatttgcatgtaggaatgatgaccaaagatccaccgccagtgctgtttgtaactggtcccgatactgacgaaaatgctggccaattgccattttttctggagtgacacagtagaaggttctgggatcttgttgccatcgatcccacttgagtttaatggctagatcgtgggccatgttgacgagacgctcttctcctgagagtttcatgaccagcatgaaaggaactagttgtttgccaaaggatcccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagttgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgggggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctttcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctaacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagcccctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggttgccgaatggcagggaagtgagtcctatttttttttttttgccgctcagatgcatcccgtgctgcgacagatgcgtccccaacaacagcccccctcgcagcagcagcaaccacaaaaggctgtccctgcaactactgcaactgccgccgtgagcggtgcgggacagcccgcctatgatctggacttggaagagggcgaaggactggcacgtctaggtgcgccctcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaagtgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagtcacccttggtttgatgcatttgtgggatttgatggaagctatcattcagaaccctactagcaaacctctgaccgcacagttgtttctggtggtgcaacacagcagagacaatgaggctttcagagaggcactgctcaacatcaccgaacccgaggggagatggttgtatgatcttatcaacattctacagagtatcatagtgcaggagcggagcctgggcctggccgagaaggtggctgccatcaattactcggttttgagtttgggaaaatattacgctcgcaagatctacaagactccatacgttcccatagacaaggaggtgaagatagatgggttctacatgcgcatgacgctcaaggtcttgaccctgagcgatgatcttggggtgtaccgcaatgacagaatgcatcgcgccgttagcgccagtaggaggcgcgagttaagcgacagggaactgatgcacagtttgcaaagagctctgactggagctggaaccgagggtgagaattactttgacatgggagctgacttgcagtggcagcctagtcgcagggctctgagcgccgcgacggcaggatgtgagcttccttacatagaagaggcggatgaaggcgaggaagaagagggcgagtacttggaagactgatggcacaacccgtgttttttgctagatggaacagcaagcaccggatcccgcaacgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgcgatgccaacctgggttcgctggtggcgttaaatgcttttttgagtactcagcctgctaatgtgccgcgtggtcaacaggattatactaactttttgagtgcattgagactgatggtatctgaagtacctcagagcgaagtgtatcagtccggacctgactacttctttcagactagcagacagggtttgcagacggtaaatctgagccaagcttttaaaaaccttaaaggtttgtggggagtgcatgccccagtaggagaaagagcaaccgtgtctagcttgttaactccgaactcccgcctattactactgttggtagctcctttcaccgacagcggtagcatcgaccgtaattcctatttgggttacctactaaacctgtatcgcgaagccatagggcaaagccaggtggacgagcagacctatcaagaaattacccaagtcagtcgcgctttgggtcaggaagacactggcagtttggaagccactctgaacttcttgcttaccaatcggtctcagaagatccctcctcaatatgctcttactgcggaggaggagaggatccttagatatgtgcagcagagcgtgggattgtttctgatgcaagagggggcaactccgactgcagcattggacatgacggcgcgaaatatggagcccagcatgtatgccagtaaccggcctttcattaacaaactgctggactacttgcacagagctgccgctatgaactctgattatttcaccaatgccatcttaaacccgcactggctgcccccacctggtttctacacgggcgaatatgacatgcccgaccctaatgacgggtttctgtgggacgacgtggacagtgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggaatacctaaacgattccttgctcagaccggcgagagaaaaaaatttcccaaacaatggaatagaaagtttggtggataagatgagtagatggaagacttatgctcaggatcacaaagacgagcctgggatcatggggactacaagtagagcgagccgtagacgccagcgtcatgacagacagaggggtcttgtgtgggacgatgaggattcggccgatgatagcagcgtgttggacttgggtgggagaggaaggggcaacccgtttgctcatttgcgccctcgtttgggtggtatgttgtaaaaaaaaataaaaaggaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtacctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcagaacaatgactttacccctacggaagccagtacccagaccattaactttgatgaacgatcgcggtggggcggtcagctaaagaccatcatgcatactaacatgcccaacgtgaacgagtatatgtttagtaataagttcaaagcgcgtgtgatggtgtccagaaaacctcctgagggtgttagagtagacgatagttatgatcataagcaagatattctaaaatacgagtggttcgagtttactttgccagaaggcaacttttcggtcactatgactattgacttgatgaataatgccatcatagacaattacttgaaagtgggcagacagaatggagtaatggaaagtgacattggtgttaagttcgacaccaggaacttcaagctgggatgggatccagaaactaagttaatcatgcctggggtttacacctatgaggccttccatcctgacatcgtattgctgcctggctgcggagtggattttacagaaagccgtctgagcaaccttcttggcattagaaagaaacacccattccaagagggttttaagatcttgtatgaggatttagaaggaggaaatattccagcccttttggatgtagatgcttatgagaacagcaagaaagatcaaaaagccaaaatagaagctgctacagctgctgcggaagctaaggcaaacatagttgccagcgactctacaagggtcgctaacgctggagaggtcagaggagacaattttgcaccaacacctgttccgactgcaaaatcattattggccaatatgactgaaggaacggacgtgaaactcactattcaacctgtagaaaaagatagtaagaatagaagctataatgtgttggaagataaaatcaacacagcctatcgcagttggtacctttcgtacaattatggcgatcccgaaaaaggagtgcgttcctggacattgctcaccacttcagatgtcacctgcggagcagagcaggtctactggtcgcttccagacatgatgcaggatcctatcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaatgtccattcttatctcgcccagtaataacaccggttggggtctgcgcgctccaagcaagatgtacggaggcgcacgcaaacgttctacccaacatcccgtgcgtgttcgcggtcattttcgcgctccatggggtgccctcaagggccgtactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtgggacgaagagccatgcttagggcggccagacgtgcagcttcgggtgccagcgccggcaggtcccgcaggcaagcagccgctgtcgcagcggcgactattgccgacatggcccaaacgcgaagaggcaatgtatactgggtgcgtgacgctgccaccggtcaacgtgtacccgtgcgcacccgtccccctcgcacttagaagatactgagcagtctccgatgttgtgtctcagcggcgaggatgtccaagcgcaaatacaaggaagaaatgctgcaggttatcgcacctgaagtctacggccaaccgttgaaggatgaaaaaaaaccccgcaaaatcaagcgggctaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataaatcccaaggatgagacagtgtccatacccttggatcatggaaatcccacccctagtcttaaaccggtcactttgcagcaagtgttacccgtaactccgcgaacaggtgttaaacgcgaaggtgaagatttgtatcccactatgcaactaatggtacccaaacgccaaaagttggaggacgttttggagaaagtaaaagtggatccagatattcaacctgaggttaaagtgagacccattaagcaggtagcgcctggtctgggagtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggttcagcaagtctgttgatgcccaactatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaattcgcgccgtagaagagggatgttggggcgcggaatgcgacgctacaggcgacggcgtgctatccgcaagcaattgcggggtggttttttgccagccttaattccaattatcgctgctgcaattggcgcgataccaggcatagcttccgtggcggttcaggcctcgcaacgacattgacattggaaaaaacgtataaataaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaactttcaacaaaaagtagtcgatgggatagcttccggcatcaatggagtggtagatttggctaatcaggctgtgcagaaaaagataaacagtcgtttggacccgccgccagcaaccccaggtgaaatgcaagtggaggaagaaattcctccgccagaaaaacgaggcgacaagcgtccgcgtcccgatttagaagagacgctggtgacgcgcgtagatgaaccgccttcttatgaggaagcaacgaagcttggaatgcccaccactagaccgatagcccctatggctaccggggtgatgaaaccttctcagttgcatcgacccgtcaccttggatttgccccctccccctgctgtacccgcttctaagcctgtcgctgtcccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccagtgggcatacatgcacatcgccggacaggatgcttcggagtacctgagtccgggtctggtgcagttcgcccgcgccacagacacctacttcaatcttggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagtttcaaaccctattctggtacggcttacaactctctggctcctaaaggcgctccaaatgcatctcagtggttggataagggagttacaagcactggtctagtggacgacgggaatgatgatgatggggaagaagccaaaaaagcaacatacacttttggtaacgctccagtaaaagccgaggctgaaatcacaaaagacggattgccggtgggcttggaggtttcaactgaaggtcctaaaccaatctatgctgataagctttatcagccagaacctcaagtgggagacgaaacttggactgacctagacggaaaaaccgaagagtatggagggagagttcttaaacctgaaactaaaatgaaaccctgctacggatcttttgctaaacctactaatattaaaggaggtcaggcaaaggtaaaaccaaaagaagacgatggcactaacaacatcgaatatgacattgacatgaacttctttgacttaagatcacaaagatcagaactgaaacctaaaattgtaatgtatgcagaaaatgtggacctggaatctccagatactcatgttgtgtacaaacctggagtttcagatgctagttctgagaccaatcttggacaacagtctatgcccaacagacccaactacattggcttcagagataacttcatcggacttatgtactataacagtactggcaacatgggggtactggctggtcaagcgtctcagttgaatgcagtggtggacttgcaggacagaaacacagaactgtcttaccaactcttgcttgactctctgggcgacagaaccagatattttagcatgtggaatcaggctgtggacagttatgatcctgatgtacgtgttattgaaaatcatggtgtggaagatgaacttcccaactattgttttccgttggatggtgtcggtccgcaaacagatagttacaaggagattaaaccaaatggagaccaatctacttggacaaatgtagacccaaatggcagcagtcaacttgctaagggaaatccatttgccatggaaattaaccttcaagccaatctatggcgaagtttcctttattccaatgtggctctgtatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctacggaatgacaccaatgatcagtcattcaacgactacctatctgcagctaacatgctctaccccattcctgccaatgcaaccaatattcccatttccattccttctcgcaactgggcggctttcagaggctggtcatttaccagactcaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggcccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctctcatcgtacacacatcgaaagggccactgcgttcgaccgtatggatgttcaataatgactcatgtaaacaacgtgttcaataaacatcactttatttttttacatgtatcaaggctctggattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctctgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcttttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggtcctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacagcgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcctatcagtgtggaagagctcagccgcgcctacgagcttaacctcttttcacctcgtactccacccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtctatctctacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcggccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactaatcttgcttgttttactttcgcttttggaaccgggttctgccaattacgatccatgtctagactttgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcatggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcactaatagattacgaaagtgaaccacaacccccactactccctgctattagttacttcaacctaaccggcggagatgactgaaacactcaccacctccaattccgccgaggatctgctcgatatggacggccgcgtctcagaacagcgactcgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacactaagcccagacggagttcttactttaaaatgtttaaccccactaacaaccacaggcggatctctacagctaaaagtgggagggggacttacagtggatgacaccaacggttttttgaaagaaaacataagtgccaccacaccactcgttaagactgctcactctataggtttaccactaggagccggattgggaacgaatgaaaataaactttgtatcaaattaggacaaggacttacattcaattcaaacaacatttgcattgatgataatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcacactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacagcacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaaga

(The sequence listing continues in the following parts.)

10. The method of claim 1, wherein the viral vector backbone nucleic acid sequence is at least 800 bp in length.

11. The method of claim 10, wherein the viral vector backbone nucleic acid sequence is no more than 2.5 kilobases in length.

12. The method of claim 1, wherein the probes are 100% complementary to the viral vector backbone nucleic acid sequence.

13. The method of claim 1, wherein the probes are tiled with a spacing of 2 nucleotides between each consecutive probe when hybridized to the viral vector backbone nucleic acid sequence.

* * * * *